United States Patent 11,931,406 (FLAVIVIRUS VACCINE) - sequence listing, part 56

SEQ ID NO: 20113 - RNA, 9876 nt, Artificial Sequence
  derived and/or modified CDS sequence (opt5) from DENV-2__EU482666__SS-prME
accgccggagugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuaucauacacaaaccgccgggcccuggcaccuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguacggaauggaaauccggccccuuaaggagaaggaagagaaucuggucaacucucucgugacagcgggccaugggcagaucgauaauuuuagccugggagugcugggcauggcccuuuuccucgaagagaugcugagaacccgcgucgggacgaaacacgcuauucugcucguugccguguccuuuaugacccugaucacaggaaacaugucuuuccgggaccuuggcagagugauggucauggugggcgccaccaugacagaugacauugggaugggaguuaccuaucuggcucuccuggccgcguuuaaggugcgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugaugguccugaaaauuaugcggaauauggaaaaguaccaacuugcugugacaaucauggccauuagcugcguuccuaacgccgugauccugcagaaugcuuggaaggucuccuguacgauucucgccgcugugagcguuucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccguggggauggucucuauucuggcuuccagccuccugaaaaacgacaucccuaugacaggaccccucguggccggcggccugcuuaccgugugcuauguccugaccgggcgguccgccgaucuggaacucgagcgcgcuacagacguuaagugggaggaucaagcggaaauuagcggaucuagcccuauccuguccauuaccaucucugaggacggcagcauguccaucaaaaaugaagaggaggaacagacacuuacgauucugaucagaaccgggcuccuggugauuucuggacucuuccccgugagcaucccgauuacagccgcugccugguaccugugggaggucaagaagcagcgggccggcgugcuuugggauguuccuucucccccucccguggggaaagcugaacuggaggacggagccuaucgcaucaagcagaaaggcauccugggcuacagccaaauuggggcgggagucuauaaggaaggcaccuuucacacaauguggcaugugaccagaggggcuguucucaugcaccggggaaaacgcaucgagcccagcugggccgaugugaagaaggaccugauuuccuacggcgggggauggaaacuugagggcgaauggaaggagggcgaagagguccaggugcuggcccucgaaccugggaaaaacccgagagcuguccagacgaagcccggacuguucaaaaccaauacaggcaccaucggggccgugagccucgauuuuucuccuggaacauccggcagccccauuguugaccggaaggggaagguggucggacuguacggcaacggcgugguuaccagaucuggggcguauguguccgcuaucgcccagacagagaaaagcaucgaggauaauccugaaauugaggacgauaucuuccgcaagaaacggcuuacgauuauggaccugcaucccggagccggcaagaccaaaagauaccugccugcuaucguccgcgaagccauuaagcgggggcucagaacacugauccuugcuccgacccgcgugguggccgcggagauggaagaggcccugcggggacuccccauuagauaucaaaccccugcuauccgcgccgagcacacaggccgggaaaucguugaccugaugugucaugcuacguucaccaugagacuccugucccccguccgggugccuaacuacaaccuuauuaucauggaugaggcccacuuuacagaccccgccucuauugcugcgcgcggguauaucagcaccagaguggaaaugggcgaggccgcuggaauuuucaugacagccaccccgccuggcucccgggaucccuuuccccagagcaaugccccuaucaucgacgaggaacgcgagauucccgaaagaucuuggaacuccgggcacgagugggucacggauuucaagggaaaaacagugugguuuguuccuagcaucaaggcuggcaaugacauugccgcgugccugcggaaaaacgggaagaaagugauccagcugucuagaaagaccuucgauagcgaauacgucaagacccgcacaaaugacugggauuuugugguuaccacagacauuuccgagaugggagcuaacuucaaagccgagcgggugaucgauccgagacgcuguaugaagcccgucauccucaccgacggcgaagaacgggugauucuggccgggccuaugcccguuacgcauucuagcgcugcccaaagacgcggccggaucggaagaaauccuaaaaacgaaaaugaccaguauauuuacaugggcgagccccuugaaaacgaugaggacugcgcgcacuggaaggaggccaaaaugcugcucgauaauaucaacacaccggaagggauuaucccuuccauguuugagcccgaacgcgagaagguggacgcuauugauggagaauacagacugcggggcgaggcccgcaaaaccuucgucgaccugaugagaagaggggaucucccuguguggcuugcuuaucgcguggccgcugagggaaucaauuacgccgacagacggugguguuuugauggcgucaagaacaaucagauccuggaagagaacguugaaguggagauuuggacaaaggagggggaacgcaagaagcugaaaccccgcuggcucgacgcgcggaucuauucugauccucuggcccuuaaggaguucaaagaguucgcugccggcagaaagagccugacccucaaccugauuacggagaugggacgccugcccaccuuuaugacacagaaggcucgggacgcccucgauaaucuugccgugcugcauaccgcugaagcgggcgggagagccuacaaccacgcucuguccgagcucccggagacacuggaaacccuucugcuccugacacugcucgccaccgucacgggaggcaucuuccuuuuucugaugagcgggaaaggagugggcaagaugacacugggcaugugcugcauuaucaccgccucuauccuccugugguaugcucaaauucagccucacuggaucgccgcguccauuauccuugaguucuuucugauuguucuccugauccccgaacccgagaaacagcggaccccucaggacaaucaacugacauacguggucaucgccauucucaccgugguugcugccacaauggcuaacgaaaugggguuccuugagaagacgaaaaaggaccugggacugggcagcaucgccacccaggagccggaauccaauauucucgauaucgaccugcgccccgcgucugccuggacacuuuaugcuguggccaccacauuugucaccccuaugcugagacauagcauugagaacuccucugugaaugucagccucacggcuaucgccaaccaggcuaccgugcugauggggcugggaaagggcuggccccucuccaaaauggauauugggguuccucuucuggccaucggauguuacagccaggugaaucccaucacacugaccgcggcccuccugcuucugauugcucacuacgccaucauuggcccuggccuccaagcuaaggccacacgggaagcccagaaacgcgcggcugccgggaucaugaagaacccgaccguggacggaauuacggucaucgaucuggaccccaucccuuaugaucccaaauucgagaagcagcugggccagguuaugcuccuuauucugugcgugacacaagugcugaugaugagaaccacaugggcucucugugaagcccugacccuugccaccgggccuaucucuacacugugggagggaaaucccggccgguuuuggaacacgaccauugcugucuccauggccaauaucuuccgcgggagcuaccucgcgggagccggccugcuguuuucuauuaugaagaacacaaccaauacaagacggggcaccgggaacaucggagagacgcucggcgaaaaauggaagucccgccuuaaugcucuggggaaaagcgaguuccagaucuauaagaaaucuggcauucaggaaguggacagaacacuggccaaggagggcaucaaaagaggggaaaccgaucaucacgcuguuagcagaggauccgccaagcuccgcugguuuguggaacggaacauggucaccccggagggcaagguggucgaccugggcugcgggagaggaggcuggucuuacuauugugggggacuuaaaaacgugcgcgaaguuaagggccugacaaaagggggaccuggccaugaggaacccauucccaugagcaccuacggcuggaaucucgugcggcugcaauccggggucgauguguucuucacaccucccgagaagugcgacacgcugcucugugauaucggagagagcuccccuaacccgaccauugaagcgggcagaacacuucgcguucugucucugguggagaauuggcucaacaaugacacccaguuuugcaucaaaguccugaaccccuauaugccuagcgugaucgaaaagauggagacacuucagcggaaguacgggggagcccuggugagaaauccccucucccgcaacucuacccacgaaauguacuggguuagcaaugcuacgggcaacauugucuccucugugaauaugaucagccggaugcugauuaacagauucaccaugaaacacaagaaagccacauaugagccugacguggaucugggguccggaacccgcaauaucggcauugagagcgaaauccccaaccucgacauuaucggcaagcggaucgagaaaauuaagcaggaacaugagacaucuuggcacuacgaucaagaccauccguauaagaccugggcuuaccacggguccuaugaaacaaaacagaccggaagcgccucuuccauggucaauggcguugugagacuucugacgaagccuugggaugugguccccauggugacacagauggcuaugaccgacaccacaccuuuugggcagcaacgcguuuucaaagagaagguggauacgagaacccaggagcccaaagaaggaacaaagaagcugaugaaaaucaccgccgaguggcucuggaaggaacugggcaaaaagaaaacaccucggauguguacccgcgaggaguuuacaagaaagguccggagcaacgcggcccuuggggcuauuuucaccgacgaaaacaaauggaagucugccagagaggcuguggaagauucccgguuuugggagcugguugacaaggaacgcaaucuccaccuggagggaaaaugcgagacguguguguacaacaugaugggcaagagagagaagaagcugggcgaguucgggaaagccaagggaagccgggccaucugguauauguggcucggcgcgcgcuuucuggaguucgaggcucuuggguuucugaaugaagaucauugguucuccagagagaacagccucucuggagucgagggcgaagggcugcacaaacuuggcuacauucugcgggacgugagcaaaaaggagggaggcgccauguacgccgacgauaccgcugggugggacacacgcaucacccucgaagaucugaaaaaugaggaaauggugacaaaccauauggagggagagcacaagagacuggccgaagcuaucuuuaaacucaccuaucagaauaaggucguucgggugcagcgccccacgccgagaggcacagugauggacauuaucucccggcgcgaucaaagagggucuggacaggucggcaccuacgggcugaacacauucaccaauauggaggcccagcuuauucggcaaauggaaggcgagggaaucuucaagagcauucagcaucugacggugaccgaggaaaucgcgguucagaacuggcucgcccgcgugggcagagagcggcuguccagaauggcuaucucuggggacgauugcgucgugaaaccucuugacgaucgcuuugccagcgcucugacagcccucaaugacaugggaaagguucggaaagauauucagcaaugggaacccuccaagggcuggaacgacuggacccaggugcccuucugcucucaccacuuucaugagcugaucaugaaagaugggagaguccuggugguuccuugucgcaaucaggacgaacucauuggacgggcgagaaucagccagggcgccggguggucccugaaggagacagcuugccuuggcaagagcuaugcccaaauguggucucugauguacuuccaccgccgggaccucagacuggcugccaacgcuauuuguuccgccgugccgagccauuggguccccaccucucgcacaaccugguccauccacgcgaaacacgaguggaugacgacagaagauaugcuuaccguguggaaucgggucuggauucaggagaacccuuggauggaagacaagacccccguggagagcugggaagagguuccuuaucugggaaaaagagaggaucaguggugcggcucccucaucgggcugacaucucgcgccaccugggcuaagaacauccagacagccauuaaucaagugcggagccugaucggaaacgaagaguacacggacuauaugcccuccaugaaaagauuucggagagaagaggaagaggccggcguccucugguga

SEQ ID NO: 20114 - RNA, 9876 nt, Artificial Sequence
  derived and/or modified CDS sequence (opt5) from DENV-2__EU482667__SS-prME
agcgccggcaugaucauuaugcugauccccaccgugauggcuuuccaccugaccacgagaaauggggaaccucauaugauugucggaauccaggaaaagggcaagagccugcuuuuuaagaccgaagacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauuguuaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaagcccuggugaccuucaagaacccucaugcuaaaaagcaagacguugugguccucggaagccaggagggcgccaugcacacagcccugaccggggcuacggaaauccagauguccucuggcaaucuucuguuuacaggacaucucaaaugccgccugagaauggacaaacuucaacugaagggcaugagcuacuccauguguaccgggaaauucaagguggucaaagagauugcggagacacagcacggaaccaucgugauuaagguucaguaugaaggcgaugggagccccugcaaaauccccuucgagaucauggaccucgaaaagcgguacgugcugggaagacugauuaccgucaacccuaucgugacagagaaggauucuccgguuaacauugaagccgagcccccuuuuggcgacuccuacaucauuaucgggguggagcccggccagcucaaacugaauugguucaagaaaggaagcucuauuggccaaauguuugaaacgaccaugcgcggggcuaagcggauggccauccuuggagauacagccugggacuucggcagccucgggggagucuuuaccuccaucggcaaagcucuccaucagguguucggggccauuuauggcgcggcuuuuucuggagugagcuggacaaugaagauccugauuggcguuaucauuaccuggaucgggaugaacuccagaagcacgucucuguccgucagccuugugcucgugggaaucgucacacuguaccugggcgugaugguucaggccgauucuggguguguggucuccuggaagaauaaagagcucaagugcggaagcggcauuuucaucaccgacaacgugcacaccuggacagaacaguauaaauuucaaccugagucccccucuaagcuggccagcgcuauucagaaagcccaggaagaggggaucuguggcauucgcuccguuacccggcuugagaaucugauguggaagcagaucacaccggaacucaaccacauccuggcugagaaugaagugaaacugacgauuaugaccggagauaucaagggcauuaugcaagccgggaagagaucucuucgcccucagcccacagagcucaaauacagcuggaagaccuggggaaaagcgaagaugcuguccacagaaagcuauaaccagaccuuccugaucgacggcccugagacggccgagugccccaauaccaaccgggcuuggaacucucucgaagucgaggauuacggguuuggaguguucacaaccaacauuuggcugaaacuuaaggaaaagcaggacgucuuuugugacuccaaacugaugagcgccgcuaucaaggauaauagagccgugcaugcggacaugggcuauuggaucgagucugcccucaacgauacauggaaaauugagaaggcuuccuucaucgaagucaaaaauugccacuggccuaagagccauacccuguggucuaacggcgugcuggagagcgaaaugauuauccccaagaaccuugccgggccggugucccaacacaauuaccgcccuggauaccacacacagauugcuggccccuggcaucucgggaaacuggagauggacuucgauuuuugugacggaaccacggucaucguuacagaagauugcggcaaccgggggcccagccugagaaccaccacagccucuggaaagcucauuaccgaguggugcugucgcuccugcacgcugccuccgcuucgguauagaggcgaggacggcuguugguacgggauggaaauccggccccugaaagagaaggaagagaaucucgugaacagccuggugacagccggacacggccaggucgauaauuucucccugggggugcuuggaauggcucucuuucuggaagagaugcugcgcaccagaguuggcacaaaacaugcgauccuccugguggccgucucuuucgugacccuuauuacagggaacaugagcuuuaaggaccugggacggguuguggucauggugggcgcuaccauggccgaugacaucggcauggggguuacguaucucgcccugcuggcugccuucaaggugagaccuaccuuugcggcuggacuucugcuccgcaaacugacauccaaggagcucaugaugaccacaauuggcaucguccugcuuucucaaagcaccauucccgaaacggugcuggagcucacagaugcccuggcccuggggaugauggugcuuaaaaucguccggaauauggaaaaguaccagcuggcuguuaccaucauggccauucucugcgugccuaacgcggugauccugcagaaugcuuggaaagucuccuguacaauucucgccgugguuucugugagcccccugcuucugaccuccagccagcaaaagaccgacuggaucccucucgcccugacaauuaaaggacugaaccccacggcuaucuuccuuaccacacugucuagaaccaauaagaagcgcuccuggccgcucaacgaggccaucauggcugucggcauggugagcauucuggccucuucccuccugaaaaaugacaucccuaugacagggccccuuguugcgggaggccugcugaccgugugcuauguccucacgggcagaagcgccgaucuggaacuugagcgggcuacagacgugaagugggaggaucaggccgaaauuucuggguccagcccuauccuguccauuaccaucagcgaggacggaucuaugagcauuaaaaacgaagaggaggaacagacccucacaauccugauccgcaccggccuccuggucauuuccgggcuuuuucccaucucuauuccgaucacagcugccgccugguaccugugggaggugaagaaacagagagcuggaguucugugggaugugccuucucccccucccaugggcaaggcggaacucgaggacggggccuaucggauuaagcaaaaaggaauccugggcuacucccagaucggcgcuggggucuacaaggaaggaacguuccacaccauguggcaugugacacgcggcgccguucuuaugcacaaagggaagagaauugagcccuccugggccgaugugaaaaaggaccugaucagcuauggaggcggguggaagcucgagggagaauggaaagagggcgaagagguccaggugcuggcucucgaaccuggcaagaauccgcgggccgugcagaccaaacccgggcuguuuaagacaaacaccggaacgauuggcgcgguuucccuugauuucucuccugggaccagcggaucccccaucauugacaaaaagggcaaggucguggggcuguacggaaacggcguggucacacgcagcggcgcuuaugugucugccaucgcccaaaccgagaaauccaucgaggauaauccugaaauugaggacgauaucuuuagaaagcggcgccugacaauuauggaccuccaccccggggcuggaaaaaccaagagauaccugccugccaucguucgggaagcgauuaaaagaggccuucgcacacugauccucgcuccgacgcggguggucgccgccgagauggaagaggcucugagagggcuccccauucgcuaucagaccccugccauccgggcugagcauacaggaagagaaaucguggaccugaugugucacgccaccuucaccaugcgccuucugagccccguucgggugccuaacuacaaucugauuaucauggaugaggcgcauuucacagaccccgccucuauugcugccagaggcuauaucuccacgcgcgucgaaaugggggaggcugccggcauuuuuaugaccgccacaccgccuggaagccgggaucccuucccccaguccaacgcuccuaucaucgacgaggaaagagagauucccgaacggucuuggaauagcggccacgagugggugaccgauuuuaaggggaagacaguuugguucgugccuuccaucaaagcgggaaacgacauugccgcuugccuccgcaagaauggcaaaaaggucauccaacugagcagaaaaaccuuugauucugaauacgugaagacgcggacaaacgacugggauuucguggucaccaccgacauuuccgagaugggggccaauuuuaaagccgagcgcguuaucgauccgagacgguguaugaagcccgugauccuuacagacggagaagagagagugauucuggcuggcccuaugcccgucacccauagcucugccgcgcagcgccgggggagaaucggccgcaacccuaagaaugaaaacgaccaguacauuuauaugggagagccccucgaaaaugaugaggacugcgcucacuggaaagaggccaagaugcugcuggauaacaucaauacaccggaaggcauuaucccuagcauguucgagcccgaacgggagaaaguggacgccauugauggggaauacagacuccgcggagaggcucggaagaccuuuguugaccuuaugagacgcggcgaucugccuguguggcuggccuauaaagucgcggccgaggggaucaacuacgcugacagacggugguguuucgauggaaucaagaacaaucagauucucgaagagaacguggaaguugagaucuggacgaaggagggcgaacgcaaaaagcugaaacccagauggcuugacgcccggauuuauuccgauccucuggcucucaaggaguuuaaagaguucgccgcugggcgcaagucucugacacugaaucucaucaccgagaugggcagacuucccacauucaugacccaaaagacgcgggacgcccuggauaaccuggcggugcuccacaccgccgaagcuggaggcagagccuacaaucaugcucugagcgagcuuccggagacacuggaaacccuccugcugcucacacuucuggccaccgucacagggggaauuuuucuguuccucauguccggccgcgggaucggaaaaaugacccugggcaugugcugcaucauuacggccucuauccuucugugguaugcucagauucagccucacuggaucgcggccagcauuauccucgaguuuuuccugaucgugcugcucauucccgaacccgagaagcagcggacaccucaagacaaccagcuuaccuacgucgugaucgcuauucugaccguuguggccgccacaauggcuaaugaaaugggcuuucuggagaaaaccaagaaagacuucgggcucggauccaucgccacacagcagccggagagcaacauucuggauaucgaccuuagacccgcgucugccuggacgcuguacgcuguggccaccacauuugucaccccuaugcuccgccauuccauugaaaauagcuccguuaacgugucucugacagcuaucgccaaucaagcgaccgugcugaugggccucgggaagggauggccccuuagcaagauggauaucggcgucccucugcuggccauuggguguuauucccaggugaaccccaucacgcucaccgcugcccugcuucugcucguugcucacuacgccauuaucggaccuggccugcaggcuaaagccacacgggaggcgcagaagagagccgcugccggcauuaugaaaaauccgaccguggacgggaucacagucaucgaucuggaccccauuccuuaugaucccaaguucgaaaaacaacucggacaggugaugcuucugauccugugcgucacccaggugcucaugaugcggacgacaugggcucugugugaggcccuuacccuggccacaggcccuauuucuacccucugggaagggaaccccggacgcuuuuggaauaccacaaucgcgguuagcauggcuaacauuuucagaggcuccuaccuggccggggcuggacugcucuuuagcaucaugaagaauacgaccaacacacggcgcggcaccggcaacaucggggagacacuuggagagaaauggaagucuagacugaaugcccugggcaaguccgaguuccaaauuuauaaaaagagcgggauccaggagguggaccggacccucgccaaagaaggaauuaagcgcggcgagacggaucaccaugcugucucuagaggguccgccaaacugcggugguuuguggagcgcaacaugguuacaccggaaggaaagguggucgaccuuggcugcggcagagggggauggagcuacuauuguggcgggcugaagaaugugcgggaggugaaaggacucaccaagggcgggccuggacacgaagaacccauccccaugucuaccuacggcuggaaccugguuagacugcagagcggcgucgauguguucuucauuccucccgaaaaaugcgacacacuccuuugugauaucggggaguccucuccuaauccgaccguggaggcgggacgcacacugcggguccugaaccucguugaaaauuggcugaacaauaacacgcaguuuugcaucaaggugcuuaaucccuacaugccuagcgugauugagaaaauggaagcccugcaaagaaaguauggcggggcucucguccgcaacccccugucccggaauagcacccaugagauguacuggguguccaacgccucuggaaauaucguuagcuccgugaacaugauuucuagaaugcugaucaaccgcuucacaaugcggcacaagaaagcuaccuaugaaccugacgucgaccucggcagcgggacaagaaauauuggaaucgaguccgagauucccaaccuugauaucaucggcaagcgcauugagaagaucaagcaggagcaugaaaccucuuggcacuacgaccaggaucacccguauaaaacgugggccuaccauggcagcuaugagaccaagcagacaggguccgcgagcucuauggugaauggaguugugcggcugcugaccaagccuugggacguccuccccacagugacccaaauggccaugacagauaccacgccuuuuggccagcagagaguguucaaagaaaaggucgacacacgcacccaggagcccaaagaggggaccaagaaacugaugaagauuacagcugaauggcuuuggaaagagcugggaaagaagaaaacgccucggauguguaccagagaagaguuuacacgcaagguuagauccaacgccgcucucggcgccaucuucaccgaugagaauaaauggaaaagcgcucgggaagccguggaggacucucgcuuuugggaacugguggauaaagagagaaaccugcaccucgaagggaagugcgagacaugugucuacaauaugaugggaaagcgggagaaaaagcugggcgaguucggcaaagcgaagggguccagagccauuugguacauguggcuuggagcucgguuucuggaguucgaagcccucggcuuucugaacgaggaccauugguucagccgcgaaaauucucuuuccgggguggagggagagggccugcacaaacucggguauauccugagagauguuagcaagaaggaaggcggagcuauguacgccgacgacaccgccggcugggauacacggaucacccuggaggaccucaaaaacgaagagauggugacgaaucacauggaaggggagcauaagaaacuggcggaggcuauuuuuaaacuuaccuaucaaaacaaagucgugcgcguucagagacccacaccgcggggaaccgugauggauaucauuucccgcagagaccagcggggcagcgggcaagucggaacauacggccugaauaccuucacgaacauggaagcccagcucauccgccagauggagggggaaggcguguucaagaauauucagcaccugacaguuaccgaggagguggccguccaaaacuggcuugcuagagugggacgggaacgccugucuagaauggccaucagcggcgaugacugcgucgugaagccucucgaugaccgguuugcuaacgcccugacagcgcugaaugauauggggaaaauccgcaaggacauucagcagugggagcccuccaaaggauggaacgauuggacccagguucccuucugcucucaucacuuucaugaacucaucaugaaggacggcagagugcuggucgugccuugucggaaucaagaugagcuuauugggagagcccgcaucagccagggagcuggcuggucccugcgggaaacggccugccucgggaaaucuuaugcucagauguggagccugauguacuuccacagacgcgaccuucggcuggccgcgaacgccauuuguuccgcugugccgucucacuggguucccaccagcagaacaaccugguccauccaugccaagcacgaguggaugacaaccgaggacaugcucacaguguggaaucgcgucuggauucgggaaaacccuuggauggaggauaagacccccguggaaagcugggaggaaaucccuuaucugggcaaaagagaggaccaguggugcggaucucugaucggccucacgucccgcgcuacaugggccaagaauauucaagcugccaucaaccagguucggagccugauugggaaugaggaauacaccgauuacaugcccucuaugaaaagauuucgccgggaggaagaggaagcgggagugcuuugguga

SEQ ID NO: 20115 - RNA, 9876 nt, Artificial Sequence
  derived and/or modified CDS sequence (opt5) from DENV-2__EU482668__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauauccgcggcauuaugcaagcugggaagcggucucuuagaccucagcccaccgagcucaaauacagcuggaagacauggggaaaggccaaaaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaagaaaagcaggacgcuuuuugugacuccaaacugaugagcgccgcuaucaaggauaaucgggccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuacagaccuggauaccacacccagauugcuggccccuggcaucucgggaaacuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaggagaaagaagagaaucucguuaacagccuggugaccgccggacacggccagguggauaauuucucccuggggguccuuggaauggcucucuuucuggaagagaugcugcggacaagagugggcaccaagcaugcgauccuccugguugccgugucuuucgucacacuuauuaccgggaacaugagcuuuaaagaccugggacgcgugguugugauggucggcgcuacgauggccgaugacaucggcaugggggugaccuaucucgcccugcuggcugccuucaagguucggccuacauuugcggcuggacuucugcucagaaaacugaccuccaaggagcucaugaugacaaccauuggcaucgugcugcuuucucaaagcacgauucccgaaacaguccuggagcucaccgaugcccuggcccuggggaugauggugcuuaagaucgugcgcaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucuagaacaaauaaaaagcgguccuggccgcucaacgaggccaucauggcugugggcauggucagcauucuggccucuucccuccugaaaaaugacaucccuaugaccgggccccuuguggcgggaggccugcugacgguuugcuaugugcucacaggccgcagcgccgaucuggaacuugagagagcuaccgacgucaagugggaggaucaggccgaaauuucuggguccagcccuauccuguccauuaccaucagcgaggacggaucuaugagcauuaagaacgaagaggaggaacagacacucaccauccugauccggacaggccuccuggugauuuccgggcuuuuucccaucucuauuccgaucacggcugccgccugguaccugugggaggucaaaaagcagcgcgcuggagugcugugggauguuccuucucccccucccaugggcaaagcggaacucgaggacggggccuauagaauuaagcaaaaaggaauccugggcuacucccagaucggcgcugggguguacaaggaaggaaccuuccacacaauguggcaugucacccggggcgccgugcuuaugcacaaggggaaacgcauugagcccuccugggccgauguuaagaaagaccugaucagcuauggaggcggguggaagcucgagggagaauggaaagagggcgaagaggugcagguccuggcucucgaaccuggcaagaauccgagagccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugacccggagcggcgcuuaugucucugccaucgcccaaacagagaaauccaucgaggauaauccugaaauugaggacgauaucuuucgcaagagacggcugaccauuauggaccuccaccccggggcuggaaagacaaaaagauaccugccugccaucgugcgcgaagcgauuaagcggggccuuagaacgcugauccucgcuccgacccgcguuguggccgccgagauggaagaggcucugcgggggcuccccauuagauaucagaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaguccaacgcuccuaucaucgacgaggaacgcgagauucccgaaagaucuuggaauagcggccacgagugggucacagauuuuaaagggaagaccgugugguucguuccuuccaucaaagcgggaaacgacauugccgcuugccuccggaagaauggcaagaaagugauccaacugagccgcaagacguuugauucugaauacgucaaaacaagaaccaacgacugggauuucguggugaccacagacauuuccgagaugggggccaauuuuaaggccgagcgggucaucgauccgagacgcuguaugaaacccguuauccuuaccgacggagaggaacgggugauucuggcuggcccuaugcccgugacacauagcucugccgcgcagagacgcgggcggaucggcagaaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgcgagaaggucgacgccauugauggggaauaccggcucagaggagaggcucgcaaaacguuuguggaccuuaugagacggggcgaucugccuguuuggcuggccuauaagguggcggccgaggggaucaacuacgcugaccgcagaugguguuucgauggaaucaaaaacaaucagauucucgaagagaacgucgaaguggagaucuggacaaaggagggcgaacggaaaaagcugaagccccgcuggcuugacgccagaauuuauuccgauccucuggcucucaaagaguuuaaggaguucgccgcugggcggaaaucucugacccugaaucucaucacagagaugggcagacuucccaccuucaugacgcaaaagacccgcgacgcccuggauaaccuggcgguucuccacacagccgaagcuggaggccgggccuacaaucaugcucugagcgagcuuccggagacccuggaaacacuccugcugcucacccuucuggccacagugaccgggggaauuuuucuguuccucauguccggcagagggaucggaaaaaugacgcugggcaugugcugcaucauuacagccucuauccuucugugguaugcucagauucagccucacuggaucgcggccagcauuauccucgaguuuuuccugaucguccugcucauucccgaacccgagaagcagcgcaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcggcccgcgucugccuggacccucuacgcuguggccacaaccuucgugacaccuaugcugagacauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaagccacccgggaggcgcagaagcgcgccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugagaacaaccugggcucuuugugaggcccugacacucgccaccggcccuauuucuacccugugggaagggaaccccggacgguucuggaauacaacgaucgcggugagcauggcuaacauuuuucgcggcuccuaccuggccggggcuggacuccuuuucagcaucaugaaaaauaccacaaacaccagacggggcacaggcaacaucggggagacccugggagagaaguggaaaucucgccugaaugcccucggcaaguccgaauuucaaauuuauaaaaagagcgggauccaggagguugacagaacgcuggccaaggaaggaauuaaacggggcgagacagaucaccaugcugugucucgcggguccgccaaacuuagaugguucgucgagcggaacauggugaccccggaaggaaaaguuguggaccugggcugcggcagagggggauggagcuacuauuguggcgggcucaagaauguccgcgaggugaaaggacugaccaagggcgggccuggacacgaggaacccauccccaugucuacauacggcuggaaccuggugcggcuccagagcggcguugaugucuuuuucauuccucccgaaaagugcgacacccuucugugugauaucggggaguccucuccuaauccgacaguggaggcgggaagaacgcugcgcgugcucaaccuggucgaaaauuggcuuaacaauaacacccaguucugcaucaaaguucugaaucccuacaugccuagcgugauugagaagauggaagcccuccaacggaaauauggcggggcucuggugagaaacccccugucccgcaauagcacacaugagauguacugggucuccaacgccucuggaaauaucgugagcuccguuaacaugauuucucggaugcucaucaacagauuuaccaugcgccacaagaaagcuacauaugaaccugacguggaccuuggcagcgggacccggaauauuggaaucgaguccgagauucccaaccuggauaucaucggcaagagaauugaaaagaucaaacaggagcaugaaacgucuuggcacuacgaccaggaucacccguauaagaccugggccuaccauggcagcuaugagacaaaacagaccggguccgcgagcucuauggucaauggagugguucgccugcucacaaagccuugggacgugcugcccaccgucacacaaauggccaugaccgauacgacaccuuucggccagcagcggguguuuaaagaaaagguggacaccagaacccaggagcccaaggaggggaccaagaaacuuaugaaaauuacggcugaauggcuguggaaggagcucggcaagaagaaaaccccucgcauguguacaagagaagaguucacccggaagguccgcuccaacgccgcucugggcgccaucuuuacagaugagaauaaguggaaaagcgcuagagaagccguugaggacucucgguucugggaacugguggauaaggagagaaaccuccaccuggaagggaaaugcgagaccuguguguacaauaugaugggaaagcgggagaagaaacuuggcgaauuuggcaaagcgaaagggucccgcgccauuugguacauguggcugggagcuagauuccucgaguuugaagcccugggcuuccuuaacgaggaccauugguuuagccgggaaaauucucuguccggggucgagggagagggccuccacaagcugggguauauccugcgcgaugugagcaaaaaggaaggcggagcuauguacgccgacgacacagccggcugggauaccagaaucacgcucgaggaccugaaaaacgaagagaugguuaccaaucacauggaaggggagcauaagaaacuugcggaggcuauuuucaaacugacauaucaaaacaaggugguccgggugcagcgccccaccccgagaggaacaguuauggauaucauuucccggcgcgaccagagaggcagcgggcaagugggaaccuacggccucaauacguuuacaaacauggaagcccagcugauccggcagauggagggggaaggcgucuucaaaaauauucagcaccuuaccgugacagaggagguugccgugcauaacuggcuggcucgcgucggaagagaacggcucucucgcauggccaucagcggcgaugacugcguggucaagccucuggaugacagauucgcuaacgcccugaccgcgcucaaugauauggggaaaauccggaaggacauucaacagugggagcccuccaagggauggaacgauuggacacaggugcccuuuugcucucaccauuuccacgaacugaucaugaaagacggccggauucuuguugugccuugucgcaaucaggaugagcugaucgggcgggccagaauuagccaaggagcuggcuggucccuccgcgaaaccgccugccuggggaagucuuaugcucagauguggagccuuauguacuuucaccggagagaccugcgccucgccgcgaacgccaucuguuccgcugucccgucucauugggugcccacaagccggaccacaugguccauucacgccaaacaugaguggaugaccacagaggacaugcugaccguguggaauagaguuuggauccgcgaaaacccuuggauggaggauaagacgcccguggaaagcugggaggaaaucccuuaucugggcaaacgggaggaccaguggugcggaucucucauuggccugacauccagagcuaccugggccaagaauauccaggcugccauuaaccaaguccgcagccuuaucgggaaugaggaauacaccgauuacaugcccucuaugaagcgguucagacgggaggaagaggaagcgggagugcugugguga

SEQ ID NO: 20116 - RNA, 9876 nt, Artificial Sequence
  derived and/or modified CDS sequence (opt5) from DENV-2__EU482669__SS-prME
agcgccggcaugaucauuaugcugauccccaccgugauggcuuuccaccugacaacgagaaauggggaaccucauaugauugucggaauccaggaaaagggcaaaucccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcgcgugggugacauauggcaccuguacgaccacaggggagcaccgcagagaaaagcgguccguggcucucgucccucaugugggaaugggccuggagacccgcacagaaaccuggaugucuagcgagggcgccuggaaacacgcccagagaaucgagacguggauucugcggcaucccggguucacaaucauggcugccauucucgcuuacaccaucggaacaacccacuuucagcgcguucugauuuucauccuucugaccgccguggcgccuuccaugacaaugagaugcauuggcaucucuaaccgggauuuugucgaaggggugagcggaggcuccuggguugacaucgugcucgagcacgggagcugugucacgaccauggccaagaauaagcccacacuggauuucgaacuuauuaaaaccgaggcuaagcagccugccacacugcgcaaauauugcaucgaagcuaagcucaccaacacgacaaccgagucuagauguccgacccaaggagagcccucccugaaagaagaacaagacaagcgguuugugugcaagcauagcaugguggaucgcggcuggggcaauggguguggacuguucggcaaagggggaauugucacaugcgccauguuuaccugcaagaaaaacauggaaggcaagaucguucagccugagaaucucgaauacacaauuguggugacgccccacucuggggaggagcaugcggucggaaacgacaccggcaaacacggcaaggaaaucaaagugacaccucaguccagcaucaccgagguugaacugacaggguauggaaccgugacgauggaguguucucccagaaccggccuugauuucaaugaaaugguccugcuccaaauggagaacaaggccuggcuggugcaccggcagugguuucuugaccugccgcucccuuggcugcccggggcugauaagcaggaguccaauuggauucagaaagaaacacugguuaccuucaagaacccucaugccaaaaagcaagacguggucgugcucggaagccaggagggcgcuaugcacacagcccugaccggggccacggaaauccagauguccucuggcaaucuucuguuuacaggacaucucaaaugccgccugagaauggacaaacuucaacugaagggcaugagcuacuccauguguaccgggaaauucaaggucgugaaagagauugcugagacacagcacggaaccaucguuauucgggugcaguaugaaggcgaugggagccccugcaagauccccuucgagaucauggaccucgagaagcgguacguccugggacgccugauuaccgugaacccuaucguuacagagaaggauucuccggugaacauugaagcggagcccccuuuuggcgacuccuacaucauuaucggggucgagcccggccagcucaagcugaauugguucaaaaagggaagcucuauuggccaaauguuugaaacgaccaugagaggggccaaaagaauggcuauccuuggagauacagccugggacuucggcagccucgggggaguguuuaccuccaucggcaaggcccuccaucagguguucggggcuauuuauggcgccgcguuuucuggaguuagcuggacaaugaaaauccugauuggcgucaucauuaccuggaucgggaugaacucccgcagcacgucucuguccgugagccuugugcucgucggaaucgugacacuguaccugggcguuauggugcaggcugauucugggugugucguguccuggaagaauaaggagcucaaaugcggaagcggcauuuucaucaccgacaacguucacaccuggacagaacaguauaaguuucaaccugagucccccucuaaacuggccagcgccauucagaaggcucaggaagaggggaucuguggcauucgguccgugaccagacuugagaaucugauguggaaacagaucacaccggaacucaaccacauccuggccgagaaugaagucaagcugacgauuaugaccggagauaucaaaggcauuaugcaagcugggaagcgcucucuucggccucagcccacagagcucaaguacagcuggaaaaccuggggaaaggccaaaaugcuguccacagaaagcuauaaccagaccuuccugaucgacggcccugagacggcggagugccccaauaccaacagagccuggaacucucucgaaguggaggauuacggguuuggaguuuucacaaccaacauuuggcugaaacuuaaagaaaagcaggacgcuuuuugugacuccaagcugaugagcgccgcuaucaaagauaaucgcgccgugcaugcggacaugggcuauuggaucgagucugcccucaacgauacauggaagauugagaaggcuagcuucaucgaagucaagaauugccacuggccuaaaagccauacccuguggucuaacggcgugcuggagagcgaaaugauuauccccaagaaccuugccgggccggugucccaacacaauuaccggccuggauaccacacacagauugcuggccccuggcaucucgggaagcuggagauggacuucgauuuuugugacggaaccacggucaucguuacagaagauugcggcaacagagggcccagccugcgcaccaccacagccucuggaaaacucauuaccgaguggugcugucgguccugcacgcugccuccgcuuagauaucggggcgaggacggcuguugguacgggauggaaauccgcccccugaaggagaaagaagagaaucucgugaacagccuggugacagccggacacggccaggucgauaauuucucccugggggugcuuggaauggcucucuuucuggaagagaugcugagaacccggguuggcacaaagcaugcgauccuccugguggccgucucuuucgugacccuuauuacagggaacaugagcuuuaaagaccugggaagaguuguggucauggugggcgcuaccauggccgaugacaucggcauggggguuacguaucucgcccugcuggcugccuucaaggugcgcccuaccuuugcggcuggacuucugcuccggaagcugacauccaaagagcucaugaugaccacaauuggcaucguccugcuuucucaaagcaccauucccgaaacggugcuggagcucacagaugcccuggcccuggggaugauggugcuuaagaucgucagaaauauggaaaaauaccagcuggcuguuaccaucauggccauucucugcgugccuaacgcggugauccugcagaaugcuuggaaggucuccuguacaauucucgccgugguuucugugagcccccugcuucugaccuccagccagcagaagaccgacuggaucccucucgcccugacaauuaagggacugaaccccacggcuaucuuccuuaccacacugucucgcaccaauaaaaagagauccuggccgcucaacgaggccaucauggcugucggcauggugagcauucuggccucuucccuccugaagaaugacaucccuaugacagggccccuuguugcgggaggccugcugaccgugugcuauguccucacgggccggagcgccgaucuggaacuugagcgcgcuacagacgugaaaugggaggaucaggccgaaauuucuggguccagcccuauccuguccauuaccaucagcgaggacggaucuaugagcauuaagaacgaagaggaggaacagacccucacaauccugaucagaaccggccuccuggucauuuccgggcuuuuucccaucucuauuccgaucacagcugccgccugguaccugugggaggugaaaaagcagcgggcuggaguucugugggaugugccuucucccccucccaugggcaaagcggaacucgaggacggggccuaucgcauuaagcaaaagggaauccugggcuacucccagaucggcgcuggggucuacaaagaaggaacguuccacaccauguggcaugugacaagaggcgccguucuuaugcacaaggggaaacggauugagcccuccugggccgaugugaagaaagaccugaucagcuauggaggcggguggaagcucgagggagaauggaaggagggcgaagagguccaggugcuggcucucgaaccuggcaaaaauccgcgcgccgugcagaccaagcccgggcuguuuaaaacaaacaccggaacgauuggcgcgguuucccuugauuucucuccugggaccagcggaucccccaucauugacaagaaaggcaaggucguggggcuguacggaaacggcguggucacaagaagcggcgcuuaugugucugccaucgcccaaaccgagaaguccaucgaggauaauccugaaauugaggacgauaucuuucggaaacgcagacugacaauuauggaccuccaccccggggcuggaaagaccaaacgguaccugccugccaucguuagagaagcgauuaagcgcggccuucggacacugauccucgcuccgacgagaguggucgccgccgagauggaagaggcucugcgcgggcuccccauucgguaucagaccccugccaucaaagcugagcauacaggaagagaaaucguggaccugaugugucacgccaccuucaccaugcgccuucugagccccguucgggugccuaacuacaaucugauuaucauggaugaggcgcauuucacagaccccgccucuauugcugccagaggcuauaucuccacgcgcgucgaaaugggggaggcugccggcauuuuuaugaccgccacaccgccuggaagccgggaucccuucccccaguccaacgcuccuaucaucgacgaggaaagagagauucccgaacggucuuggaauagcggccacgagugggugaccgauuacaaggggaagacaguuugguuugugccuuccaucaaagcgggaaacgacauugccgcuugccuccgcaagaauggcaaaaaggucauccaacugagcagaaaaaccuucgauucugaauacgugaagacgcggacaaacgacugggauuuuguggucaccaccgacauuuccgagaugggggccaauuucaaagccgagcgcguuaucgauccgagacgguguaugaagcccgugauccuuacagacggagaagagagagugauucuggcuggcccuaugcccgucacccauagcucugccgcgcagcgccgggggagaaucggccgcaacccuaagaaugaaaacgaccaguauauuuacaugggagagccccucgaaaaugaugaggacugcgcucacuggaaagaggccaagaugcugcuggauaacaucaauacaccggaaggcauuaucccuagcauguuugagcccgaacgggagaaaguggacgccauugauggggaauauagacuccgcggagaggcucggaagaccuucguugaccuuaugagacgcggcgaucugccuguguggcuggccuacaaagucgcggccgaggggaucaacuaugcugacagacggugguguuuugauggaaucaagaacaaucagauucucgaagagaacguggaaguugagaucuggacgaaggagggcgaacgcaaaaagcugaaacccagauggcuugacgcccggauuuacuccgauccucuggcucucaaggaguucaaagaauuugccgcugggcgcaagucucugacacugaaucucaucaccgagaugggcagacuucccacauucaugacccaaaagacgcgggacgcccuggauaaccuggcggugcuccacaccgccgaagcuggaggcagagccuauaaucaugcucugagcgagcuuccggagacacuggaaacccuccugcugcucacacuucuggccaccgucacagggggaauuuuccuguuucucauguccggccgcgggaucggaaaaaugacccugggcaugugcugcaucauuacggccucuauccuucugugguacgcucagauucagccucacuggaucgcggccagcauuauccucgaguucuuucugaucgugcugcucauucccgaacccgagaagcagcggacaccucaagacaaccagcuuaccuacgucgugaucgcuauucugaccguuguggccgccacaauggcuaaugaaaugggcuuccuggagaaaaccaagaaagaccucgggcugggauccaucgccacacagcagccggagagcaacauucuugauaucgaccugagacccgcgucugccuggacgcucuaugcuguggccaccacauuugucaccccuaugcugcgccauuccauugaaaauagcuccguuaacgugucucugacagcuaucgccaaucaagcgaccgugcucaugggccuugggaagggauggccccugagcaagauggauaucggcgucccucugcucgccauuggguguuacucccaggugaaccccaucacgcugaccgcugcccuucugcuccugguugcucacuaugccauuaucggaccuggccugcaggcuaaagccacacgggaggcgcagaagagagccgcugccggcauuaugaaaaauccgaccguggacgggaucacagucaucgaucucgaccccauuccuuacgaucccaaguucgaaaaacaacuuggacaggugaugcugcugauccucugcgucacccaggugcugaugaugcggacgacaugggcucuuugugaggcccugacccucgccacaggcccuauuucuacccugugggaagggaaccccggacgcuuuuggaauaccacaaucgcgguuagcauggcuaacauuuucagaggcuccuaucuggccggggcuggacuccuuuuuagcaucaugaagaauacgaccaacacacggcgcggcaccggcaacaucggggagacacugggagagaaauggaagucuagacugaaugcccucggcaaguccgaguuccaaauuuacaaaaagagcgggauccaggagguggaccggacccuggccaaagaaggaauuaagcgcggcgagacggaucaccaugcugucucuagaggguccgccaaacuucggugguuuguggagcgcaacaugguuacaccggaaggaaagguggucgaccugggcugcggcagagggggauggagcuauuacuguggcgggcucaagaaugugcgggaggugaaaggacugaccaagggcgggccuggacacgaagaacccauccccaugucuaccuacggcuggaaccugguuagacuccagagcggcgucgauguguucuuuauuccucccgaaaaaugcgacacacuucugugugauaucggggaguccucuccuaauccgaccguggaggcgggacgcacacugcggguccucaaccugguugaaaauuggcuuaacaauaacacgcaguucugcaucaaggugcugaaucccuauaugccuagcgugauugagaaaauggaagcccuccaaagaaaguacggcggggcucugguccgcaacccccugucccggaauagcacccaugagauguauuggguguccaacgccucuggaaauaucguuagcuccgugaacaugauuucuagaaugcucaucaaccgcuucacaaugcggcacaagaaagcuaccuacgaaccugacgucgaccuuggcagcgggacaagaaauauuggaaucgaguccgagauucccaaccuggauaucaucggcaagcgcauugagaagaucaagcaggagcaugaaaccucuuggcacuaugaccaggaucacccguacaaaacgugggccuaucauggcagcuacgagaccaagcagacaggguccgcgagcucuauggugaauggaguugugcggcugcucaccaagccuugggacguccugcccacagugacccaaauggccaugacagauaccacgccuuuuggccagcagagaguguucaaagaaaaggucgacacacgcacccaggagcccaaagaggggaccaagaaacuuaugaagauuacagcugaauggcuguggaaagagcucggaaagaagaaaacgccucggauguguaccagagaagaguuuacacgcaagguuagauccaacgccgcucugggcgccaucuucaccgaugagaauaaauggaaaagcgcucgggaagccguggaggacucucgcuuuugggaacugguggauaaagagagaaaccuccaccuggaagggaagugcgagacaugugucuacaauaugaugggaaagcgggagaagaaacuuggcgaguucggcaaagcgaaaggguccagagccauuugguauauguggcugggagcucgguuucucgaguucgaagcccugggcuuucuuaacgaggaccauugguucagccgcgaaaauucucuguccgggguggagggagagggccuccacaaacugggguacauccugagagauguuagcaagaaggaaggcggagcuauguaugccgacgacaccgccggcugggauacacggaucacccucgaggaccugaaaaacgaagagauggugacgaaucacauggaaggggagcauaagaaacuugcggaggcuauuuuuaagcugaccuaccaaaacaaagucgugcgcguucagagacccacaccgcggggaaccgugauggauaucauuucccgcagagaccagcggggcagcgggcaagucggaacauauggccucaauaccuucacgaacauggaagcccagcugauccgccagauggagggggaaggcguguuuaagacaauucagcaccuuaccguuacagaggagguggccguccaaaauuggcuggcuagagugggacgggaacgccucucuagaauggccaucagcggcgaugacugcgucgugaagccucuggaugaccgguucgcuaacgcccugaccgcgcucaacgauauggggaaaauccgcaaggacauucagcagugggagcccuccaaaggauggaaugauuggacgcagguucccuucugcucucaucacuuucaugaacugaucaugaaggacggcagagugcuugucgugccuugucggaaccaagaugagcugauugggagagcccgcaucagccagggagcuggcuggucccuccgggaaaccgccugccuggggaaaucuuacgcucagauguggagccuuauguauuuccacagacgcgaccugcggcucgccgcgaaugccauuuguuccgcugugccgucucacuggguucccacaagcagaaccacaugguccauccaugccaagcacgaguggaugaccacagaggacaugcugaccguguggaaccgcgucuggauucgggaaaauccuuggauggaggauaagacgcccguggaaagcugggaggaaaucccuuaccugggcaaaagagaggaccaguggugcggaucucucaucggccugacaucccgcgcuaccugggccaagaacauucaagcugccaucaaucagguucggagccuuauugggaacgaggaauacaccgauuauaugcccucuaugaaaagauuucgccgggaggaagaggaagcgggagugcugugguga

SEQ ID NO: 20117 - RNA, 9876 nt, Artificial Sequence
  derived and/or modified CDS sequence (opt5) from DENV-2__EU482670__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaaggugaugaaagagauugcugagacccagcacggaaccaucgucauucgggugcaguaugaaggcgaugggagccccugcaagauccccuucgagaucauggaccucgagaagcgguacguucugggacgccugauuacagugaacccuaucgucacggagaaggauucuccggugaacauugaagcggagcccccuuuuggcgacuccuacaucauuaucgggguugagcccggccagcucaagcugaauugguucaaaaagggaagcucuauuggccaaauguuugaaaccacaaugagaggggccaaaagaauggcuauccuuggagauaccgccugggacuucggcagccucgggggaguguuuacauccaucggcaaggcccuccaucaggucuucggggcuauuuauggcgccgcguuuucuggagugagcuggaccaugaaaauccugauuggcgugaucauuacguggaucgggaugaacucccgcagcacaucucuguccguuagccuuguccucgugggaaucgugacccuguaccugggcgucauggugcaggcugauucuggguguguuguguccuggaagaauaaggagcucaaaugcggaagcggcauuuucaucaccgacaacguccacacauggaccgaacaguauaaguuucaaccugagucccccucuaaacuggccagcgccauucagaaggcucaggaagaggggaucuguggcauucgguccgugacaagacuugagaaucugauguggaaacagaucacgccggaacucaaccacauccuggccgagaaugaaguuaagcugaccauuaugacaggagauaucaaaggcauuaugcaagcugggaagcgcucucuucggccucagcccaccgagcucaaguacagcuggaaaacauggggaaaggccaaaaugcuguccaccgaaagccauaaccagacguuccugaucgacggcccugagaccgcggagugccccaauacaaacagagccuggaacucucucgaaguggaggauuauggguuuggagucuucaccacaaacauuuggcugaaacuuaaagaaaagcaggacgcuuuuugugacuccaagcugaugagcgccgcuaucaaagauaaucgcgccgugcacgcggacaugggcuacuggaucgagucugcccucaacgauaccuggaagauugagaaggcuagcuucaucgaaguuaagaauugccauuggccuaaaagccacacacuguggucuaacggcgugcuggagagcgaaaugauuauccccaagaaccuugccgggccggucucccaacacaauuaucggccuggauaccauacccagguggcuggccccuggcaccucgggaagcuggagauggacuucgauuuuugugacggaacgacagugauugucaccgaagauugcggcaacagagggcccagccugcgcaccacaaccgccucuggaaaacucaucacggaguggugcugucgguccugcacacugccuccgcuuagauaccggggcgaggacggcuguugguaugggauggaaauucgcccccugaaggagaaagaagagaaucucguuaacagccuggugaccgccggacauggccagguggauaauuucucccuggggguccuuggaauggcucucuuucuggaagagaugcugagaacacgggugggcaccaagcacgcgauccuccugguugccgugucuuucgucacacuuaucaccgggaacaugagcuuuaaagaccugggaagagugguugugauggucggcgcuacgauggccgaugacauuggcaugggggugaccuaccucgcccugcuggcugccuucaagguucgcccuacauuugcggcuggacuucugcuccggaagcugaccuccaaagagcucaugaugacaaccaucggcauugugcugcuuucucaaagcacgauccccgaaacaguccuggagcucaccgaugcccuggcccuggggaugauggugcuuaagauugugagaaauauggaaaaauaucagcuggcugucacaaucauggccauccucugcguuccuaacgcggugauucugcagaaugcuuggaagguguccuguaccauccucgccgucgugucuguuagcccccugcuucugaccuccagccagcagaagacggacuggauuccucucgcccugacgaucaagggacugaaccccaccgcuauuuuccuuacaacccugucucgcacaaauaaaaagagauccuggccgcucaacgaggccaucauggcugugggcauggucagcauccuggccucuucccuccugaagaaugacauuccuaugaccgggccccuuguggcgggaggccugcugacgguuugcuacgugcucacaggccggagcgccgaucuggaacuugagcgcgcuaccgacgucaaaugggaggaucaggccgaaaucucuggguccagcccuauucuguccaucaccauuagcgaggacggaucuaugagcaucaagaacgaagaggaggaacagacacucaccauucugaucagaacaggccuccuggugaucuccgggcuuuuucccauuucuaucccgauuacggcugccgccugguaucugugggaggucaaaaagcagcgggcuggagugcugugggauguuccuucucccccucccaugggcaaagcggaacucgaggacggggccuaccgcaucaagcaaaaggggauucugggcuauucccagaucggcgcugggguguacaaagaaggaaccuuccauacaauguggcacgucaccagaggcgccgugcuuaugcacaaggggaaacggaucgagcccuccugggccgauguuaagaaagaccugauuagcuacggaggcggguggaagcucgagggagaauggaaggagggcgaagaggugcagguccuggcucucgaaccuggcaaaaauccgcgcgccgugcagacaaagcccgggcuguuuaaaaccaacacgggaaccaucggcgcggugucccuugauuucucuccugggacaagcggaucccccauuaucgacaagaaaggcaagguugucgggcuguauggaaacggcguggugaccagaagcggcgcuuacgucucugccauugcccaaacagagaaguccaucgaggauaauccugaaaucgaggacgauauuuuucggaaacgcagacugaccaucauggaccuccaucccggggcuggaaagacaaaacgguaucugccugccauugugagagaagcgaucaagcgcggccuucggacgcugauucucgcuccgaccagaguuguggccgccgagauggaagaggcucugcgcgggcuccccauccgguaccagaccccugccauuagagcugagcacaccggacgcgaaaucgucgaccugaugugucaugccaccuucacaaugcggcuucugagccccgugagaguuccuaacuauaaucugaucauuauggaugaggcgcacuucacggaccccgccucuaucgcugcccgcggcuacauuuccacccggguggaaaugggggaggcugccggcaucuuuaugacagccaccccgccuggaagcagagaucccuucccccaguccaacgcuccuauuaucgacgaggaacgggagauccccgaacgcucuuggaauagcggccaugagugggucacagauuuuaaagggaagaccgugugguucguuccuuccauuaaggcgggaaacgacaucgccgcuugccuccgcaaaaauggcaagaaagugauucaacugagccggaagacguuugauucugaauaugucaaaacacgcaccaacgacugggauuucguggugaccacagacaucuccgagaugggggccaauuuuaaggccgagagagucauugauccgcggagauguaugaaacccguuauccuuaccgacggagaggaacgcgugauccuggcuggcccuaugcccgugacacacagcucugccgcgcagcggagagggcgcauuggccggaacccuaagaaugaaaacgaccaguacaucuacaugggagagccccucgaaaaugaugaggacugcgcucacuggaaggaggccaaaaugcugcuggauaacauuaauaccccggaaggcaucauuccuagcauguucgagcccgaaagagagaaggucgacgccaucgauggggaauaucgccuccggggagaggcuagaaaaacguuuguggaccuuaugcgcagaggcgaucugccuguuuggcuggccuacaagguggcggccgaggggauuaacuaugcugaccggcgcugguguuucgauggaaucaaaaacaaucagauccucgaagagaacgucgaaguggagauuuggacaaaggagggcgaaagaaagaaacugaagccccgguggcuugacgcccgcaucuacuccgauccucuggcucucaaagaguuuaaggaguucgccgcugggagaaaaucucugacccugaaucucauuacagagaugggccggcuucccaccuucaugacgcaaaagaccagagacgcccuggauaaccuggcgguucuccauacagccgaagcuggaggccgcgccuauaaucacgcucugagcgagcuuccggagacccuggaaacacuccugcugcucacccuucuggccacagugaccgggggaaucuuucuguuccucauguccggccgggggauuggaaagaugacgcugggcaugugcugcaucaucacagccucuauucuucugugguacgcucagauccagccucauuggauugcggccagcaucauucucgaguuuuuccugaucguccugcucauccccgaacccgagaaacagagaaccccucaagacaaccagcuuaccuauguggucauugcuauccugacagugguugccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguggccacaaccuucgugacaccuaugcugcggcacuccaucgaaaauagcuccgucaacguuucucugaccgcuauugccaaucaagcgacggugcucaugggccuugggaaaggauggccccugagcaagauggauaucggcgugccucugcucgccaucggguguuacucccaggucaaccccauuacccugacagcugcccuucugcuccugguggcucacuaugccaucauuggaccuggccugcaggcuaaggccaccagagaggcgcagaaacgggccgcugccggcaucaugaagaauccgacaguugacgggauuaccgugaucgaucucgaccccaucccuuacgaucccaaauuugaaaagcaacuuggacaggucaugcugcugauucucugcgugacgcagguccugaugaugcgcacaaccugggcucuuugugaggcccugacacucgccaccggcccuaucucuacccugugggaagggaaccccggaagauucuggaauacaacgauugcggugagcauggcuaacaucuuucggggcuccuaucuggccggggcuggacuccuuuucagcauuaugaaaaauaccacaaacacccgcagaggcacaggcaacaugggggagacccugggagagaaguggaaaucucggcugaaugcccucggcaaguccgaauuucaaaucuacaagaaaagcgggauccaggagguugaccgcacgcuggccaaggaaggaauuaaaagaggcgagacagaucaucacgcugugucucggggguccgccaaacuucgcugguucgucgagagaaacauggugaccccggaaggaaaaguuguggaccugggcugcggccggggaggauggagcuauuacuguggcgggcucaagaaugucagagaggugaagggacugaccaaaggcgggccuggacaugaagaacccauccccaugucuacauauggcuggaaccuggugcgccuccagagcggcguugaugucuuuuucauuccucccgaaaagugcgacacccuucugugugauaucggggaguccucuccuaauccgacaguggaggcgggacggacgcugagagugcucaaccuggucgaaaauuggcuuaacaauaacacccaguucugcauuaaaguucugaaucccuacaugccuagcgugaucgagaagauggaagcccuccaacgcaaauacggcggggcucuggugcggaacccccuguccagaaauagcacacacgagauguauugggucuccaacgccucuggaaauaucgugagcuccguuaacaugauuucucgcaugcucaucaaccgguuuaccaugagacauaagaaggcuacauacgaaccugacguggaccuuggcagcgggacccgcaauauuggaaucgaguccgagauucccaaccuggauaucauuggcaaacggaucgaaaagaucaaacaggagcacgaaacgucuuggcacuaugaccaggaucauccguacaagaccugggccuaucacggcagcuacgagacaaaacagaccggguccgcgagcucuauggucaauggagugguuagacugcucacaaagccuugggacgugcugcccaccgucacacaaauggccaugaccgauacgacaccuuucggccagcagcgcguguuuaaggaaaaaguggacacccggacccaggagcccaaggaggggaccaagaaacuuaugaaaauuacggcugaauggcuguggaaggagcucggcaaaaagaagaccccuagaauguguacacgcgaagaguucaccagaaaaguccgguccaacgccgcucugggcgccaucuuuacagaugagaauaaguggaaaagcgcucgcgaagccguugaggacucuagauucugggaacugguggauaaggagcggaaccuccaucuggaagggaaaugcgagaccuguguguauaauaugaugggaaagagagagaagaaacuuggcgaauuuggcaaggcgaaagggucccgggccauuugguacauguggcugggagcucgcuuccucgaguuugaagcccugggcuuccuuaacgaggaccacugguuuagcagagaaaauucucuguccggggucgagggagagggccuccacaagcugggguacauccugcgggaugugagcaaaaaggaaggcggagcuauguaugccgacgacacagccggcugggauacccgcauuacgcucgaggaccugaagaacgaagagaugguuaccaaucauauggaaggggagcacaagaaacuugcggaggcuaucuucaaacugacauaccaaaacaaaguggucagagugcagcggcccaccccgcgcggaacaguuauggauaucauuuccagacgggaccagcgcggcagcgggcaagugggaaccuauggccucaauacguuuacaaacauggaagcccagcugaucagacagauggagggggaaggcgucuucaaaaauauucagcaucuuaccgugacagaggagguugccgugcaaaacuggcuggcucgggucggacgcgaaagacucucucggauggccaucagcggcgaugacugcguggucaagccucuggaugaccgcuucgcuaacgcccugaccgcgcucaaugauauggggaagauuagaaaagacauccagcagugggagcccuccaagggauggaacgauuggacacaggugcccuuuugcucucaccauuuccacgaacugaucaugaaagacggccggauucuuguugugccuuguagaaaucaagaugagcugaucgggcgcgcccggauuagccagggagcuggcuggucccucagagaaaccgccugccuggggaagucuuacgcucagauguggagccuuauguauuuucaccgccgggaccugagacucgccgcgaacgccaucuguuccgcugucccgucucauugggugcccacaagccgcaccacaugguccauucacgccaaacaugaguggaugaccacagaggacaugcugaccguguggaaucggguuuggaucagagaaaacccuuggauggaggauaagacgcccguggaaagcugggaggaaauuccuuaccugggcaagcgcgaggaccaguggugcggaucucucaucggccugacaucccgggcuaccugggccaaaaauauccaagcugccauuaaccaggucagaagccuuaucgggaaugaggaauauaccgauuacaugcccucuaugaagcgcuuccggagagaggaagaggaagcgggagugcugugguga

SEQ ID NO: 20118 - RNA, 9876 nt, Artificial Sequence
  derived and/or modified CDS sequence (opt5) from DENV-2__EU482671__SS-prME
agcgccggaaugaucauuaugcugauccccaccgugauggcuuuccaccugacgacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuuauuugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugcgggagaucgcugagacccagcacggaaccauugucaucagagugcaguaugaaggcgaugggagccccugcaaaauccccuucgagauuauggaccucgaaaagcgcuacguucugggacggcugaucacagugaacccuauugucacggagaaagauucuccggugaacaucgaagcggagcccccuuuuggcgacuccuacauuaucauugggguugagcccggccagcucaagcugaauugguucaagaaaggaagcucuaucggccaaauguuugaaaccacaaugagaggggccaagcgcauggcuauccuuggagauaccgccugggacuucggcagccucgggggaguguuuacauccauuggcaaagcccuccaucaggucuucggggcuaucuauggcgccgcguuuucuggagugagcuggaccaugaagauucugaucggcgugauuaucacguggaucgggaugaacucccggagcacaucucuguccguuagccuuguccucgugggaauugugacccuguaccugggcgucauggugcaggcugauucuggguguguuguguccuggaaaaauaaggagcucaagugcggaagcggcaucuucauuaccgacaacguccacacauggaccgaacaguauaaauuucaaccugagucccccucuaagcuggccagcgccauccagaaagcucaggaagaggggauuuguggcaucagauccgugacacgccuugagaaucugauguggaagcagaucacgccggaacucaaccacauucuggccgagaaugaaguuaaacugaccaucaugacaggagauauuaagggcaucaugcaagcugggaaacggucucuuagaccucagcccaccgagcucaaguacagcuggaagacauggggaaaagccaagaugcuguccaccgaaagcuauaaccagacguuccugauugacggcccugagaccgcggagugccccaauacaaaccgcgccuggaacucucucgaaguggaggauuacggguuuggagucuucaccacaaacaucuggcugaaacuuaaggaaaaacaggacgcuuuuugugacuccaagcugaugagcgccgcuaucaaggauaaucgggccgugcaugcggacaugggcuauuggauugagucugcccucaacgauaccuggaaaaucgagaaggcuuccuucauugaaguuaaaaauugccacuggccuaagagccauacacuguggucuaacggcgugcuggagagcgaaaugaucauucccaaaaaccuugccgggccggucucccaacacaauuacagaccuggauaccacacccagaucgcuggccccuggcaucucgggaagcuggagauggacuucgauuuuugugacggaacgacagugauugugaccgaagauugcggcaaccgcgggcccagccugcggaccacaaccgccucuggaaagcucaucacggaguggugcuguagauccugcacacugccuccgcuucgguaucgcggcgaggacggcuguugguacgggauggaaaucagaccccugaaagagaaggaagagaaucucgucaacagccugguuaccgccggacacggccagguggauaauuucucccugggggugcuuggaauggcucucuuucuggaagagaugcugcggacaagagucggcaccaaacaugcgauucuccugguggccguuucuuucgugacacuuaucaccgggaacaugagcuuuaaggaccugggacgcgucgugguuauggugggcgcuacgauggccgaugacauuggcaugggggucaccuaucucgcccugcuggcugccuucaaagugcggccuacauuugcggcuggacuucugcucagaaagcugaccuccaaggagcucaugaugacaaccaucggcauuguucugcuuucucaaagcacgauccccgaaacagugcuggagcucaccgaugcccuggcccuggggaugaugguccuuaaaaucgugcgcaauauggaaaaguaccagcuggcugugacaauuauggccauccucugcgucccuaacgcgguuauucugcagaaugcuuggaaaguguccuguaccauccucgccguggucucugugagcccccugcuucugaccuccagccagcaaaagacagacuggauuccucucgcccugacgaucaaaggacugaaccccaccgcuaucuuccuuacaacccugucuagaacaaauaagaaacgguccuggccgcucaacgaggccauuauggcuguuggcauggugagcauccuggccucuucccuccugaagaaugacauuccuaugaccgggccccuugucgcgggaggccugcugacggugugcuauguucucacaggccgcagcgccgaucuggaacuugagagagcuaccgacgugaagugggaggaucaggccgaaaucucuggguccagcccuauucuguccaucaccauuagcgaggacggaucuaugagcaucaaaaacgaagaggaggaacagacacucaccauccugauucggacaggccuccuggucaucuccgggcuuuuucccauuucuaucccgauuacggcugccgccugguaccugugggaggugaagaaacagcgcgcuggaguccugugggaugugccuucucccccucccaugggcaaggcggaacucgaggacggggccuauagaaucaaacaaaagggaauccugggcuacucccagauuggcgcugggguuuacaaggaaggaaccuuccacacaauguggcaugugacccggggcgccguccuuaugcacaaagggaagcgcaucgagcccuccugggccgaugugaaaaaggaccugauuagcuauggaggcggguggaaacucgagggagaauggaaggagggcgaagagguucaggugcuggcucucgaaccuggcaagaauccgagagccguccagacaaaacccgggcuguuuaagaccaacacgggaaccaucggcgcggugucccuugauuucucuccugggacaagcggaucccccauuaucgacaaaaagggcaaagugguugggcuguacggaaacggcgucgugacccggagcggcgcuuaugugucugccaucgcccaaacagagaaguccauugaggauaauccugaaaucgaggacgauauuuuucgcaagagacggcugaccaucauggaccuccaccccggggcuggaaaaacaaagagauaccugccugccauuguccgcgaagcgaucaaacggggccuuagaacgcugauucucgcuccgacccgcgugguugccgccgagauggaagaggcucugcgggggcuccccaucagauaucagaccccugccauccgcgcugagcauaccggacgggaaauuguggaccugaugugucacgccaccuucacaaugagacuucugagccccguccgcgugccuaacuacaaucugaucauuauggaugaggcgcauuucacggaccccgccucuaucgcugcccggggcuauauuuccaccagaguugaaaugggggaggcugccggcaucuuuaugacagccaccccgccuggaagccgggaucccuucccccaguccaacgcuccuaucauugacgaggaacgcgagauccccgaaagaucuuggaauagcggccacgagugggugacagauuuuaaggggaaaaccgucugguucgugccuuccauuaaggcgggaaacgacaucgccgcuugccuccggaagaauggcaaaaagguuauucaacugagccgcaaaacguuugauucugaauacgugaagacaagaaccaacgacugggauuucgucgugaccacagacaucuccgagaugggggccaauuuuaaagccgagcgggugaucgauccgagacgcuguaugaagcccgucauucuuaccgacggagaggaacggguuauccuggcuggcccuaugcccgugacacauagcucugccgcgcagagacgcgggcggauuggcagaaacccuaaaaaugaaaacgaccaguacaucuauaugggagagccccucgaaaaugaugaggacugcgcucacuggaaggaggccaagaugcugcuggauaacauuaauaccccggaaggcaucauuccuagcauguucgagcccgaacgcgagaaaguggacgccaucgauggggaauaccggcucagaggagaggcucgcaagacguuugucgaccuuaugagacggggcgaucugccuguguggcuggccuauaaaguugcggccgaggggaucaacuacgcugaccgcagaugguguuucgauggaauuaagaacaaucagauccucgaagagaacguggaagucgagauuuggacaaaagagggcgaacggaagaagcugaaaccccgcuggcuugacgccagaaucuauuccgauccucuggcucucaaggaguuuaaagaguucgccgcugggcggaagucucugacccugaaucucauuacagagaugggcagacuucccaccuucaugacgcagaagacacgcgacgcccuggauaaccuggcggugcuccacacagccgaagcuggaggccgggccuacaaucaugcucugagcgagcuuccggagacccuggaaacacuccugcugcucacccuucuggccacaguuaccgggggaaucuuucuguuccucauguccggcagagggaucggaaagaugacgcugggcaugugcugcauuaucacagccucuauucuucugugguaugcucagauccagccucacuggauugcggccagcaucauccucgaguuuuuccugauugugcugcucauccccgaacccgagaagcagcgcaccccucaagacaaccagcuuaccuacgucgugauugcuauccugacagucguggccgccaccauggcuaaugaaaugggcuuucuggagaaaacaaagaaagaccucgggcugggauccauugccacgcagcagccggagagcaacauccuugauauugaccugcggcccgcgucugccuggacccucuacgcuguugccacaaccuucgugacaccuaugcugagacauuccaucgaaaauagcuccgugaacgucucucugaccgcuaucgccaaucaagcgacgguucucaugggccuugggaagggauggccccugagcaaaauggauauuggcgugccucugcucgccaucggguguuauucccaggugaaccccauuacccugacagcugcccuucugcuccuggucgcucacuacgccaucauuggaccuggccugcaggcuaaggccacccgggaggcgcagaagcgcgccgcugccggcaucaugaaaaauccgacaguggacgggaucaccguuauugaucucgaccccaucccuuaugaucccaaguuugaaaaacaacuuggacaggugaugcugcugauucucugcgucacacaggugcugaugaugagaacaaccugggcucuuugugaggcccugacacucgccaccggcccuaucucuacccugugggaagggaaccccggacgguucuggaauacaacgauugcggucagcauggcuaacaucuuucgcggcuccuaccuggccggggcuggacuccuuuucagcaucaugaagaauaccacaaacaccagacggggcacaggcaacaugggggagacccugggagagaaauggaagucucgccugaaugcccucggcaaauccgaauuucaaauuuauaagagaagcgggauccaggagguggaccggacgcuggccaaggaaggaauuaaacgcggcgagacagaucaccaugcuguuucuagaggguccgccaaacuucggugguucguggagagaaacauggucaccccggaaggaaaagugguugaccugggcugcggccgcgggggauggagcuacuauuguggcgggcucaagaaugugcgggaggucaaaggacugaccaagggcgggccuggacacgaggaacccauccccaugucuacauacggcuggaaccuggugagacuccagagcggcguggaugucuuuuucauuccucccgaaaagugcgacacccuucugugugauaucggggaguccucuccuaauccgacagucgaggcgggacgcacgcugcgggugcucaaccugguggaaaauuggcuuaacaauaacacccaguucugcaucaaaguccugaaucccuacaugccuagcguuauugagaagauggaagcccuccaaagaaaauauggcggggcucuggugcgcaacccccugucccggaauagcacacaugagauguacuggguguccaacgccucuggaaauaucgucagcuccgugaacaugauuucuagaaugcucaucaaccgcuuuaccaugcggcacaagaaagcuacauaugaaccugacguugaccuuggcagcgggaccagaaauauuggaaucgaguccgagauucccaaccuggauaucaucggcaagcgcauugaaaagaucaaacaggagcaugaaacgucuuggcacuacgaccaggaucacccguauaagaccugggccuaccauggcagcuaugagacaaaacagaccggguccgcgagcucuauggugaauggagucgugcggcugcucacaaagccuugggacguucugcccaccgugacacaaauggccaugaccgauacgacaccuuucggccagcagagagucuuuaaagaaaagguggacacccgcacccaggagcccaaggaggggaccaagaaacuuaugaaaauuacggcugaauggcuguggaaggagcucggcaagaagaaaaccccuagaauguguacacgggaagaguucacccgcaaggugagauccaacgccgcucugggcgccaucuuuacagaugagaauaaguggaaaagcgcucgggaagccgucgaggacucuagauucugggaacugguugauaaggagcggaaccuccaccuggaagggaaaugcgagaccuguguguacaauaugaugggaaagcgcgagaagaaacuuggcgaauuuggcaaagcgaaaggguccagagccauuugguacauguggcugggagcucgguuccucgaguuugaagcccugggcuuccuuaacgaggaccauugguuuagccgcgaaaauucucuguccgggguggagggagagggccuccacaagcugggguauauccugagagaugucagcaaaaaggaaggcggagcuauguacgccgacgacacagccggcugggauacccggaucacgcucgaggaccugaaaaacgaagagauggugaccaaucacauggaaggggagcauaagaaacuugcggaggcuauuuucaaacugacauaucaaaacaagguugugcgcguccagagacccaccccgcggggaacagugauggauaucauuucccgcagagaccagcggggcagcgggcaaguuggaaccuacggccucaauacguuuacaaacauggaagcccagcugauccgccagauggagggggaaggcguguucaaaaauauucagcaccuuaccgucacagaggagguggccguucaaaacuggcuggcuagagugggacgggaacgccucucuagaauggccaucagcggcgaugacugcgucgugaagccucuggaugaccgguucgcuaacgcccugaccgcgcucaaugauauggggaaaaucagaaaggacauucagcagugggagcccuccaagggauggaacgauuggacgcagguccccuuuugcucucaucacuuccaugaacugaucaugaaagacggccgcgugcuuguugugccuugucggaaucaagaugagcugauugggagagcccgcaucagccagggagcuggcuggucccuccgggaaaccgccugccuggggaagucuuaugcucagauguggagccuuauguacuuucacagacgcgaccugcggcucgccgcgaacgccauuuguuccgcugucccgucucacugggugcccacaagcagaaccacaugguccauccaugccaaacacgaguggaugaccacagaggacaugcugaccguguggaaucgcguuuggauucgggaaaacccuuggauggaggauaagacgcccguggaaagcugggaggaaaucccuuaucugggcaaaagagaggaccaguggugcggaucucucaucggccugacaucccgcgcuaccugggccaagaauauucaagcugccaucaaccagguccggagccuuauugggaaugaggaauacaccgauuacaugcccucuaugaagagauuccggagagaggaagaggaagcgggagugcugugguga

SEQ ID NO: 20119 - RNA, 9876 nt, Artificial Sequence
  derived and/or modified CDS sequence (opt5) from DENV-2__EU482674__SS-prME
agcgccggaaugaucauuaugcugauccccaccgugauggcuuuccaccucacgacgagaaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcguucugauuuucauccuucugacagcuguggccccuucuaugacgaugagaugcauuggaaucagcaaccgggauuuugucgaaggcguguccgggggaagcuggguugacaucgugcucgagcacggcucuugugucaccacaauggcgaagaauaagcccacccuggauuucgaacuuauuaaaacagaggccaagcagccugcuacccugcgcaaauauugcaucgaagccaagcucacgaacacaaccaccgaguccagauguccgacacaaggggagcccagccugaaagaagaacaagacaagcgguuugugugcaagcauucuaugguggaucgcggauggggcaauggcugugggcuguucggaaaaggcgggauugucacaugcgcuauguuuacaugcaagaaaaacauggaaggaaagaucguucagccugagaaucucgaauacacgauuguggugacaccccacuccggcgaggagcaugccgucgggaacgacacaggaaaacacggcaaggaaaucaaagugaccccucagagcucuaucacagaggcggaacugaccggcuaugggacgguuaccauggaguguucccccagaacaggacuugauuucaaugaaauggugcugcuccaaauggagaacaaggccuggcugguccaccggcagugguuucuugaccugccgcucccuuggcugcccggcgcugauaagcaggagagcaauuggauucagaaagaaacccuggugacauucaagaacccucaugccaaaaagcaagacguugugguccucgggucccaggagggagcuaugcacaccgcccugacgggcgccacagaaauccagaugucuagcgggaaucuucuguuuaccggccaucucaaaugccgccugagaauggacaaacuucaacugaagggaauguccuacagcauguguacaggcaaauucaagguggucaaagagauugcugagacccagcacgggaccaucgugauucggguucaguaugaaggagauggcucucccugcaagauccccuucgagaucauggaccucgagaagagauacgugcuggggcgccugauuacagucaacccuaucgugacggagaaggauuccccgguuaacauugaagcggagcccccuuuuggagacagcuacaucauuaucggcguggagcccgggcagcucaagcugaauugguucaaaaagggcucuagcauuggacaaauguuugaaaccacaaugcggggcgccaaaagaauggcuauccuuggggauaccgccugggacuucggaucccugggcggggucuuuacaucuaucggaaaggcccuccaucagguguucggcgcuauuuauggggccgcguuuagcggcguguccuggaccaugaaaauccugauuggaguuaucauuacguggaucggcaugaacagccgcucuacaucccugagcgucucucuugugcucguggggaucgucacccuguaccugggagugaugguucaggcugauuccggcuguguggucagcuggaagaauaaggagcucaaaugcggguccggaauuuucaucaccgacaacgugcacacauggaccgaacaguauaaguuucaaccugagucucccagcaaacuggccuccgccauucagaaggcucaggaagagggcaucugugggauucggucuguuacaagacuugagaaucugauguggaaacagaucacgccggaacucaaccacauccuggccgagaaugaagugaagcugaccauuaugacaggcgauauccgcggaauuaugcaagcuggcaaacggagccuuagaccucagcccaccgagcucaaguacuccuggaagacaugggggaaagccaagaugcugagcaccgaaucuuauaaccagacguuccugaucgacggaccugagaccgcggagugccccaauacaaaccgcgccuggaacucccucgaagucgaggauuacggcuuugggguguucaccacaaacauuuggcugaaacuuaaggaaaaacaggacgcuuuuugugacagcaagcugaugucugccgcuaucaaggauaaucgggccguucaugcggacaugggauauuggaucgaguccgcccucaacgauaccuggaaaauugagaaggcuagcuucaucgaagugaaaaauugccacuggccuaagucucauacacuguggagcaacggcguccuggaguccgaaaugauuauccccaaaaaccuugccggcccggugagccaacacaauuacagaccuggguaccacacccagauugcuggacccuggcaucucggcaagcuggagauggacuucgauuuuugugacgggacgacagugaucgucaccgaagauugcggaaaccgcggccccucucugcggaccacaaccgccuccgggaagcucauuacggaguggugcuguagaagcugcacacugccuccgcuucgguaucgcggagaggacggcuguugguacggcauggaaaucagaccccugaaagagaaggaagagaaucucguuaacucccuggugaccgccgggcacggacagguggauaauuucucucugggcguccuugggauggcucucuuucuggaagagaugcugcggacaagagugggaaccaaacaugcgauccuccugguugccgugagcuucgucacacuuauuaccggcaacauguccuuuaaggaccuggggcgcgugguugugauggucggagcuacgauggccgaugacaucggcaugggcgugaccuaucucgcccugcuggcugccuucaaaguucggccuacauuugcggcugggcuucugcucagaaagcugaccucuaaggagcucaugaugacaaccauuggaaucgugcugcuuagccaauccacgauucccgaaacaguccuggagcucaccgaugcccuggcccugggcaugauggugcuuaaaaucgugcgcaauauggaaaaguaccagcuggcugucacaaucauggccauucucugcguuccuaacgcggugauccugcagaaugcuuggaaagugucuuguaccauucucgccgucgugagcguuagcccccugcuucugaccagcucucagcaaaagacagacuggaucccucucgcccugacgauuaaagggcugaaccccaccgcuaucuuccuuacaacccuguccagaacaaauaagaaacggagcuggccgcucaacgaggccaucauggcugugggaauggucucuauucuggccuccagccuccugaagaaugacaucccuaugaccggcccccuuguggccgggggacugcugacgguuugcuaugugcucacaggccgcucugccgaucuggaacuugagagagcuaccgacgucaagugggaggaucaggccgaaauuuccggcagcuccccuauccugagcauuaccaucucugaggacgggagcauguccauuaaaaacgaagaggaggaacagacacucaccauccugauccggacaggacuccuggugauuucuggccuuuuucccaucagcauuccgaucacggcugccgccugguaccugugggaggucaagaaacagcgcgcuggggugcugugggauguuccuucucccccucccaugggaaaggcggaacucgaggacggcgccuauagaauuaaacaaaaggggauccugggacacagccagaucggcgcuggcguguacaaggaagggaccuuccauacaauguggcacgucacccggggagccgugcuuaugcacaaaggcaagcgcauugagcccagcugggccgauguuaaaaaggaccugaucuccuacgggggaggcuggaaacucgagggggaauggaaggagggagaagaggugcagguccuggcucucgaaccuggcaagaauccgagagccgugcagacaaaacccggccuguuuaagaccaacacggggaccauuggagcggugucucuugauuucagcccuggcacauccgggagccccaucauugacaaaaagggaaaaguugucggccuguaugggaacggaguggugacccggucuggcgcuuacgucuccgccaucgcccaaacagagaagaauaucgaggauaacccugaaauugaggacgauaucuuucgcaagagacggcugaccauuauggaccuccaucccggcgcugggaaaacaaagagauaucugccugccaucgugcgcgaagcgauuaaacggggacuuagaacgcugauccucgcuccgacccgcguuguggccgccgagauggaagaggcucugcggggccuccccauuagauaccagaccccugcgauccgcgcugagcacaccgggcgggaaaucgucgaccugaugugucaugccaccuucacaaugagacuucugagccccgugcgcguuccuaauuauaaccugauuaucauggaugaggcgcacuucacggaccccgccucuauugcugcccggggauacaucuccaccagaguggaaaugggcgaggcugccgggauuuuuaugacagccaccccgccuggcagccgggaucccuucccccaguccaaugcuccuaucaucgacgaggaacgcgagauucccgaaagaucuuggaacagcggacaugagugggucacagauuuuaagggcaaaaccgugugguucguuccuuccaucaaggcggggaaugacauugccgcuugccuccggaagaacggcaagaaggugauccaacugagccgcaaaacguuugauucugaauaugucaagacaagaaccaaugacugggauuucguggugaccacagacauuuccgagaugggcgccaacuuuaaagccgagcgggucaucgauccgagacgcuguaugaagcccguuauccuuaccgacggggaagaacgggugauucuggcuggaccuaugcccgugacacacagcucugccgcgcagagacgcggccggaucgggagaaauccuaaaaacgaaaaugaccaguacauuuacaugggcgagccccucgaaaacgaugaggacugcgcucacuggaaggaggccaagaugcugcuggauaauaucaacaccccggaaggaauuaucccuagcauguucgagcccgaacgcgagaaagucgacgccauugauggcgaauaucggcucagaggggaggcucgcaagacguuuguggaccuuaugagacggggagaucugccuguuuggcuggccuacaaaguggcggccgagggcaucaacuaugcugaccgcagaugguguuucgaugggaucaagaauaaccagauucucgaagagaaugucgaaguggagaucuggacaaaagagggagaacggaagaagcugaaaccccgcuggcuugacgccagaauuuacuccgauccucuggcucucaaggaguuuaaagaguucgccgcuggccggaagucucugacccugaaccucaucacagagauggggagacuucccaccuucaugacgcagaagacccgcgacgcccuggauaaucuggcgguucuccauacagccgaagcuggcggacgggccuauaaccacgcucugagcgagcuuccggagacccuggaaacacuccugcugcucacccuucuggccacagugaccggcgggauuuuucuguuccucauguccggaagaggcaucgggaagaugacgcugggaaugugcugcaucauuacagccucuauccuucugugguacgcucagauucagccucauuggaucgcggccagcauuauccucgaguuuuuccugaucguccugcucauucccgaacccgagaagcagcgcaccccucaagacaaucagcuuaccuauguggucaucgcuauucugacagugguugccgccaccauggcuaacgaaaugggcuuucuggagaaaacaaagaaagaccucggccugggguccaucgccacgcagcagccggagagcaauauucuugauaucgaccugcggcccgcgucugccuggacccucuacgcuguggccacaaccuucgugacaccuaugcugagacacuccauugaaaacagcuccgucaauguuucucugaccgcuaucgccaaccaagcgacggugcucaugggacuuggcaagggguggccccugagcaaaauggauaucggagugccucugcucgccauuggcuguuacucccaggucaaucccaucacccugacagcugcccuucugcuccugguggcucacuaugccauuaucgggccuggacugcaggcuaaggccacccgggaggcgcagaagcgcgccgcugccggcauuaugaaaaacccgacaguugacggcaucaccgugaucgaucucgaccccauuccuuacgaucccaaguuugaaaaacaacuugggcaggucaugcugcugauccucugcgugacgcagguccugaugaugagaacaaccugggcucuuugugaggcccugacacucgccaccggaccuauuucuacccugugggaaggcaaucccgggcgguucuggaacacaacgaucgcggugagcauggcuaauauuuuucgcggauccuaucuggccggcgcugggcuccuuuucagcaucaugaagaacaccacaaacaccagacggggaacaggcaauaucggcgagacccugggggagaaauggaagucucgccugaacgcccucggaaaauccgaauuucaaauuuacaagaaguccggcauccaggagguugacagaacgcuggccaaagaagggauuaagcggggagagacagaucaucacgcugugucucgcggcuccgccaaacuuagaugguucgucgagcggaauauggugaccccggaagggaagguuguggaccugggaugcggcagaggcggguggagcuauuacuguggaggccucaaaaacguccgcgaggugaaggggcugaccaagggaggcccugggcaugaggaacccauccccaugucuacauauggauggaaucuggugcggcuccagagcggcguugaugucuuuuucauuccucccgaaaaaugcgacacccuucugugugauaucggcgaguccucuccuaacccgacaguggaggcggggagaacgcugcgcgugcucaaucuggucgaaaacuggcuuaauaacaauacccaguucugcaucaagguucugaaccccuacaugccuagcgugauugagaaaauggaagcccuccaacggaaguacggaggcgcucuggugagaaauccccugucccgcaacagcacacacgagauguauugggucuccaaugccucugggaacaucgugagcuccguuaacaugauuucucggaugcucaucaauagauuuaccaugcgccauaaaaaggcuacauacgaaccugacguggaccuuggaagcggcacccggaacauugggaucgaguccgagaagcccaaucuggauauuaucggaaaaagaaucgaaaagauuaaacaggagcacgaaacgucuuggcacuaugaccaggaucauccguacaagaccugggccuaucacggcagcuacgagacaaaacagaccggcuccgcgagcucuauggucaacggggugguucgccugcucacaaagccuugggacgugcugcccaccgucacacaaauggccaugaccgauacgacaccuuucggacagcagcggguguuuaaggaaaaaguggacaccagaacccaggagcccaaggagggcaccaagaaacuuaugaaaaucacggcugaauggcuguggaaagagcucgggaaaaagaagaccccucgcauguguacaagagaagaguucacccggaaaguccgcuccaaugccgcucugggagccauuuuuacagaugagaacaaguggaaaagcgcuagagaagccguugaggacucucgguucugggaacugguggauaaggagagaaaucuccaucuggaaggcaaaugcgagaccuguguguauaacaugauggggaagcgggagaagaaacuuggagaauuuggcaaggcgaaaggcucccgcgccaucugguacauguggcugggggcuagauuccucgaguuugaagcccugggauuccuuaaugaggaccacugguuuagccgggaaaacucucuguccggcgucgagggggagggacuccacaagcugggcuacauucugcgcgaugugagcaaaaaggaagggggcgcuauguaugccgacgacacagccggaugggauaccagaaucacgcucgaggaccugaagaaugaagagaugguuaccaaccauauggaaggcgagcacaagaaacuugcggaggcuaucuucaaacugacauaccaaaauaaagugguccgggugcagcgccccaccccgagagggacaguuauggauauuaucucccggcgcgaccagagaggaagcggccaaguggggaccuauggacucaacacguuuacaaauauggaagcccagcugauucggcagauggagggcgaaggggucuucaaaaacauccagcaucuuaccgugacagaggagguugccgugcacaacuggcuggcucgcgucggcagagaacggcucucucgcauggccauuagcggagaugacugcguggucaagccucuggaugacagauucgcuaaugcccugaccgcgcucaacgauaugggcaagauccggaaagacauccaacagugggagcccuccaagggguggaaugauuggacacaggugcccuuuugcucucaucacuuccacgaacugauuaugaaagacggaagaguucuuguggucccuugucgcaaccaggaugagcugaucggccgggccagaauuagccaaggggcuggauggucccuccgcgaaaccgccugccugggcaagucuuacgcucagauguggagccuuauguauuuucaucggagagaccugcgccucgccgcgaaugccaucuguuccgcugugccgucucacugggugcccacaagccggaccacaugguccauucaugccaaacacgaguggaugaccacagaggacaugcugaccguuuggaacagaguguggauccgcgaaaauccuuggauggaggauaagacgcccgucgaaagcugggaggaaauuccuuaccuggggaagcgggaggaccaguggugcggcucucucaucggacugacauccagagcuaccugggccaaaaacauccaggcugccauuaaucaagugcgcagccuuaucggcaacgaggaauauaccgauuacaugcccucuaugaagcgguucagacgggaggaagaggaagcggggguucugugguga

SEQ ID NO: 20120 - RNA, 9876 nt, Artificial Sequence
  derived and/or modified CDS sequence (opt5) from DENV-2__EU482676__SS-prME
uccgccuccaugaucauuaugcugauccccaccgugauggcuuuccaccucacaacgagaaauggagagccucauaugauugucgggauccaggaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcguucugauuuucauccuucugacagcuguggccccuucuaugacgaugagaugcauuggaaucuccaaccgggauuuugucgaaggcguguccgggggaagcuggguugacaucgugcucgagcacggcucuugugucaccacaauggcgaagaauaagcccacccuggauuucgaacuuauuaaaacagaggccaagcagccugcuacccugcgcaaauauugcaucaaggccaaacucacgaacacaaccaccgaauccagauguccgacacaaggggagcccagccugaaggaggaacaggacaagcgguuugugugcaaacauucuaugguggaucgcggauggggcaauggcugugggcuguucggaaagggcgggauuguuacaugcgcuauguuuacaugcaaaaagaacauggagggaagaaucguucagccugaaaaucucgaguacacgauuguggugacaccccacuccggcgaggaacaugccgucgggaacgacacaggaaaacacggcaaggagaucaaagugaccccucagagcucuaucacagaagcggagcugaccggcuaugggacgguuaccauggaauguagcccccggacaggacuugauuucaaugagauggugcugcuccaaauggaaaacaaggccuggcugguccaccgccagugguuucuugaccugccgcucccuuggcugcccggcgcugauaagcaggagagcaauuggauucagaaagagacccuggugacauucaagaacccucaugccaaaaagcaagacguugugguccucgggucccaggaaggagcuaugcacaccgcccugacgggcgccacagagauccagaugucuagcgggaaucuucuguuuaccggccaucucaaaugcagacugcggauggacaaacuucaacugaagggaauguccuacagcauguguacaggcaaauucaagguggucaaagaaauugcugagacccagcacgggaccaucgugauuagaguucaguaugagggagauggcucucccugcaagauccccuucgaaaucauggaccucgagaaacgcuacgugcuggggcggcugauuacagucaacccuaucgugacggaaaaggauuccccgguuaacauugaggcggaacccccuuuuggagacagcuacaucauuaucggcguggagcccgggcagcucaagcugaauugguucaaaaagggcucuagcauuggacaaauguuugagaccacaaugagaggcgccaaacgcauggcuauccuuggggauaccgccugggacuucggaucccugggcggggucuuuacaucuaucggaaaggcccuccaucagguguucggcgcuauuuauggggccgcguuuagcggcguguccuggaccaugaaaauccugauuggaguuaucauuacguggaucggcaugaacagccggucuacaucccugagcgucucucuugugcucguggggaucgucacccuguaccugggagugaugguucaggcugauuccggcuguguggucagcuggaagaauaaggaacucaaaugcggguccggaauuuucaucaccgacaacgugcacacauggaccgagcaguauaaguuucaaccugaaucucccagcaaacuggccuccgccauucagaaggcucaggaggaaggcaucugugggauuagaucuguuacacgccuugagaaucugauguggaaacagaucacgccggagcucaaccacauccuggccgaaaaugaggugaagcugaccauuaugacaggcgauaucaaaggaauuaugcaagcuggcaagcggagccuuagaccucagcccaccgaacucaaguacuccuggaaaacaugggggaaggccaaaaugcugagcaccgagucuuauaaccagacguuccugaucgacggaccugaaaccgcggagugccccaauacaaaccgcgccuggaacucccucgaggucgaagauuacggcuuugggguguucaccacaaacauuuggcugaaacuuaaagagaagcaggacgucuuuugugacagcaagcugaugucugcugccaucaaagauaaucgggcugugcaugccgacaugggauauuggaucgaauccgcgcucaacgauaccuggaagauugagagagccagcuucaucgaggucaaaaauugccacuggccuaagucucauacacuguggagcaacggcgugcuggaauccgagaugauuauccccaaaaaccuugcuggcccggugagccaacacaauuaccgcccuggguaccacacccagauugccggacccuggcaucucggcaagcuggaaauggacuucgauuuuugugacgggacgacagucaucguuaccgaggauugcggaaaccggggccccucucugagaaccacaaccgcuuccgggaagcucauuacggaauggugcugucggagcugcacacugccuccgcuucgcuauagaggagaggacggcuguugguacggcauggagauccggccccugaaagaaaaggaggaaaaucucgugaacucccuggugaccgccgggcacggacaggucgauaauuucucucugggcgugcuugggauggcccucuuucuggaggaaaugcugagaacacgcguuggaaccaaacaugcuauccuccugguggcggucagcuucgugacacuuauuaccggcaacauguccuuuaaggaccuggggcggguuguggucauggugggagccacgauggcugaugacaucggcaugggcguuaccuaucucgcccugcuggccgcuuucaaagugagaccuacauuugccgcggggcuucugcuccgcaagcugaccucuaaggagcucaugaugacaaccauuggaaucguccugcuuagccaauccacgauucccgagacagugcuggaacucaccgaugcucuggcccugggcaugauggugcuuaaaaucgucagaaauauggagaaguaccagcuggccguuacaaucauggcuauucucugcgugccuaacgccgugauccugcagaaugcguggaaagucucuuguaccauucucgcugugguuagcgugagcccccugcuucugaccagcucucagcaaaagacagacuggaucccucucgcccugacgauuaaagggcugaaccccaccgccaucuuccuuacaacccugucccggacaaauaagaaacgcagcuggccgcucaacgaagcuaucauggccgucggaauggugucuauucuggcuuccagccuccugaagaaugacaucccuaugaccggcccccuuguugccgggggacugcugacggugugcuauguccucacaggcagaucugcggaucuggagcuugaacgggccaccgacgugaagugggaggaucaggcugagauuuccggcagcuccccuauccugagcauuaccaucucugaagacgggagcauguccauuaaaaacgaggaagaggagcagacacucaccauccugauccgcacaggacuccuggucauuucuggccuuuuucccaucagcauuccgaucacggccgcugccugguaccugugggaagugaagaaacagagagccgggguucugugggaugugccuucucccccucccaugggaaaggcugagcucgaagacggcgcguaucggauuaaacaaaaggggauccugggauacagccagaucggcgccggcgucuacaaggaggggaccuuccacacaauguggcaugugacccgcggagcuguucuuaugcacaaaggcaagagaauugaacccagcugggccgaugugaaaaaggaccugaucuccuaugggggaggcuggaaacucgagggggaguggaaggaaggagaggaaguccaggugcuggcccucgagccuggcaagaauccgcgggcugugcagacaaaacccggccuguuuaagaccaacacggggaccauuggagccguuucucuugauuucagcccuggcacauccgggagccccaucauugacaaaaagggaaaagucgugggccuguacgggaacggaguggucacccgcucuggcgcguauguguccgcuaucgcccaaacagaaaagagcaucgaggauaauccugagauugaagacgauaucuuuagaaagcggagacugaccauuauggaccuccaccccggcgccgggaaaacaaagcgcuaccugccugcuaucguucgggaggccauuaaaagaggacuucgcacgcugauccucgcgccgacccggguggucgcugccgaaauggaggaagcccugagaggccuccccauucgcuaucagaccccugcuauccgggccgagcauaccgggagagagaucguggaccugaugugucacgcuaccuucacaaugcgccuucugucucccguucgggugccuaacuacaaucugauuaucauggaugaagcccauuucacggaccccgcguccauugccgcuagaggauauaucagcacccgggucgagaugggcgaagccgcugggauuuuuaugacagccaccccgccuggcucccgcgaucccuucccccagucuaacgccccuaucaucgacgaggagagagaaauucccgagcggagcuggaacuccggacacgaaugggugacagauuuuaagggcaaaaccguuugguucgugccuagcaucaaggcugggaacgacauugcggccugccuccgcaagaauggcaagaaggucauccaacugucuagaaaaacguuugauuccgaguacgugaagacacggaccaacgacugggauuucguggucaccacagacauuagcgaaaugggcgcuaauuuuaaagccgagagaguuaucgauccgcgccgguguaugaagcccgugauccuuaccgacggggaggaaagagugauucuggccggaccuaugcccgucacacauucuagcgcugcccagcgccggggcagaaucgggcgcaacccuaaaaaugagaacgaccaguacauuuauaugggcgaaccccucgagaaugaugaagacugcgcgcacuggaaggaggcuaagaugcugcuggauaacaucaauaccccggagggaauuaucccuuccauguucgaacccgagcgggaaaaaguggacgccauugauggcgaguacagacuccgcggggaagccagaaagacguuuguugaccuuaugcggcgcggagaucugccuguguggcuggcuuauaaagucgccgcggagggcaucaacuacgccgacagacggugguguuucgaugggaucaagaacaaucagauucucgaggaaaacguggagguugaaaucuggacaaaagagggagagcgcaagaagcugaaacccagauggcuugacgcucggauuuauucugauccucuggcccucaaggaauuuaaagaguucgcugccggcagaaagagccugacccugaaucucaucacagaaauggggcgccuucccaccuucaugacgcagaagacccgggacgcucuggauaaccuggccgugcuccacacagcggaggccggcggcagagcuuacaaucaugcccuguccgaacuuccggagacccuggagacacuccugcugcucacccuucuggcuacagucaccggcgggauuuuucuguuccucaugucuggacgcggcaucgggaagaugacgcugggaaugugcugcaucauuacagccagcauccuucugugguaugcccagauucagccucacuggaucgcugcguccauuauccucgaauuuuuccugaucgugcugcucauucccgagcccgaaaagcagcggaccccucaagacaaccagcuuaccuacgucgugaucgccauucugacaguuguggcugccaccauggccaaugagaugggcuuucuggagaaaacgaagaaagacuucggccucgggagcaucgcuacgcagcagccggagucuaacauucuggauaucgaccuuagacccgccuccgcguggacccuguacgccguggcuacaaccuuugucacaccuaugcuccggcauagcauugaaaauuccucuguuaacgugagccugaccgccaucgcuaaucaagccacggugcugaugggacucggcaagggguggccccuuuccaaaauggauaucggagucccucugcuggcgauuggcuguuauucucaggugaaccccaucacccucacagccgcucugcuucugcucguugcccacuacgcuauuaucgggccuggacugcaggccaaggcuacccgcgaagcccagaagagagcggccgcuggcauuaugaaaaauccgacaguggacggcaucaccgucaucgaucuggaccccauuccuuaugaucccaaguucgagaaacaacucgggcaagugaugcuucugauccugugcgucacacaggugcucaugaugcggacaaccugggcccugugugaagcucuuacacuggccaccggaccuauuagcacccucugggagggcaaccccgggcgcuuuuggaauacaacgaucgccguuuccauggcgaacauuuucagaggaagcuaccuggcuggcgccgggcugcucuuuucuaucaugaagaauaccacaaacacccggcgcggaacaggcaacaucggcgaaacccuuggggagaaauggaaguccagacugaaugcucugggaaaaagcgaguuccaaauuuauaagaagucuggcauccaggaaguggaccggacgcucgccaaagaggggauuaagcgcggagaaacagaucaccaugccgucuccagaggcagcgcuaaacugcggugguuuguggagagaaacaugguuaccccggaggggaagguggucgaccuuggaugcggccgcggcggguggucuuacuauuguggaggccugcggaaugugagagaagugaaagggcucaccaagggaggcccugggcacgaggaacccauccccaugagcacauacggauggaaccugguucgccugcaguccggcgucgauguguucuucauuccucccgagaagugcgacacccuccuuugugauaucggcgaaucuagcccuaauccgacaguggaggccgggcggacgcugagaguccugaaccucguugagaauuggcugaacaauaacacccaguuuugcaucaaagugcuuaaucccuacaugccuuccgugauugaaaagauggaggcgcugcaacgcaaauauggaggcgcccucguccggaacccccugagcagaaauuccacacaugaaauguacugggugucuaacgcuagcgggaauaucguuuccucugugaacaugauuagccgcaugcugaucaaccgguucaccaugagacacaagaaagccacauaugagccugacgucgaccucggauccggcacccgcaauauugggaucgaaucugagauucccaaccuugauaucaucggaaagcggauugagaagaucaaacaggaacaugagacgagcuggcacuacgaccaggaucacccguauaagaccugggcuuaccauggcuccuaugaaacaaaacagaccggcagcgccucuuccauggugaaugggguugugagacugcugacaaagccuugggacguccuccccaccgugacacaaauggcgaugaccgauacgacaccuuuuggacagcagcgcguguucaaagagaaggucgacaccagaacccaggaacccaaggagggcaccaaaaagcugaugaaaauuacggccgaguggcuuuggaaggaacuggggaaaaagaaaaccccucggauguguacacgcgaggaauuuaccagaaagguucggagcaacgcugcccucggagcuaucuucacagaugagaauaaguggaaaucugccagagaggcuguggaagacucccgguuuugggagcugguggauaaggaacgcaaccugcaccucgagggcaaaugcgaaaccugugucuacaauaugauggggaagagagagaaaaagcugggagaguucggcaaggccaaaggcagccgggcgauuugguacauguggcuuggggcccgcuuucuggaguucgaggcucucggauuucugaacgaagaccauugguucucuagagaaaauucccuuagcggcguggaaggggagggacugcacaagcucggcuauauccugcgggauguuuccaaaaaggaagggggagccauguacgcugacgacacagccggaugggauacccgcaucacgcuggaggaccucaaaaacgaggaaauggugaccaaucacauggagggcgaacauaagaagcuggccgaggcgauuuuuaaacuuacauaucaaaacaaggucgugagaguucagcggcccaccccgcgcgggacagugauggauaucauuagcagacgggaccagcgcggaucuggccaagucgggaccuacggacugaauacguucacaaacauggaggcucagcucaucagacagauggaaggcgaggggguguucaaaaauauucagcaccugaccguuacagaagagguggccguccaaaacuggcuugcccgggugggccgcgagagacugagccggauggcuaucuccggagaugacugcgucgugaagccucucgaugacagauuugccaacgcucugaccgcccugaaugauaugggcaaaauccgcaaggacauucagcagugggaacccucuaagggguggaacgauuggacgcagguucccuucugcagccaucacuuucaugagcucaucaugaaagacggacgggugcuggucgugccuuguagaaaucaagaugaacuuauuggccgcgcgcggaucucccagggggccggauggucucugagagagaccgcuugccucggcaagagcuaugcccagauguggucccugauguacuuccaccgccgggaccuuagacuggcugccaacgcgauuuguucugccgugccgagccacuggguucccacaucccgcaccacauggagcauccaugcuaaacacgaauggaugaccacagaggacaugcucgccguguggaaucgggucuggauuagagagaacccuuggauggaagauaagacccccguggagucuugggaagagaucccuuaucuggggaaacgcgaagaccaguggugcggcucccugaucggacucacgagccgggcuacaugggccaagaauauucaagcugccaucaaccagguuagaucucugauuggcaaugaggaguacaccgauuacaugcccuccaugaagcgguuuagacgcgaagaggaagaggcgggggugcuuugguga

SEQ ID NO: 20121 - RNA, 9876 nt, Artificial Sequence
  derived and/or modified CDS sequence (opt5) from DENV-2__EU482677__SS-prME
agcgccggcaugaucauuaugcugauccccaccgucauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucgugaccgacaacguucacacauggaccgaacaguauaaguuucaaccugagucccccucuaaacuggccagcgccauccagaaggcucaggaagaggggauuuguggcauccgguccgugacaagacuugagaaucugauguggaaacagauuacgccggaacucaaccacauccuggccgagaaugaagucaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaagaaaagcaggacgcuuuuugugacuccaagcugaugagcgccgcuauuaaagauaaucgcgccgugcaugcggacaugggcuauuggaucgagucugcccucaacgauaccuggaagaucgagaaggcuagcuucauugaagucaagaauugccacuggccuaaaagccauacacuguggucuaacggcgugcuggagagcgaaaugaucauucccaagaaccuugccgggccggugucccaacacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauucgcccccugaaggagaaagaagagaaucucgugaacagccuggugaccgccggacacggccaggucgauaauuucucccugggggugcuuggaauggcucucuuucuggaagagaugcugagaacacggguuggcaccaagcaugcgauccuccugguggccgucucuuucgugacacuuaucaccgggaacaugagcuuuaaagaccugggaagaguuguggucauggugggcgcuacgauggccgaugacauuggcauggggguuaccuaucucgcccugcuggcugccuucaaggugcgcccuacauuugcggcuggacuucugcuccggaagcugaccuccaaagagcucaugaugacaaccaucggcauuguccugcuuucucaaagcacgauccccgaaacagugcuggagcucaccgaugcccuggcccuggggaugauggugcuuaagauugucagaaauauggaaaaauaccagcuggcuguuacaaucauggccauccucugcgugccuaacgcggugauucugcagaaugcuuggaaggucuccuguaccauccucgccgugguuucugugagcccccugcuucugaccuccagccagcagaagaccgacuggauuccucucgcccugacgaucaagggacugaaccccaccgcuauuuuccuuacaacccugucucgcacaaauaaaaagagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauucugaucagaacaggccuccuggucaucuccgggcuuuuucccauuucuaucccgauuacggcugccgccugguaccugugggaggugaaaaagcagcgggcuggaguucugugggaugugccuucucccccucccaugggcaaagcggaacucgaggacggggccuaucgcaucaagcaaaagggcauucugggauacucccagaucggcgcuggggucuacaaagaaggaaccuuccacacaauguggcaugugaccagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccgugcagacaaagcccgggcuguuuaaaaccuccacgggaaccaucggcgcgguuucucuugauuucagcccugggacauccggaagccccauuaucgacaagaaaggcaaggucguggggcuguacggaaacggcguggucaccagaucuggcgcuuauguguccgccauugcccaaacagaaaagagcaucgaggauaacccugaaaucgaggacgauauuuuucggaaacgcagacugaccaucauggaccuccaccccggggcuggaaagacaaaacgguaccugccugccauuguuagagaagcgaucaagcgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugucucccguuagagugccuaauuacaaccugaucauuauggaugaggcgcauuucacggaccccgccuccaucgcugcccgcggcuauauuagcacccgggucgaaaugggggaggcugccggcaucuuuaugacagccaccccgccuggauccagagaucccuucccccagucuaaugcuccuauuaucgacgaggaacgggagauccccgaacgcagcuggaacuccggccacgagugggugacagauuuuaaagggaagaccguuugguucgugccuagcauuaaggcgggaaaugacaucgccgcuugccuccgcaaaaacggcaagaaagucauucaacugucucggaagacguuugauuccgaauacgugaaaacaaagaccaaugacugggauuucguggucaccacagacaucagcgagaugggggccaacuuuaaagccgagcgcguuauugauccgagacgguguaugaagcccgugauccuuaccgacggagaagagagagugauccuggcuggcccuaugcccgucacacauucuagcgccgcgcagcgccgggggagaauuggccgcaauccuaagaacgaaaaugaccaguacaucuauaugggagagccccucgaaaacgaugaggacugcgcucacuggaaagaggccaagaugcugcuggauaauauuaacaccccggaaggcaucauuccuuccauguucgagcccgaacgggagaaaguggacgccaucgauggggaauacagacuccgcggagaggcucggaagacguuuguugaccuuaugagacgcggcgaucugccuguguggcuggccuauaaagucgcggccgaggggauuaauuacgcugacagacggugguguuucgauggaaucaagaacaaccagauccucgaagagaauguggaaguugagauuuggacaaaggagggcgaacgcaaaaagcugaaacccagauggcuugacgcccggaucuauucugauccucuggcucucaaggaguuuaaagaguucgccgcugggcgcaagagccugacccugaaccucauuacagagaugggcagacuucccaccuucaugacgcaaaaggcccgggacgcgcuggauaaucuggccgugcuccacaccgcugaagccggaggcagagcuuacaaccaugcccuguccgagcuuccggagacacuggaaacccuccugcugcucacacuucuggccaccgucacagggggaaucuuucuguuccucaugucuggccgcgggauuggaaaaaugacccugggcaugugcugcaucaucacggcuagcauucuucugugguaugcgcagauccagccucacuggauugccgcuuccaucauucucgaguuuuuccugaucgugcugcucauccccgaacccgagaagcagcggacaccucaagacaaucagcuuaccuacgucgugauugccauccugaccguuguggccgcuacaauggccaacgaaaugggcuuucuggagaaaaccaagaaagaccucgggcugggaagcauugcgacacagcagccggagucuaauauccuugauauugaccugagacccgccuccgcuuggacgcucuacgccguggcuaccacauucgucaccccuaugcugcgccauagcaucgaaaacuccucuguuaaugugagccugacagccauugcgaaccaagccaccgugcucaugggccuugggaagggauggccccuguccaagauggauaucggcgucccucugcucgcuaucggguguuauucucaggugaaucccauuacgcugaccgccgcccuucugcuccugguugcccacuacgcuaucauuggaccuggccugcaggccaaagcgacacgggaggcccagaagagagcugccgcuggcaucaugaaaaacccgaccguggacgggauuacagucaucgaucucgaccccaucccuuaugaucccaaguuugaaaaacaacuuggacaggugaugcugcugauucucugcgucacccaggugcugaugaugcggacgacaugggcccuuugugaggcccugacccucgcgacaggcccuaucagcacccugugggaagggaaucccggacgcuucuggaacaccacaauugcuguuuccauggccaauaucuuuagaggcagcuaccuggcuggggccggacuccuuuucucuauuaugaagaacacgaccaauacacggcgcggcaccggcaacaucggggagacacugggagagaaauggaaguccagacugaacgcccucggcaagagcgaauuucaaaccuauaaaaagucugggauccaggagguggaccggacgcuggcuaaagaaggaauuaagcgcggcgagacagaucaccaugccgucuccagagggagcgcgaaacuucggugguucguggagcgcaauaugguuaccccggaaggaaagguggucgaccugggcugcggcagagggggauggucuuacuauuguggcgggcucaagaacgugcgggaggugaaaggacugaccaagggcgggccuggacacgaagaacccauccccaugagcacauacggcuggaaucugguuagacuccaguccggcgucgauguguuuuucauuccucccgaaaaaugcgacacccuucugugugauaucggggagucuagcccuaacccgacaguggaggccggacgcacgcugcggguccucaaucugguugaaaacuggcuuaauaacaauacccaguucugcauuaaggugcugaaccccuacaugccuuccgugaucgagaaaauggaagcucuccaaagaaaguauggcggggcccugguccgcaauccccugagccggaacuccacacaugagauguacugggugucuaaugcuagcggaaacaucguuuccucugugaauaugauuagcagaaugcucaucaaccgcuuuaccaugcggcacaagaaagccacauaugaaccugacgucgaccuuggcuccgggaccagaaacauuggaaaugagucugagauccccaaccuggauauuaucggcaagcgcauugagaaaaucaagcaggagcaugaaacgagcuggcacuacgaccaggaucacccguauaaaaccugggcguaccauggcuccuaugagacaaagcagaccgggagcgccucuuccauggugaauggaguugugcggcugcucacaaagccuugggacguccugcccaccgugacacaaauggcuaugaccgauacgacaccuuucggccagcagagaguguuuaaagaaaaggucgacacccgcacccaggagcccaaagaggggacaaagaaacuuaugaagaucacggccgaauggcuguggaaagagcucggaaagaagaaaaccccucggauguguacaagagaagaguucacccgcaagguuagaagcaacgcugcccugggcgcuauuuuuacagaugagaauaaauggaagucugcccgggaagcgguggaggacucccgcuucugggaacugguggauaaagagagaaaccuccaccuggaagggaagugcgagaccugugucuacaauaugaugggaaagcgggagaagaaacuuggcgaauuuggcaaagccaaagggagcagagcuaucugguacauguggcugggagcccgguuccucgaguuugaagcucugggcuuccuuaacgaggaccauugguuuucucgcgaaaauucccugagcgggguggagggagagggccuccacaaacugggguauauucugagagauguuuccaagaaggaaggcggagccauguacgccgacgacacagcgggcugggauacccggaucacgcucgaggaccugaaaaacgaagagauggugaccaaucacauggaaggggagcauaagaaacuugcugaggccauuuucaagcugacauaucaaaacaaagucgugcgcguucagagacccaccccgcggggaacagugauggauaucaucagccgcagagaccagcggggcucugggcaagucggaaccuacggccucaauacguuuacaaacauggaagcccagcugauucgccagauggagggggaaggcguguucaagaauauccagcaccuuaccguuacagaggagguggcuguccaaaacuggcuggccagagugggacgggaacgccucagcagaauggcuauuuccggcgaugacugcgucgugaagccucuggaugaccgguucgccaacgcgcugaccgcccucaaugauauggggaaaauccgcaaggacauucagcagugggagcccucuaaaggauggaacgauuggacgcagguucccuuuugcagccaucacuuccaugaacugaucaugaaggacggcagagugcuugucgugccuugucggaaucaagaugagcugaucgggagagcucgcauuucccagggagccggcuggucucuccgggaaaccgcuugccuggggaaaagcuaugcccagauguggucccuuauguacuuucacagacgcgaccugcggcucgcggccaacgcuaucuguucugccgugccgagccacuggguucccacauccagaaccacauggagcauucaugcuaagcacgaguggaugaccacagaggacaugcugaccguguggaaucgcgucuggauccgggaaaacccuuggauggaggauaagacgcccguggaaucuugggaggaaauuccuuaucugggcaaaagagaggaccaguggugcggaucccucaucggccugacaagccgcgccaccugggcuaagaauauucaaguugccaucaaccaggugcggucucuuaucgggaaugaggaauacaccgauuacaugcccuccaugaaaagauuccgccgggaggaagaggaagcgggaguccugugguga

SEQ ID NO: 20122 - RNA, 9876 nt, Artificial Sequence
  derived and/or modified CDS sequence (opt5) from DENV-2__EU482678__SS-prME
agcgccggcaugaucauuaugcugauccccaccgucauggcuuuccaccugacaacgcggaauggggagccucauaugauugucggaauccaggaaaagggcaagucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugaugagcaggaauccaauuggauucagaaggagacccuggugacauucaaaaacccucaugccaagaaacaagacguugugguccucggaagccaggaaggcgcuaugcacaccgcccugacgggggccacagagauccagauguccucuggcaaucuucuguuuaccggacaucucaagugccgccugagaauggacaaacuucaacugaagggcaugagcuacuccauguguacagggaaguucaaaguggucaaggagauugcugaaacccagcacggaaccaucgugauucggguucaguaugagggcgaugggagccccugcaaaauccccuucgaaaucauggaccucgagaagagauacgugcugggacgccugauuacagucaacccuaucgugacggaaaaagauucuccgguuaacauugaggcggagcccccuuuuggcgacuccuacaucauuaucgggguggaacccggccagcucaagcugaauugguucaagaaaggaagcucuauuggccaaauguuugagaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggaacucaagugcggaagcggcauuuucaucaccgacaacgugcacacauggaccgagcaguauaaauuucaaccugaaucccccucuaagcuggccagcgccauucagaaagcucaggaggaggggaucuguggcauucgguccguuacaagacuugaaaaucugauguggaagcagaucacgccggagcucaaccacauccuggccgaaaaugaggugaaacugaccauuaugacaggagauaucaagggcauuaugcaagcugggaaacgcucucuucggccucagcccaccgaacucaaguacagcuggaagacauggggaaaagccaagaugcuguccaccgagagcuauaaccagacguuccugaucgacggcccugagaccacagaaugccccaauaccaacagagcguggaacucucucgaggucgaagauuacggguuuggaguguucacaaccaacauuuggcugaaacuuaaggagaaacaggacgccuuuugugacuccaagcugaugagcgcugccaucaaggauaaucgcgcuguucaugccgacaugggcuauuggaucgagucugcgcucaacgauacauggaaaauugaaaaggccuccuucaucgaggugaaaaauugccacuggccuaagagccauacccuguggucuaacggcguccuggaaagcgagaugauuauccccaaaaaccuugcugggccggugucccaacacaauuaccggccuggauaccacacgcagauugccggccccuggcaucucgggaagcuggaaauggacuucgauuuuugugacggaacaaccgugaucgucaccgaggauugcggcaacagagggcccagccugcgcacaaccacggcuucuggaaagcucauuacagaguggugcugucgguccugcacccugccuccgcuuagauaucggggcgaagacggcuguugguacgggauggagauccgcccccugaaagaaaaggaggaaaaucucguuaacagccuggugacagccggacacggccagguggauaauuucucccuggggguccuuggaauggcccucuuucuggaggagaugcugagaacccgggugggcacaaaacaugcuauccuccugguugcggugucuuucgucacccuuauuacggggaacaugagcuuuaaggaccugggaagagugguugugauggucggcgccaccauggcugaugacaucggcaugggggugacauaucucgcccugcuggccgcuuucaaaguucgcccuaccuuugccgcgggacuucugcuccggaagcugacauccaaggaacucaugaugaccacgauuggcaucgugcugcuuucucaaagcacaauucccgagaccguccuggaacucacagaugcucuggcccuggggaugauggugcuuaaaaucgugagaaauauggagaaguaccagcuggccgucaccaucauggcuauucucugcguuccuaacgccgugauccugcagaaugcguggaaaguguccuguaccauucucgcugucgugucuguuagcccccugcuucugacauccagccagcaaaagacggacuggaucccucucgcccuggccauuaaaggacugaaccccaccgcuaucuuccuuacaacccugucucgcacaaauaagaaaagauccuggccgcucaacgaagccaucauggcugugggcauggucagcauucuggccucuucccuccugaagaaugacaucccuaugaccgggccccuuguggcgggaggccugcugacgguuugcuaugugcucacaggccggagcgccgaucuggagcuugagcgcgcuaccgacgucaagugggaagaucaggccgagauuucuggguccagcccuauccuguccauuaccaucagcgaagacggaucuaugagcauuaaaaacgaggaggaggaacagacacucaccauccugaucagaacaggccuccuggugauuuccgggcuuuuucccaucucuauuccgaucacggcugccgccugguaccugugggaagucaagaaacagcgggcuggagugcugugggauguuccuucucccccucccaugggcaaggcggagcucgaagacggggccuaucgcauuaaacaaaagggaauccugggcuacucccagaucggcgcugggguguacaaggagggaaccuuccacacaauguggcaugucaccagaggcgccgugcuuaugcacaaagggaagcggauugagcccuccugggccgauguuaaaaaggaccugaucagcuauggaggcggguggaaacucgaaggagaguggaaggaaggcgaggaagugcagguccuggcucucgagccuggcaagaauccgcgcgccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccaaacagagaaguccaucgaagauaauccugagauugaagacgauaucuuucggaagcgcagacugaccauuauggaccuccaccccggggcuggaaaaacaaagcgguaccugccugccaucgugagagaggcgauuaaacgcggccuucggacgcugauccucgcuccgaccagaguuguggccgccgaaauggaggaggcucugcgcgggcuccccauucgguaucagaccccugccaucagagcugaacauaccggacgcgagaucgucgaccugaugugucacgccaccuucacaaugcggcuucugagccccgugagaguuccuaacuacaaucugauuaucauggaugaagcgcauuucacggaccccgccucuauugcugcccgcggcuauaucuccacccggguggagaugggggaggcugccggcauuuuuaugacagccaccccgccuggaagcagagaucccuucccccaguccaacgcuccuaucaucgacgaggaacgggaaauucccgagcgcucuuggaauacaggccacgaaugggucaccgauuuuaaggggaaaacggugugguucguuccuagcaucaaggcgggaaacgacauugccgcuugccucagaaagaauggcaaaaaggugauccaacugucccggaaaacauuugauagcgaguacgucaagacccgcaccaacgacugggauuucguggugacaaccgacauuucugagaugggggccaauuuuaaagccgaaagagucaucgauccgcggagauguaugaagcccguuauccuuacagacggagaggaacgcgugauucuggcuggcccuaugcccgugacccauuccagcgccgcgcagcggagagggcgcaucggccggaacccuaaaaaugagaacgaccaguacauuuauaugggagaaccccucgagaaugaugaggacugcgcucacuggaaggaagccaagaugcugcuggauaacaucaauacgccggagggcauuaucccuucuauguucgaacccgagagagaaaaagucgacgccauugauggggaguaccgccuccggggagaggcuagaaagacauuuguggaccuuaugcgcagaggcgaucugccuguuuggcuggccuauaaaguggcggccgaagggaucaacuacgcugaccggcgcugguguuucgauggaaucaagaacaaucagauucucgaggaaaacgucgagguggagaucuggaccaaagaaggcgagagaaagaagcugaaaccccgguggcuugacgcccgcauuuauagcgauccucuggcucucaaggaauuuaaagaguucgccgcugggagaaagucccugacacugaaucucaucaccgaaaugggccggcuucccacguucaugacccagaagacgagagacgcccuggauaaccuggcgguucuccacaccgccgaggcuggaggccgcgccuacaaucaugcucugucugagcuuccggaaacacuggagacccuccugcugcucacacuucuggccaccgugacagggggaauuuuucuguuccucaugagcggccgggggaucggaaagaugacacugggcaugugcugcaucauuaccgccuccauccuucugugguaugcucagauucagccucacuggaucgcggccucuauuauccucgaauuuuuccugaucguccugcucauucccgagcccgaaaagcagagaaccccucaagacaaccagcuuacauacguggucaucgcuauucugaccgugguugccgccacaauggcuaaugagaugggcuuucuggagaaaacgaagaaagaccucgggcugggaagcaucgccacccagcagccggaauccaacauucuugauaucgaccugcgccccgcgagcgccuggacacucuacgcuguggccaccacauucgugaccccuaugcugcggcauucuauugagaauagcagcgucaacguuucccugacggcuaucgccaaucaagcgaccgugcucaugggccuugggaagggauggccccugucuaaaauggauaucggcgugccucugcucgccauuggguguuauagccaggucaaccccaucacacugaccgcugcccuucugcuccugguggcucacuacgccauuaucggaccuggccugcaggcuaaggccacaagagaagcgcagaagcgggccgcugccggcauuaugaaaaauccgaccguugacgggaucacggugaucgaucucgaccccauuccuuaugaucccaaguuugagaaacaacuuggacaggucaugcugcugauccucugcgugacacagguccugaugaugcgcaccacaugggcucuuugugaagcccugacccucgccaccggcccuauuuccacacugugggaggggaaccccggaagauucuggaauacgaccaucgcggugucuauggcuaacauuuuucggggcagcuaccuggccggggcuggacuccuuuucuccaucaugaagaauacaaccaacacacgcagaggcaccggcaacaucggggagacgcugggagaaaaauggaaaagccggcugaaugcccucggcaaaucugaguuucaaauuuauaagaaguccgggauccaggaaguugaccgcacacuggccaaagagggaauuaagagaggcgagaccgaucaccaugcugugagccgggggucugccaaacuucgcugguucgucgaaagaaacauggugaccccggagggaaagguuguggaccugggcugcggcagagggggaugguccuacuauuguggcgggcucaaaaauguccgggaagugaagggacugacaaagggcgggccuggacacgaggaacccauccccaugagcaccuacggcuggaaccuggugcgccuccagucuggcguugaugucuuuuucauuccucccgagaaaugcgacacacuucugugugauaucggggagagcuccccuaauccgacgguggaagcgggacggacccugagagugcucaaccuggucgagaauuggcuuaacaauaacacacaguucugcaucaagguucugaaucccuacaugccuucugugauugagaagauggaggcccuccaacgcaaguauggcggggcucuggugcggaacccccugagcagaaauuccacccaugaaauguacugggucagcaacgccuccggaaauaucgugucuagcguuaacaugauuucccgcaugcucaucaaccgguuuacaaugagacacaaaaaggcuaccuaugagccugacguggaccuuggcucugggacgcgcaauauuggaaucgagagcgaaauucccaaccuggauaucaucggcaagcggauugagaaaaucaagcaggaacaugagaccuccuggcacuacgaccaggaucacccguauaaaacaugggccuaccauggcucuuaugaaaccaagcagacagggagcgcguccagcauggucaauggagugguuagacugcucaccaaaccuugggacgugcugcccacagucacccaaauggccaugacggauacaaccccuuucggccagcagcgcguguuuaaggagaagguggacacccggacacaggagcccaaagaagggacgaagaaacuuaugaagauuaccgcugaguggcuguggaaagaacucggaaagaaaaagacaccuagaauguguacccgcgaggaguucacaagaaagguccggucuaacgccgcucugggcgccaucuuuaccgaugaaaauaaauggaaguccgcucgcgaggccguugaagacagcagauucugggagcugguggauaaagaacggaaccuccaccuggaggggaagugcgagacauguguguacaauaugaugggaaaaagagaaaagaaacuuggcgaguuuggcaaagcgaaggggucucgggccauuugguacauguggcugggagcucgcuuccucgaauuugaggcccugggcuuccuuaacgaagaccauugguuuuccagagagaauagccugucuggggucgagggagaaggccuccacaaacugggguauauccugcgggauguguccaagaaagagggcggagcuauguacgccgacgacaccgccggcugggauacgcgcaucacccucgaagaccugaagaacgaggaaaugguuacaaaucacaugaagggggagcauaagaaacuugcggaggcuauuuucaaacugaccuaucaaaacaaaguggucagagugcagcggcccacaccgcgcggaaccguuauggauaucauuagcagacgggaccagcgcggcuccgggcaagugggaacguacggccucaauacauuuaccaacauggaagcccagcugaucagacagauggagggggaaggcgucuucaaaaauauucagcaccuuacagugaccgaggagguugccgugcaaaacuggcuggcucgggucggacgcgaaagacucagccggauggccaucucuggcgaugacugcguggucaagccucuggaugaccgcuucgcuaacgcccugacggcgcucaaugauauggggaagaucagaaaagacauucagcagugggagcccagcaagggauggaacgauuggacccaggugcccuuuugcucccaucacuuccaugaacugaucaugaaagacggccggguucuuguggucccuuguagaaaucaagaugagcugauugggcgcgcccggaucucucagggagcuggcuggagccucagagaaacagccugccuggggaaguccuaugcucagauguggucucuuauguacuuucaccgccgggaccugagacucgccgcgaacgccauuuguagcgcugugccgucccacugggugcccaccucucgcacaaccuggagcauccaugccaaacacgaguggaugacaaccgaggacaugcugacgguuuggaaucggguguggauuagagaaaacccuuggauggaggauaagacacccgucgaauccugggaggaaaucccuuaucugggcaagcgcgaggaccaguggugcggaagccucaucggccugaccucucgggcuaccugggccaaaaauauucaagcugccaucaaccaggugagaucccuuauugggaaugaggaauacacagauuacaugcccagcaugaagcgcuuccggagagaggaagaggaagcgggaguucugugguga

SEQ ID NO: 20123 - RNA, 9876 nt, Artificial Sequence
  derived and/or modified CDS sequence (opt5) from DENV-2__EU482679__SS-prME
agcgccggaaugaucauuaugcugauccccacagugauggcuuuccaccugacaacgagaaauggggagccucauaugauuguuggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagccauaaccagacguuccugaucgacggcccugagaccgcggagugccccaauacaaacagagccuggaacucucucgaagucgaggauuauggguuuggaguguucaccacaaacauuuggcugaaacuuaaagaaaagcaggacgcuuuuugugacuccaagcugaugagcgccgcuaucaaagauaaucgcgccguucacgcggacaugggcuacuggaucgagucugcccucaacgauaccuggaagauugagaaggcuagcuucaucgaagugaagaauugccauuggccuaaaagccacacacuguggucuaacggcguccuggagagcgaaaugauuauccccaagaaccuugccgggccggugucccaacacaauuaucggccuggauaccauacccagauugcuggccccuggcaccucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaccggggcgaggacggcuguugguaugggauggaaauccgcccccugaaggagaaagaagagaaucucguuaacagccuggugaccgccggacauggccagguggauaauuucucccuggggguccuuggaauggcucucuuucuggaagagaugcugagaacacgggugggcaccaagcacgcgauccuccugguugccgugucuuucgucacacuuauuaccgggaacaugagcuuuaaagaccugggaagagugguugugauggucggcgcuacgauggccgaugacaucggcaugggggugaccuaccucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaucagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuacgugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaucugugggaggucaaaaagcagcgggcuggagugcugugggauguuccuucucccccucccaugggcaaagcggaacucgaggacggggccuaccgcauuaagcaaaagggaauccugggcuauucccagaucggcgcugggguguacaaagaaggaaccuuccauacaauguggcacgucaccagaggcgccgugcuuaugcacaaggggaaacggauugagcccuccugggccgauguuaagaaagaccugaucagcuacggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguauggaaacggcguggugaccagaagcggcgcuuacgucucugccaucgcccaaacagagaaguccaucgaggauaauccugaaauugaggacgauaucuuucggaaacgcagacugaccauuauggaccuccaucccggggcuggaaagacaaaacgguaucugccugccaucgugagagaagcgauuaagcgcggccuucggacgcugauccucgcuccgaccagaguuguggccgccgagauggaagaggcucugcgcgggcuccccauucgguaccagaccccugccaucagagcugagcacaccggacgcgaaaucgucgaccugaugugucaugccaccuucacaaugcggcuucugagccccauuagagugccuaacuauaaucugaucauuauggaugaggcgcacuucacggaccccgccucuaucgcugcccgcggcuacauuuccacccggguugaaaugggggaggcugccggcaucuuuaugacagccaccccgccuggaagcagagaucccuucccccaguccaacgcuccuaucauugacgaggaacgggagauccccgaacgcucuuggaauagcggccaugagugggugacagauuuuaaagggaagaccgucugguucgugccuuccauuaaggcgggaaacgacaucgccgcuugccuccgcaaaaauggcaagaaaguuauucaacugagccggaagacguuugauucugaauaugugaaaacacgcaccaacgacugggauuucgucgugaccacagacaucuccgagaugggggccaauuuuaaggccgagagagugaucgauccgcggagauguaugaaacccgucauucuuaccgacggagaggaacgcguuauccuggcuggcccuaugcccgugacacacagcucugccgcgcagcggagagggcgcauuggccggaacccuaagaaugaaaacgaccaguacaucuacaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaucgccuccggggagaggcuagaaaaacguuugucgaccuuaugcgcagaggcgaucugccuguguggcuggccuacaagguugcggccgaggggaucaacuaugcugaccggcgcugguguuucgauggaauuaaaaacaaucagauccucgaagagaacguggaagucgagauuuggacaaaggagggcgaaagaaagaaacugaagccccgguggcuugacgcccgcaucuacuccgauccucuggcucucaaagaguuuaaggaguucgccgcugggagaaaaucucugacccugaaucucauuacagagaugggccggcuucccaccuucaugacgcaaaagaccagagacgcccuggauaaccuggcggugcuccauacagccgaagcuggaggccgcgccuauaaucacgcucugagcgagcuuccggagacccuggaaacacuccugcugcucacccuucuggccacaguuaccgggggaaucuuucuguuccucauguccggccgggggaucggaaagaugacgcugggcaugugcugcauuaucacagccucuauucuucugugguacgcucagauccagccucauuggauugcggccagcaucauccucgaguuuuuccugauugugcugcucauccccgaacccgagaaacagagaaccccucaagacaaccagcuuaccuaugucgugauugcuauccugacagucguggccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguugccacaaccuucgugacaccuaugcugcggcacuccaucgaaaauagcuccgugaacgucucucugaccgcuaucgccaaucaagcgacgguucucaugggccuugggaaaggauggccccugagcaagauggauauuggcgugccucugcucgccaucggguguuacucccaggugaaccccauuacccugacagcugcccuucugcuccuggucgcucacuaugccaucauuggaccuggccugcaggcuaaggccaccagagaggcgcagaaacgggccgcugccggcaucaugaagaauccgacaguggacgggaucaccguuauugaucucgaccccaucccuuacgaucccaaauuugaaaagcaacuuggacaggugaugcugcugauucucugcgucacacaggugcugaugaugcgcacaaccugggcucuuugugaggcccugacacucgccaccggcccuaucucuacccugugggaagggaaccccggaagauucuggaauacaacgauugcggucagcauggcuaacaucuuucggggcuccuaucuggccggggcuggacuccuuuucagcaucaugaaaaauaccacaaacacccgcagaggcacaggcaacaugggggagacccugggagagaaguggaaaucucggcugaaugcccucggcaaguccgaauuucaaauuuacaagaaaagcgggauccaggagguggaccgcacgcuggccaaggaaggaauuaaaagaggcgagacagaucaucacgcuguuucucggggguccgccaaacuucgcugguucguggagagaaacauggucaccccggaaggaaaagugguugaccugggcugcggcagagggggauggagcuauuacuguggcgggcucaagaaugugcgggaggucaagggacugaccaaaggcgggccuggacaugaagaacccauccccaugucuacauauggcuggaaccuggugcgccuccagagcggcguggaugucuuuuucauuccucccgaaaagugcgacacccuucugugugauaucggggaguccucuccuaauccgacagucgaggcgggacggacgcugagagugcucaaccugguggaaaauuggcuuaacaauaacacccaguucugcaucaaaguccugaaucccuacaugccuagcguuauugagaagauggaagcccuccaacgcaaauacggcggggcucuggugcggaacccccuguccagaaauagcacacacgagauguauuggguguccaacgccucuggaaauaucgucagcuccgugaacaugauuucucgcaugcucaucaaccgguuuaccaugagacauaagaaggcuacauacgaaccugacguugaccuuggcagcgggacccgcaauauuggaaucgaguccgagauucccaaccuggauaucaucggcaaacggauugaaaagaucaaacaggagcacgaaacgucuuggcacuaugaccaggaucauccguacaagaccugggccuaucacggcagcuacgagacaaaacagaccggguccgcgagcucuauggugaauggagucgugagacugcucacaaagccuugggacguucugcccaccgugacacaaauggccaugaccgauacgacaccuuucggccagcagcgcgucuuuaaggaaaaaguggacacccggacccaggagcccaaggaggggaccaagaaacuuaugaaaauuacggcugaauggcuguggaaggagcucggcaaaaagaagaccccuagaaugggcacacgcgaagaguucaccagaaaagugcgguccaacgccgcucugggggccaucuuuacagaugagaauaaguggaaaagcgcucgcgaagccgucgaggacucuagauucugggaacugguugauaaggagcggaaccuccaucuggaaggaaaaugugagaccugcguguauaauaugaugggcaagagagagaagaaacuuggcgaauuugggaaggcgaaaggaucccgggccauuugguacauguggcugggcgcucgcuuccucgaguuugaagcccugggguuccuuaacgaggaccacugguuuagcagagaaaauucucuguccggaguggagggcgaggggcuccacaagcugggcuacauccugcgggaugucagcaaaaaggaaggaggcgcuauguaugccgacgacacagccgggugggauacccgcaucacgcucgaggaccugaagaacgaagagauggugaccaaucauauggaaggagagcacaagaaacuugcggaggcuauuuucaaacugacauaccaaaacaaaguugugagaguccagcggcccaccccgcgcggcacagugauggauaucauuuccagacgggaccagcgcgggagcggacaaguuggcaccuaugggcucaauacguuuacaaacauggaagcccagcugaucagacagauggagggcgaaggaguguucaaaaauauucagcaucuuaccgucacagaggagguggccguucaaaacuggcuggcucgggugggccgcgaaagacucucucggauggccaucagcggggaugacugugucgugaagccucuggaugaccgcuucgcuaacgcccugaccgcgcucaaugauaugggaaagaucagaaaagacauucagcagugggagcccuccaagggcuggaacgauuggacgcagguccccuuuugcucucaccauuuccacgaacugaucaugaaagacgggcgggugcuuguugugccuugcagaaaucaagaugagcugauuggacgcgcccggaucagccagggcgcuggguggucccucagagaaaccgccugucugggcaagucuuacgcucagauguggagccuuauguauuuucaccgccgggaccugagacucgccgcgaacgccauuugcuccgcugucccgucucauugggugcccacaagccgcaccacaugguccauccacgccaaacaugaguggaugaccacagaggacaugcugaccguguggaaucggguuuggauuagagaaaacccuuggauggaggauaagacgcccguggaaagcugggaggaaaucccuuaccugggaaagcgcgaggaccagugguguggcucucucaucgggcugacaucccgggcuaccugggccaaaaauauucaagcugccaucaaccaggucagaagccuuauuggaaaugaggaauauaccgauuacaugcccucuaugaagcgcuuccggagagaggaagaggaagcgggcgugcugugguga

SEQ ID NO: 20124 - RNA, 9876 nt, Artificial Sequence
  derived and/or modified CDS sequence (opt5) from DENV-2__EU482774__SS-prME
agcgccggcaugaucauuaugcugauccccaccgugauggcuuuccaccucacaacgagaaauggggaaccucauaugauugucggaauccaggaaaagggcaaaucccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaaucuucauuggcguuaucauuacguggaucgggaugaacucccgcagcacaucucuguccgucagccuggugcuugugggaaucgucacccucuaccugggcgugaugguucaggcugauucuggguguguggucuccuggaagaauaaggagcugaaaugcggaagcggcauuuuuaucaccgacaacgugcacacauggaccgaacaguauaaguuccaaccugagucccccucuaaacucgccagcgccauucagaaggcucaggaagaggggaucuguggcauucgguccguuacaagacuggagaaucuuauguggaaacagaucacgccggaacugaaccacauccucgccgagaaugaagugaagcugaccauuaugacaggagauaucaaaggcauuaugcaagcugggaagcgcucucugcggccucagcccaccgagcuuaaguacagcuggaaaacauggggaaaggccaaaaugcucuccaccgaaagccauaaccagacguuucugaucgacggcccugagaccgcggagugccccaauacaaacagagccuggaacucucuggaagucgaggauuauggguucggaguguuuaccacaaacauuuggcucaagcugaaagaaaagcaggacgcuuucugugacuccaaacuuaugagcgccgcuaucaaagauaaucgcgccguucacgcggacaugggcuacuggaucgagucugcccugaacgauaccuggaagauugagaaggcuagcuucaucgaagugaagaauugccauuggccuaaaagccacacacucuggucuaacggcguccuggagagcgaaaugauuauccccaagaaccuggccgggccggugucccaacacaauuaucggccuggauaccauacccagauugcuggccccuggcaccuugggaagcucgagauggacuuugauuucugugacggaacgacagugaucgucaccgaagauugcggcaacagagggcccagccugcgcaccacaaccgccucuggaaaacugauuacggaguggugcugucgguccugcacacucccuccgcugagauaccggggcgaggacggcuguugguaugggauggaaauccgcccccuuaaggagaaagaagagaaucugguuaacagccucgugaccgccggacauggccagguggauaauuuuucccuggggguccugggaauggcucuuuuccucgaagagaugcugagaacacgggugggcaccaagcacgcgauccugcucguugccgugucuuuugucacacugauuaccgggaacaugagcuucaaagaccuuggaagagugguugugauggucggcgcuacgauggccgaugacaucggcaugggggugaccuaccuggcccuccuggcugccuuuaagguucgcccuacauucgcggcuggacugcuucugcggaagcucaccuccaaagagcugaugaugacaaccauuggcaucgugcuccugucucaaagcacgauucccgaaacaguccuugagcugaccgaugcccucgcccuggggaugauggugcugaagaucgugagaaauauggaaaaauaucagcuugcugucacaaucauggccauucugugcguuccuaacgcgguggugcuccagaaugcuuggaaggucuccuguaccauccuggccgugguuucugugagcccccuccugcuuaccuccagccagcagaaaaccgacuggauuccucuggcccucacgaucaagggacugaaccccaccgcuauuuuucugacaacccuuucucgcacaaauaaaaagagauccuggccgcugaacgaggccaucauggcugucggcauggugagcauccucgccucuucccugcucaagaaugacauuccuaugaccgggccccugguugcgggaggccuucugacggugugcuacguccugacaggccggagcgccgaucucgaacuggagcgcgcuaccgacgugaaaugggaggaucaggccgaaaucucuggguccagcccuauucuuuccaucaccauuagcgaggacggaucuaugagcaucaagaacgaagaggaggaacagacacugaccauucucaucagaacaggccugcucgucaucuccgggcuguuccccauuucuaucccgauuacggcugccgccugguaucuuugggaggugaaaaagcagcgggcuggaguucugugggaugugccuucucccccucccaugggcaaagcggaacuggaggacggggccuaccgcaucaagcaaaagggcauucucggauauucccagaucggcgcuggggucuacaaagaaggaaccuuucauacaauguggcacgugaccagaggcgccguucugaugcacaaggggaaacggaucgagcccuccugggccgaugugaagaaagaccuuauuagcuacggaggcggguggaagcuggagggagaauggaaggagggcgaagagguccaggugcucgcucuggaaccuggcaaaaauccgcgcgccgugcagacaaagcccgggcuguucaaaaccaacacgggaaccaucggcgcgguuucccuggauuuuucuccugggacaagcggaucccccauuaucgacaagaaaggcaaggucguggggcuuuauggaaacggcguggucaccagaagcggcgcuuacgugucugccauugcccaaacagagaaguccaucgaggauaauccugaaaucgaggacgauauuuuccggaaacgcagacugaccaucauggaccugcaucccggggcuggaaagacaaaacgguaucucccugccauuguuagagaagcgaucaagcgcggccugcggacgcuuauucuggcuccgaccagaguggucgccgccgagauggaagaggcucuccgcgggcugcccauccgguaccagaccccugccauuaaagcugagcacaccggaagagaaaucguggaccucaugugucaugccaccuucacaaugcgccugcuuagccccguucgggugccuaacuauaaucugaucauuauggaugaggcgcacuuuacggaccccgccucuaucgcugccagaggcuacauuuccacccgcgucgaaaugggggaggcugccggcaucuucaugacagccaccccgccuggaagccgggaucccuuuccccaguccaacgcuccuauuaucgacgaggaaagagagauccccgaacggucuuggaauagcggccaugagugggugacagauuucaaggggaagaccguuugguuugugccuuccauuaaagcgggaaacgacaucgccgcuugccugcgcaagaauggcaaaaaggucauucaacucagcagaaaaacguucgauucugaauaugugaagacacggaccaacgacugggauuuuguggucaccacagacaucuccgagaugggggccaauuucaaagccgagcgcguuauugauccgagacgguguaugaagcccgugauccugaccgacggagaagagagagugauccuugcuggcccuaugcccgucacacacagcucugccgcgcagcgccgggggagaauuggccgcaacccuaagaaugaaaacgaccaguacaucuacaugggagagccccuggaaaaugaugaggacugcgcucacuggaaagaggccaagaugcuccuggauaacauuaauaccccggaaggcaucauuccuagcauguuugagcccgaacgggagaaaguggacgccaucgauggggaauauagacugcgcggagaggcucggaagacguucguugaccucaugagacgcggcgaucuuccuguguggcuggccuacaaagucgcggccgaggggauuaacuaugcugacagacggugguguuuugauggaaucaagaacaaucagauccuggaagagaacguggaaguugagauuuggacaaaggagggcgaacgcaaaaagcucaaacccagauggcuggacgcccggaucuacuccgauccucuugcucugaaggaguucaaagaguucgccgcugggcgcaagucucucacccugaaucugauuacagagaugggcagacuccccaccuuuaugacgcaaaagacccgggacgcccuugauaaccuggcggugcugcauacagccgaagcuggaggcagagccuauaaucacgcucucagcgagcugccggagacccuugaaacacugcuccugcugacccuccuugccacagucaccgggggaaucuuccuguuucugauguccggccgcgggauuggaaaaaugacgcucggcaugugcugcaucaucacagccucuauucugcuuugguacgcucagauccagccucauuggauugcggccagcaucauucuggaguucuuucucaucgugcugcugauccccgaacccgagaagcagcggaccccucaagacaaccagcucaccuaugucgugauugcuauccuuacaguuguggccgccaccauggcuaaugaaaugggcuuccuggagaaaacaaagaaagaccuggggcucggauccauugccacgcagcagccggagagcaacauccuggauauugaccuuagacccgcgucugccuggacccuguacgcuguggccacaaccuuugucacaccuaugcuccgccacuccaucgaaaauagcuccguuaacgugucucugaccgcuauugccaaucaagcgacggugcugaugggccucgggaagggauggccccuuagcaagauggauaucggcgucccucugcuggccaucggguguuacucccaggugaaccccauuacccucacagcugcccugcuucugcucguugcucacuaugccaucauuggaccuggccugcaggcuaaagccacccgggaggcgcagaagagagccgcugccggcaucaugaaaaauccgacaguggacgggauuaccgucaucgaucuggaccccaucccuuacgaucccaaguucgaaaaacaacucggacaggugaugcuucugauucugugcgucacgcagguccucaugaugcggacaaccugggcucugugugaggcccuuacacuggccaccggcccuaucucuacccucugggaagggaaccccggacgcuuuuggaauacaacgauugcgguuagcauggcuaacaucuucagaggcuccuaucuggccggggcuggacugcucuuuagcauuaugaagaauaccacaaacacccggcgcggcacaggcaacaucggggagacccuuggagagaaauggaagucuagacugaaugcccugggcaaguccgaguuccaaaucuacaaaaagagcgggauucaggagguggaccggacgcucgccaaagaaggaaucaagcgcggcgagacagaucaucacgcugucucuagaggguccgccaaacugcggugguuuguggagcgcaacaugguuaccccggaaggaaagguggucgaccuuggcugcggcagagggggauggagcuauuacuguggcgggcugaagaaugugcgggaggugaaaggacucaccaagggcgggccuggacaugaagaacccauucccaugucuacauauggcuggaaccugguuagacugcagagcggcgucgauguguucuucaucccucccgaaaaaugcgacacccuccuuugugauauuggggaguccucuccuaauccgacaguggaggcgggacgcacgcugcggguccugaaccucguugaaaauuggcugaacaauaacacccaguuuugcaucaaggugcuuaaucccuacaugccuagcgugaucgagaaaauggaagcccugcaaagaaaguacggcggggcucucguccgcaacccccugucccggaauagcacacacgagauguauuggguguccaacgccucuggaaauauuguuagcuccgugaacaugaucucuagaaugcugauuaaccgcuucaccaugcggcauaagaaagcuacauacgaaccugacgucgaccucggcagcgggaccagaaauaucggaauugaguccgagauccccaaccuugauauuaucggcaagcgcaucgagaaaauuaagcaggagcacgaaacgucuuggcacuaugaccaggaucauccguacaaaaccugggccuaucacggcagcuacgagacaaagcagaccggguccgcgagcucuauggugaauggaguugugcggcugcugacaaagccuugggacguccuccccaccgugacacaaauggccaugaccgauacgacaccuuuuggccagcagagaguguucaaagaaaaggucgacacccgcacccaggagcccaaagaggggacaaagaaacugaugaagaucacggcuaaauggcuuuggaaggaacugggaaagaaaaagaccccucggauguguacaagagaggaauuuacccgcaaaguuagauccaacgccgcucucggcgccauuuucacagaugagaauaaguggaaaagcgcucgggaggccguggaagacucucgcuuuugggagcugguggauaaggaaagaaaccugcaucucgaggggaagugcgaaaccugugucuauaauaugaugggaaaacgggagaagaaacugggcgaguucggcaaggcgaaaggguccagagccaucugguacauguggcuuggagcucgguuucuggaguucgaggcccucggcuuucugaacgaagaccacugguucagccgcgaaaauucucuuuccgggguggaaggagagggccugcacaagcucggguacauucugagagauguuagcaagaaagagggcggagcuauguaugccgacgacacagccggcugggauacccggaucacgcuggaagaccucaagaacgaggaaauggugaccaaucauauggagggggaacacaaaaagcuggcggaggcuaucuuuaaacuuacauaccaaaacaaggucgugcgcguucagagacccaccccgcggggaacagugauggauauuaucucccgcagagaccagcggggcagcgggcaagucggaaccuauggccugaauacguucacaaacauggaggcccagcucauucgccagauggaaggggagggcguguucaagaauauccagcaucugaccguuacagaagagguggccguccaaaacuggcuugcuagagugggacgggagcgccugucuagaauggccauuagcggcgaugacugcgucgugaaaccucucgaugaccgguuugcuaacgcccugaccgcgcugaaugauauggggaagauccgcaaagacauccagcagugggaacccuccaagggauggaacgauuggacgcagguucccuucugcucucaccauuuucacgagcucauuaugaaagacggcagagugcuggucgugccuugucggaaucaagaugaacuuaucgggagagcccgcauuagccagggagcuggcuggucccugcgggagaccgccugccucgggaagucuuacgcucagauguggagccugauguauuuccacagacgcgaccuucggcuggccgcgaacgccaucuguuccgcugugccgucucauuggguucccacaagcagaaccacaugguccauucacgccaagcaugaauggaugaccacagaggacaugcucaccguguggaaucgcgucuggauccgggagaacccuuggauggaagauaaaacgcccguggagagcugggaagagauuccuuaccugggcaagagagaagaccaguggugcggaucucugaucggccucacaucccgcgcuaccugggccaaaaauauccaagcugccauuaaccagguucggagccugaucgggaaugaggaguauaccgauuacaugcccucuaugaagagauuucgccgggaagaggaagaggcgggagugcuuugguga

SEQ ID NO: 20125 - RNA, 9876 nt, Artificial Sequence
  derived and/or modified CDS sequence (opt5) from DENV-2__EU482775__SS-prME
agcgccggaaugaucauuaugcugauccccacagugauggcuuuccaccugacgacgagaaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuugcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucuagaacaaauaagaaacgguccuggccgcucaacgaggccaucauggcugugggcauggucagcauucuggccucuucccuccugaagaaugacaucccuaugaccgggccccuuguggcgggaggccugcugacgguuugcuaugugcucacaggccgcagcgccgaucuggaacuugagagagcuaccgacgucaagugggaggaucaggccgaaauuucuggguccagcccuauccuguccauuaccaucagcgaggacggaucuaugagcauuaaaaacgaagaggaggaacagacacucaccauccugauccggacaggccuccuggugauuuccgggcuuuuucccaucucuauuccgaucacggcugccgccugguaccugugggaggucaagaaacagcgcgcuggagugcugugggauguuccuucucccccucccaugggcaaggcggaacucgaggacggggccuauagaauuaaacaaaagggaauccugggcuacucccagaucggcgcugggguguacaaggaaggaaccuuccacacaauguggcaugucacccggggcgccgugcuuaugcacaaagggaagcgcauugagcccuccugggccgauguuagaaaagaccugaucagcuauggaggcggguggaagcucgagggagaauggaaagagggcgaagaggugcagguccuggcucucgaaccuggcaagaauccgcgggccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugacccgcagcggcgcuuaugucucugccaucgcccaaacagagaaauccaucgaggauaauccugaaauugaggacgauaucuuuagaaagcggagacugaccauuauggaccuccaccccggggcuggaaagacaaaacgcuaccugccugccaucgugcgggaagcgauuaagagaggccuucgcacgcugauccucgcuccgacccggguuguggccgccgagauggaagaggcucugagagggcuccccauucgcuaucagaccccugccauccgggcugagcauaccggaagagaaaucgucgaccugaugugucacgccaccuucacaaugcgccuucugagccccgugcggguuccuaacuacaaucugauuaucauggaugaggcgcauuucacggaccccgccucuauugcugccagaggcuauaucuccacccggguggaaaugggggaggcugccggcauuuuuaugacagccaccccgccuggaagccgcgaucccuucccccaguccaacgcuccuaucaucgacgaggaaagagagauucccgaacggucuuggaauagcggccacgagugggucacagauuuuaaagggaagaccgugugguucguuccuuccaucaaagcgggaaacgacauugccgcuugccuccgcaagaauggcaagaaagugauccaacugagcagaaagacguuugauucugaauacgucaaaacacggaccaacgacugggauuucguggugaccacagacauuuccgagaugggggccaauuuuaaggccgagagagucaucgauccgcgccgguguaugaaacccguuauccuuaccgacggagaagagagagugauucuggcuggcccuaugcccgugacacauagcucugccgcgcagcgccgggggagaaucggccgcaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgggagaaggucgacgccauugauggggaauacagacuccgcggagaggcuagaaaaacguuuguggaccuuaugcggcgcggcgaucugccuguuuggcuggccuauaagguggcggccgaggggaucaacuacgcugacagacggugguguuucgauggaaucaaaaacaaucagauucucgaagagaacgucgaaguggagaucuggacaaaggagggcgaacgcaaaaagcugaagcccagauggcuugacgcccggauuuauuccgauccucuggcucucaaagaguuuaaggaguucgccgcugggagaaaaucucugacccugaaucucaucacagagaugggccgccuucccaccuucaugacgcaaaagacccgggacgcccuggauaaccuggcgguucuccacacagccgaagcuggaggcagagccuacaaucaugcucugagcgagcuuccggagacccuggaaacacuccugcugcucacccuucuggccacagugaccgggggaauuuuucuguuccucauguccggccgcgggaucggaaaaaugacgcugggcaugugcugcaucauuacagccucuauccuucugugguaugcucagauucagccucacuggaucgcggccagcauuauccucgaguuuuuccugaucguccugcucauucccgaacccgagaagcagcggaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugagacccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaagccacccgcgaggcgcagaagagagccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcggacaaccugggcucuuugugaggcccugacacucgccaccggcccuauuucuacccugugggaagggaaccccggacgcuucuggaauacaacgaucgcggugagcauggcuaacauuuuuagaggcuccuaccuggccggggcuggacuccuuuucagcaucaugaaaaauaccacaaacacccggcgcggcacaggcaacaucggggagacccugggagagaaguggaaaucuagacugaaugcccucggcaaguccgaauuucaaauuuauaaaaagagcgggauccaggagguugaccggacgcuggccaaggaaggaauuaaacgcggcgagacagaucaccaugcugugucuagaggguccgccaaacuucggugguucgucgagagaaacauggugaccccggaaggaaaaguuguggaccugggcugcggccgcgggggauggagcuacuauuguggcgggcucaagaauguccgggaggugaaaggacugaccaagggcgggccuggacacgaagaacccauccccaugucuacauacggcuggaaccuggugagacuccagagcggcguugaugucuuuuucauuccucccgaaaagugcgacacccuucugugugauaucggggaguccucuccuaauccgacaguggaggcgggacgcacgcugcgggugcucaaccuggucgaaaauuggcuuaacaauaacacccaguucugcaucaaaguucugaaucccuacaugccuagcgugauugagaagauggaagcccuccaaagaaaauauggcggggcucuggugcgcaacccccugucccggaauagcacacaugagauguacugggucuccaacgccucuggaaauaucgugagcuccguuaacaugauuucuagaaugcucaucaaccgcuuuaccaugcggcacaagaaagcuacauaugaaccugacguggaccuuggcagcgggaccagaaauauuggaaucgaguccgagauucccaaccuggauaucaucggcaagcgcauugaaaagaucaaacaggagcaugaaacgucuuggcacuacgaccaggaucacccguauaagaccugggccuaccauggcagcuaugagacaaaacagaccggguccgcgagcucuauggucaauggagugguucggcugcucacaaagccuugggacgugcugcccaccgucacacaaauggccaugaccgauacgacaccuuucggccagcagagaguguuuaaagaaaagguggacacccgcacccaggagcccaaggaggggaccaagaaacuuaugaaaauuacggcugaauggcuguggaaggagcucggcaagaagaaaaccccuagaauguguacacgggaagaguucacccgcaaggucagauccaacgccgcucugggcgccaucuuuacagaugagaauaaguggaaaagcgcucgggaagccguugaggacucuagauucugggaacugguggauaaggagcggaaccuccaccuggaagggaaaugcgagaccuguguguacaauaugaugggaaagcgcgagaagaaacuuggcgaauuuggcaaagcgaaaggguccagagccauuugguacauguggcugggagcucgguuccucgaguuugaagcccugggcuuccuuaacgaggaccauugguuuagccgcgaaaauucucuguccggggucgagggagagggccuccacaagcugggguauauccugagagaugugagcaaaaaggaaggcggagcuauguacgccgacgacacagccggcugggauacccggaucacgcucgaggaccugaaaaacgaagagaugguuaccaaucacauggaaggggagcauaagaaacuugcggaggcuauuuucaaacugacauaucaaaacaaggugguccgcgugcagagacccaccccgcggggaacaguuauggauaucauuucccgcagagaccagcggggcagcgggcaagugggaaccuacggccucaauacguuuacaaacauggaagcccagcugauccgccagauggagggggaaggcgucuucaaaaauauucagcaccuuaccgugacagaggagguugccgugcauaacuggcuggcuagagucggacgggaacgccucucuagaauggccaucagcggcgaugacugcguggucaagccucuggaugaccgguucgcuaacgcccugaccgcgcucaaugauauggggaaaaucagaaaggacauucaacagugggagcccuccaagggauggaacgauuggacacaggugcccuuuugcucucaccauuuccacgaacugaucaugaaagacggccgcguucuuguggucccuugucggaaucaggaugagcugauugggagagcccgcaucagccaaggagcuggcuggucccuccgggaaaccgccugccuggggaagucuuaugcucagauguggagccuuauguacuuucacagacgcgaccugcggcucgccgcgaacgccauuuguuccgcugugccgucucauugggugcccacaagcagaaccacaugguccauccacgccaaacaugaguggaugaccacagaggacaugcugaccguuuggaaucgcguguggauucgggaaaacccuuggauggaggauaagacgcccgucgaaagcugggaggaaaucccuuaucugggcaaaagagaggaccaguggugcggaucucucaucggccugacaucccgcgcuaccugggccaagaauauucaggcugccaucaaccaagugcggagccuuauugggaaugaggaauacaccgauuacaugcccucuaugaagagauuccggagagaggaagaggaagcgggaguucugugguga

SEQ ID NO: 20126 - RNA, 9876 nt, Artificial Sequence
  derived and/or modified CDS sequence (opt5) from DENV-2__EU482776__SS-prME
agcgccggcaugaucauuaugcugauccccaccgucauggcuuuccaccugacaacgagaaauggggaaccucauaugauugucggaauccaggaaaagggcaagagccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuacaaaguucggccuacauucgcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaucagcuggcugucacaaucauggccauucucugcguuccuaacgcggugauccugcagaaugcuuggaaagccuccuguaccauucucgccguggucucugugagcccccugcuucugaccuccagccagcaaaagacagacuggaucccucucgcucugacgauuaaaggacugaaccccaccgccaucuuucuuacaacccugucuagaacaaauaagaaacgguccuggccgcucaacgaggcuaucauggccguuggcauggugagcauucuggcgucuucccuccugaagaaugacaucccuaugaccgggccccuugucgccggaggccugcugacggugugcuacguucucacaggccgcagcgcugaucuggaacuugagagagccaccgacgugaagugggaggaucaggcugaaauuucuggguccagcccuauccuguccauuaccaucagcgaggacggaucuaugagcauuaaaaacgaagaggaggaacagacacucaccauccugauccggacaggccuccuggucauuuccgggcuuuuccccaucucuauuccgaucacggccgccgcuugguaucugugggaggugaagaaacagcgcgcgggaguccugugggaugugccuucucccccucccaugggcaaggccgaacucgaggacggggcuuacagaauuaaacaaaagggaauccugggcuacucccagaucggcgccgggguuuauaaggaaggaaccuuucacacaauguggcaugugacccggggcgccguccuuaugcacaaagggaagcgcauugagcccuccugggcugaugugaaaaaggaccugaucagcuacggaggcggguggaaacucgagggagaauggaaggagggcgaagagguucaggugcuggcccucgaaccuggcaagaauccgagagcgguccagacaaaacccgggcuguucaagaccaacacgggaaccauuggcgcugugucccuugauuuuucuccugggacaagcggaucccccaucauugacaaaaagggcaaagugguugggcuguauggaaacggcgucgugacccggagcggcgccuacgugucugccaucgcucaaacagagaaguccaucgaggauaauccugaaauugaggacgauaucuuccgcaagagacggcugaccauuauggaccuccaccccggggccggaaaaacaaagagauaucugccugcgaucguccgcgaagcuauuaaacggggccuuagaacgcugauccucgccccgacccgcgugguugccgcugagauggaagaggcccugcgggggcuccccauuagauaccagaccccugcuauccgcgccgagcauaccggacgggaaaucguggaccugaugugucacgcgaccuuuacaaugagacuucugagccccguccgcgugccuaacuauaaucugauuaucauggaugaggcccauuucacggaccccgcuucuauugccgcucggggcuacaucuccaccagaguugaaaugggggaggccgccggcauuuucaugacagcuaccccgccuggaagccgggaucccuuuccccaguccaacgcgccuaucaucgacgaggaacgcgagauucccgaaagaucuuggaauagcggccacgagugggugacagauuucaaggggaaaaccgucugguuugugccuuccaucaaggccggaaacgacauugcugccugccuccggaagaauggcaaaaagguuauccaacugagccgcaaaacguucgauucugaauacgugaagacaagaaccaacgacugggauuuugucgugaccacagacauuuccgagaugggggccaauuucaaagcugagcgggugaucgauccgagacgcuguaugaagcccgucauccuuaccgacggagaggaacggguuauucuggccggcccuaugcccgugacacauagcucugcggcucagagacgcgggcggaucggcagaaacccuaaaaaugaaaacgaccaguauauuuacaugggagagccccucgaaaaugaugaggacugcgcccacuggaaggaggccaagaugcugcuggauaacaucaauaccccggaaggcauuaucccuagcauguuugagcccgaacgcgagaaaguggacgcuauugauggggaauaucggcucagaggagaggcccgcaagacguucgucgaccuuaugagacggggcgaucugccuguguggcuggcguacaaaguugccgcugaggggaucaacuaugccgaccgcagaugguguuuugauggaaucaagaacaaucagauucucgaagagaacauggaaguggagaucuggacaaaagagggcgaacggaagaagcugaaaccccgcuggcuugacgcuagaauuuacuccgauccucuggcccucaaggaguucaaagaauuugcugccgggcggaagucucugacccugaaucucaucacagagaugggcagacuucccaccuucaugacgcagaagacccgcgacgcgcuggauaaccuggccguccuccacacagcugaagccggaggccgggcuuauaaucaugcccugagcgagcuuccggagacccuggaaacacuccugcugcucacccuucuggccacagugaccgggggaauuuuccuguuucucauguccggcagagggaucggaaagaugacgcugggcaugugcugcaucauuacagcuucuauccuucugugguacgcgcagauucagccucacuggaucgccgcuagcauuauccucgaguucuuucugaucguucugcucauucccgaacccgagaagcagcgcaccccucaagacaaccagcuuaccuacguggucaucgccauucugacaguggucgccgcuaccauggccaaugaaaugggcuuccuggagaaaacaaagaaagaccucgggcugggauccaucgcgacgcagcagccggagagcaacauucuugauaucgaccugcggcccgccucugcuuggacccucuaugccguggcuacaaccuuuguuacaccuaugcugagacauuccauugaaaauagcuccgugaacgugucucugaccgccaucgcgaaucaagccacgguccucaugggccuugggaagggauggccccugagcaaaauggauaucggcguuccucugcucgcuauuggguguuacucccaggugaaccccaucacccugacagccgcccuucugcuccugguggcccacuaugcuauuaucggaccuggccugcaggccaaggcgacccgggaggcccagaagcgcgcugccgcuggcauuaugaaaaauccgacagucgacgggaucaccgugaucgaucucgaccccauuccuuacgaucccaaguucgaaaaacaacuuggacagguuaugcugcugauccucugcgugacgcagguccugaugaugagaacaaccugggcccuuugugaggcccugacacucgcgaccggcccuauuucuacccugugggaagggaaccccggacgguuuuggaauacaacgaucgcugugagcauggccaacauuuuccgcggcuccuaucuggcuggggccggacuccuuuuuagcaucaugaagaauaccacaaacaccagacggggcacaggcaacaucggggagacccugggagagaaauggaagucucgccugaaugcccucggcaaauccgaguuccaaauuuacaaaaagagcgggauccaggaggucgacagaacgcuggcuaaagaaggaauuaagcggggcgagacagaucaccaugccgugucucgcggguccgcgaaacuuagaugguuuguugagcggaacauggugaccccggaaggaaaggucguggaccugggcugcggcagagggggauggagcuauuacuguggcgggcucaaaaauguucgcgaggugaagggacugaccaagggcgggccuggacacgaagaacccauccccaugucuacauacggcuggaaccugguccggcuccagagcggcguggauguguucuuuauuccucccgaaaaaugcgacacccuucugugugauaucggggaguccucuccuaauccgacaguugaggccggaagaacgcugcgcauccucaaccuggucgaaaauuggcuuaacaauaacacccaguucugcauuaaggugcugaaucccuauaugccuagcgugaucgagaaaauggaagcucuccaacggaaguacggcggggcccuggucagaaacccccugucccgcaauagcacacaugagauguauuggguuuccaacgcuucuggaaauauugugagcuccgugaacaugaucucucggaugcucauuaacagauucaccaugcgccacaaaaaggccacauacgaaccugacgucgaccuuggcagcgggacccggaauaucggaauugaguccgagauccccaaccuggauaucauuggcaagagaaucgagaagauuaagcaggagcaugaagcgucuuggcacuaugaccaggaucacccguacaaaacgugggccuaucauggcagcuacgagaccaagcagacaggguccgcuagcucuauggugaauggaguugugcgccugcucaccaaaccuugggacguccugcccacagugacccaaauggccaugacagauaccacgccuuuuggccagcagcggguuuucaaggaaaagguggacacaagaacccaggagcccaaagaggggaccaagaaacuuaugaagaucacagcugaauggcuguggaaagagcucggaaagaaaaagacgccucgcauguguaccagagaagaguuuacacggaagguccgcuccaacgccgcucugggcgccauuuucaccgaugagaauaaauggaaaagcgcgagagaagccguggaggacucucgguuuugggaacugguggauaaagagagaaaccuccaccuggaagggaagugcgagacaugugucuacaauaugaugggaaaacgggagaagaaacuuggcgaguucggcaaagcuaaggggucccgcgccaucugguauauguggcugggagcuagauuucucgaguucgaagcccugggcuuucuuaacgaggaccauugguucagccgggaaaauucucuguccgggguugagggagagggccuccacaaacugggguacauccugcgcgaugugagcaagaaagaaggcggagccauguaugcggacgacaccgcuggcugggauacaagaauuacccucgaggaccugaagaacgaagagauggugacgaaucacauggaaggggagcauaagaaacuugccgaggccaucuuuaagcugaccuaccaaaacaaagucgugcggguucagcgccccacaccgagaggaaccgugauggauauuaucucccggcgcgaccagagaggcagcgggcaagucggaacauauggccucaauaccuucacgaacauggaagcucagcugauucggcagauggagggggaaggcguguuuaagaauauccagcaccuuacaguuaccgaggagguggccguccauaacuggcuggcucgcgugggaugcgaaagacucucucggauggccaucagcggcgaugacugcguugugaaaccucuggaugaccgcuucgcgaacgcccugacagcucucaaugauauggggaagauuagaaaggacauccaacagugggagcccuccaaaggauggaacgauuggacccagguccccuucuguucucaccauuuucacgaacugauuaugaaggacggccgggugcuugucgugccuugcagaaaucaggaugagcugaucgggcgcgcccggauuagccaaggagcuggcuggucccucagagaaacggccugucuggggaaaucuuacgcgcagauguggagccuuauguauuuccaccgccgggaccugagacucgccgcuaacgccaucugcuccgcuguuccgucucauugggugcccaccagccgcacaaccugguccauucacgccaagcaugaguggaugacaaccgaggacaugcugacagucuggaaucggguguggauccuggaaaacccuuggauggaggauaaaacccccguggaaagcugggaggaaaucccuuaccucggcaagagagaggaccagugguguggaucucugauuggccuuacgucccgcgcuacaugggccaagaauauccaggcggccauuaaccaaguucggagccugaucgggaaugaggaauacaccgauuauaugcccucuaugaaaagauuucgccgggaggaagaggaagcuggagugcucugguga

SEQ ID NO: 20127 - RNA, 9876 nt, Artificial Sequence
  derived and/or modified CDS sequence (opt5) from DENV-2__EU482777__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaaacgggccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaaaaauaccacaaacacccgcagaggcacaggcaacaugggggagacccugggagagaaguggaaaucucggcugaaugcccucggcaaguccgaauuucaaaucuauaagaaaagcgggauucaggagguugaccgcacgcuggccaaggaaggaaucaaaagaggcgagacagaucaccaugcugugucucggggguccgccaaacuucgcugguucgucgagagaaacauggugaccccggaaggaaaaguuguggaccugggcugcggcagagggggauggagcuacuauuguggcgggcucaagaauguccgggaggugaagggacugaccaaaggcgggccuggacacgaagaacccauucccaugucuacauacggcuggaaccuggugcgccuccagagcggcguugaugucuuuuucaucccucccgaaaagugcgacacccuucugugugauauuggggaguccucuccuaauccgacaguggaggcgggacggacgcugagagugcucaaccuggucgaaaauuggcuuaacaauaacacccaguucugcaucaaaguucugaaucccuacaugccuagcgugaucgagaagauggaagcccuccaacgcaaauauggcggggcucuggugcggaacccccuguccagaaauagcacacaugagauguacugggucuccaacgccucuggaaauauugugagcuccguuaacaugaucucucgcaugcucauuaaccgguuuaccaugagacacaagaaggcuacauaugaaccugacguggaccuuggcagcgggacccgcaauaucggaauugaguccgagauccccaaccuggauauuaucggcaaacggaucgaaaagauuaaacaggagcaugaaacgucuuggcacuacgaccaggaucacccguauaagaccugggccuaccauggcagcuaugagacaaaacagaccggguccgcgagcucuauggucaauggagugguuagacugcucacaaagccuugggacgugcugcccaccgucacacaaauggccaugaccgauacgacaccuuucggccagcagcgcguguuuaaggaaaaaguggacacccggacccaggagcccaaggaggggaccaagaaacuuaugaaaaucacggcugaauggcuguggaaggagcucggcaaaaagaagaccccuagaauguguacacgcgaagaguucaccagaaaaguccgguccaacgccgcucugggcgccauuuuuacagaugagaauaaguggaaaagcgcucgcgaagccguugaggacucuagauucugggaacugguggauaaggagcggaaccuccaccuggaagggaaaugcgagaccuguguguacaauaugaugggaaagagagagaagaaacuuggcgaauuuggcaaggcgaaagggucccgggccaucugguacauguggcugggagcucgcuuccucgaguuugaagcccugggcuuccuuaacgaggaccauugguuuagcagagaaaauucucuguccggggucgagggagagggccuccacaagcugggguauauucugcgggaugugagcaaaaaggaaggcggagcuauguacgccgacgacacagccggcugggauacccgcaucacgcucgaggaccugaagaacgaagagaugguuaccaaucacauggaaggggagcauaagaaacuugcggaggcuaucuucaaacugacauaucaaaacaaaguggucagagugcagcggcccaccccgcgcggaacaguuauggauauuaucuccagacgggaccagcgcggcagcgggcaagugggaaccuacggccucaauacguuuacaaacauggaagcccagcugauuagacagauggagggggaaggcgucuucaaaaauauccagcaccuuaccgugacagaggagguugccgugcaaaacuggcuggcucgggucggacgcgaaagacucucucggauggccauuagcggcgaugacugcguggucaagccucuggaugaccgcuucgcuaacgcccugaccgcgcucaaugauauggggaagaucagaaaagacauccagcagugggagcccuccaagggauggaacgauuggacacaggugcccuuuugcucucaucacuuccaugaacugauuaugaaagacggccggguucuuguggucccuuguagaaaucaagaugagcugaucgggcgcgcccggauuagccagggagcuggcuggucccucagagaaaccgccugccuggggaagucuuaugcucagauguggagccuuauguacuuucaccgccgggaccugagacucgccgcgaacgccaucuguuccgcugugccgucucacugggugcccacaagccgcaccacaugguccauucaugccaaacacgaguggaugaccacagaggacaugcugaccguuuggaaucggguguggaucagagaaaacccuuggauggaggauaagacgcccgucgaaagcugggaggaaauuccuuaucugggcaagcgcgaggaccaguggugcggaucucucaucggccugacaucccgggcuaccugggccaaaaauauccaagcugccauuaaccaggugagaagccuuaucgggaaugaggaauacaccgauuacaugcccucuaugaagcgcuuccggagagaggaagaggaagcgggaguucugugguga

SEQ ID NO: 20128 - RNA, 9876 nt, Artificial Sequence
  derived and/or modified CDS sequence (opt5) from DENV-2__EU482778__SS-prME
accgccggcgugaucauuaugcugauccccaccgcuauggccuuccaccucacgacccggaacggggagccucauaugauugucggacggcaggaaaagggcaagagccugcuuuuuaagacagaggacgggguuaauaugugcacccugauggcgaucgaucucggagaacugugugaggacacaauuaccuacaaaugcccccuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaggaacaggacaaacgcuuugugugcaagcauuccaugguggauagaggcuggggcaacggguguggacuguucggcaaagggggcaucguuaccugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaaaauugccacuggcccaagucccauacccuguggagcaacggggugcuggaaucugagaugaucauucccaagagcuucgccggaccuguuucccagcacaacuaccgccccggcuauuacacgcaaacagccgggcccuggcaucuuggaaagcucgaaauggauuuugacuucugugagggcaccaccguggucgugacagaagauugcgggaaucggggaccuagccugagaaccacgacagcuucuggcaaacugaucaccgaguggugcugucgguccugcacacucccgccccugcgcuacagaggcgaggacggguguugguauggaauggaaauucggccucuuaaggagaaggaagagaaccuggugaauagccucgucaccgcgggccacgggcagaucgauaacuuuucccugggaguucugggcauggcccuuuuccucgaagagaugcugagaacacgcguggggaccaaacaugcuauccugcucguggccgucucuuuugugacgcugauuaccggaaauaugagcuuccgggaccuuggcagaguuauggugauggucggcgccgcuaugacagaugacaucgggauuggagugaccuaccuggcccuccuggcggcuuuuaagguucgccccacauucgccgccggccugcuucugagaaaacucaccuccaaggagcugaugauggcuacgaucgggauugcccuccugucucagagcacaaucccugaaaccauccuugagcugacagaugcgcucgcucugggaaugauggugcugaaaauuguccggaacauggaaaaguaucaacuugccgugaccaucauggccauuuccugcguucccaaugcugugauccugcagaacgccuggaaggucucuuguaccauucucgcuacagugagcguguccccucugcuccugacgagcucucagcagaaagccgacuggaucccccuugcgcugaccaucaagggccucaauccgacagccauuuuucugaccacacugucccgcaccagcaaaaagagaucuuggccucuuaacgaggcuaucauggccgucgggaugguuuccauucuggcuagcucucuccugaaaaaugacauccccaugacgggaccucucguggccggcggccugcuuacagugugcuacguccugaccgggcgguccgccgaucuggaacucgagcgcgcuaccgacgugaagugggaggaucaagcggaaauuagcggauccagccccauccugucuauuacaaucgccgaggacggcagcauguccaucaaaaacgaagaggaggaacagacccuuacaauucugaucagaacggggcuccugguuauuucuggacucuucccggugagcaucccuauuaccgcugccgccugguaucugugggaggucaagaagcagcgggcuggcgugcuuugggauguucccuccccuccgcccguggggaaagccgaacuggaggacggagcguaccgcaucaagcagaaaggcauccugggcuauucucaaauuggggcuggagucuacaaggaaggcacauuucacaccauguggcacgugacaagaggggccguccucaugcaucggggaaaacgcaucgagccuagcugggccgaugugaagaaggaccugauuuccuacggcgggggauggaaacuugagggcgaauggaaggagggcgaagagguucaggugcuggcucucgaaccggggaaaaaucccagagccguccagaccaagccuggacuguucaaaacgaacaccggcacaaucggggcggugucucucgauuuuagccccggaaccuccggcagcccuauuguugacaagaaggggaaaguggucggacuguauggcaauggcguggugacacggucuggggcuuacguuuccgccaucgcccagaccgaaaagagcaucgaggauaaccccgaaauugaggacgauaucuuccgcaagaagcgccuuacaauuauggaccugcacccuggagcuggcaaaacgaagcgguaucugccggccaucgucagagaagcuauuaagcgcgggcuccggacccugauccuugcccccacaagagugguggcggccgagauggaagaggcucugcgcggacucccuauucgguaccaaacccccgccaucagagcugagcauaccggccgcgaaaucgucgaccugaugugucacgccacauucacgaugcggcuccugucuccugugagaguucccaacuauaaucuuauuaucauggaugaggcccauuuuaccgacccggcuuccauugcggcccggggguacaucagcacacgcguggaaaugggcgaggcugccggaauuuucaugaccgccacaccucccggcuccagagaucccuuuccucagucuaacgcucccaucauggacgaggaacgggagaucccugaacgcagcuggaacuccgggcacgagugggucaccgauuucaaaggaaagacggugugguuuguuccgagcauuaaagccggcaaugacaucgcggcuugccugagaaagaaugggaaaaaggugauucagcugucucggaagacauucgauuccgaauaugucaaaaccagaaccaacgacugggauuuugugguuacaaccgacaucagcgagaugggagccaauuucaaggccgagcgcgugauugauccccggagauguaugaaaccugucauccucacagacggcgaggagagagugauccuggcugggcccaugccugugacccacucuagcgccgcgcaacggagaggccgcauuggacggaaccccaagaaugaaaacgaccaguacaucuacaugggcgagccgcuugaaaaugaugaggacugcgcccauuggaaagaggcuaagaugcugcucgauaacauuaauacgccugaagggaucauucccuccauguuugagccugaaagagagaaagucgacgccaucgauggagaauaucgccugagaggcgaggcucggaagacauucguugaccugaugcgcagaggggaucuccccguguggcuugccuaccggguggcugccgagggaauuaacuaugcggaccgcagaugguguuuugauggcgucaagaauaaccagauccuggaagagaacguggaaguugagaucuggaccaaagagggggaacggaagaaacugaagccuagauggcucgacgcccgcauuuacucugauccccuggcucuuaaagaguucaaggaguucgccgcuggcagaaagagccugacacucaaucugaucaccgagaugggaagacugccgacguuuaugacccagaaagcccgcgacgcccucgauaaccuugcugugcugcacacagcggaagccggcgggcgggcuuauaaucaugcccuguccgagcucccugagacccuggaaacacuucugcuccugacccugcucgccacagucaccggaggcauuuuccuuuuucugaugucugggaagggagugggcaaaaugacgcugggcaugugcugcaucauuacagcuagcauccuccuguggcacgcccaaauccagccccacuggauugcggccuccaucauucuugaguucuuucugaucguucuccugauucccgaaccugagaagcagagaaccccgcaggacaaccaacugaccuacguggucaucgcuauccucacaguggucgccgcuaccauggccaaugaaaugggguuccuugagaaaacaaagaaggaccugggacugggcagcauugcgacgcaggagcccgaaucuaacauccucgauauugaccugcggccugccuccgcuuggacccuuuaugccguggcuacaaccuuuguuacacccaugcugcgccauagcaucgaaaauuccucugugaacgugagccucaccgccauugcuaaucaggccacgguccugauggggcugggaaaaggcuggccucucuccaagauggauaucgggguuccccuucuggcgauuggauguuacucucaggugaacccuaucacccugacagccgcucuccugcuucugguggcccacuacgcuaucauuggcccgggccuccaagccaaagccaccagagaagcgcagaagcgggcugccgcugggaucaugaaaaaucccacagucgacggaauuaccgugaucgaucuggacccuauucccuaugauccuaaguucgagaagcagcugggccagguuaugcuccuuauccugugcgugacgcaaguccugaugaugcgcacaaccugggcccucugugaagcccugacacuugcuaccgggcccaucagcacccugugggagggaaacccgggcagauuuuggaauacaacgauugccguguccauggcgaacaucuuccgggggagcuaccucgccggagcuggccugcuguuuucuauuaugaaaaauaccacaaacacccgcagaggcacagggaauaucggagagacccucggcgaaaaguggaaaucccggcuuaacgcccugggaaagagcgaguuccagauuuauaaaaagucuggaauccaggaagucgaccgcacgcuggcuaaagagggcaucaagagaggggagacagaucaucacgccgugucccggggaagcgcgaagcucagaugguuuguugaacgcaacauggugaccccugagggcaaagucguggaccugggcugcgggcggggaggcuggucuuacuauugugggggacuuaagaauguuagagaagugaaaggccugaccaaaggcgggcccgggcaugaggaacccgucccuaugagcacauacggcuggaaccucgugcgccugcaauccgggguggauguuuucuucaccccgccugagaaaugcgacacacugcucugugauauuggagagucuagcccgaaucccacgaucgaagccggccggacccuuagaguccugucccugguggagaacuggcucaauaacgacacacaguuuugcauuaaggugcugaauccuuauaugcccagcgucaucgaaaagauggagacccuucagcgcaaauacgggggagcucugguucggaacccucucuccagaaauucuacacacgaaauguacugggugagcaacgccaccggcaauauuguguccucugucaacaugaucagccgcaugcugaucaaucgguucacgaugaagcacaaaaaggcuaccuaugagcccgacguggaucugggguccggaacaagaaacauuggcaucgagucugaaauuccgaaucucgacaucauuggcaaacgcaucgagaagauuaagcaggaacaugagaccagcuggcacuacgaucaagaccauccuuauaaaacaugggccuaccacggguccuaugaaaccaagcagacaggaagcgcuucuuccaugguuaacggcgugguccggcuucugaccaaacccugggaugugguuccuauggugacgcagauggccaugacagacaccacccccuuugggcagcaaagagucuucaaggagaaaguggauacacgcacgcaggagccuaaggaaggaaccaagaaacugaugaagaucacagcggaguggcucuggaaagaacugggcaagaaaaagacccccagaauguguacacgggaggaguuuacccgcaaagugagaagcaacgccgcucuuggggccaucuucacagacgaaaauaaguggaagucugcucgggaggccgucgaagauuccagauuuugggagcugguugacaaagaacggaaccuccaccuggagggaaagugcgagaccuguguguacaauaugaugggcaaacgcgaaaagaaacugggcgaguucgggaaggccaagggaagcagagcgauuugguauauguggcucggcgcucgguuucuggaguucgaggcccuuggguuucugaacgaagaucauugguucucucgcgaaaauucccucagcggaguggagggcgaagggcugcacaaacuuggcuacauccugagagacgucuccaagaaagagggaggcgccauguacgcugacgauacggccgggugggacacccggauuacacucgaagaucugaagaacgaggaaauggugaccaaucauauggagggagagcacaaaaagcuggcugaagccaucuuuaagcucacauaucagaacaaaguugugcgcguccagagaccgaccccucggggcacggugauggacauuaucagccgcagagaucaacgggggucuggacagguuggcacauacgggcugaauaccuucacaaacauggaggcgcagcuuauccgccaaauggaaggcgagggaauuuucaagagcauccagcaucugaccgugacggaggaaauugccguccagaauuggcucgcuagagugggccgggagcgccuguccagaauggccaucucuggggacgauugcguugugaaaccccuugacgaucgguuugcuagcgcccugaccgcgcucaacgacaugggaaaggucagaaaagauauucagcaaugggaacccucccgcggcuggaaugacuggacacaggugccuuucugcucucaccacuuucaugagcugaucaugaaggaugggcggguccuggugguuccguguagaaaccaggacgaacucaucggacgcgcccggauuagccagggcgcuggguggucccugaaggagaccgccugccuuggcaaaucuuaugcucaaauguggagccugauguacuuccacagacgcgaccuccggcuggccgcuaaugccaucuguuccgcggugcccagccauugggucccuacaucuagaaccacaugguccauucacgccaagcacgaguggaugaccacggaagauaugcuuacaguguggaaccgcguguggauccaggagaaccccuggauggaagacaaaaccccuguugagagcugggaagaggugcccuaucugggaaagcgggaggaucaguggugcggcucucucauugggcugaccuccagagcuacaugggccaaaaauauccagaccgccauuaaccaaguccgcagccugaucggaaaugaagaguacacagacuauaugccuuccaugaagcgguuuagacgggaagaggaagaggcuggcgugcucugguga

SEQ ID NO: 20129 - RNA, 9876 nt, Artificial Sequence
  derived and/or modified CDS sequence (opt5) from DENV-2__EU482779__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgaauaccggcacaauuggggcggugagccucgauuuuucccccggaaccagcggcucuccuaucguugaccggaaggggaagguggucggacuguauggcaacggcguggugacaagauccggggcuuacguuagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccuguccccugugcggguucccaacuauaaccuuaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccugcggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucucacagacggcgaagaacgggugauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaaggucgacgccauugauggagaauauagacugcggggcgaggcucgcaaaacauucguugaccugaugagaagaggggaucuccccguguggcuugccuaccgcguggcugccgagggaaucaauuaugcggacagacggugguguuuugauggcgucaagaacaaucagauucuggaagagaacguggaaguugagaucuggaccaaggagggggaacgcaagaagcugaaaccucgcuggcucgacgcccggaucuacagcgauccccuggcucuuaaggaguucaaagaguucgccgcuggcagaaagucccugacacucaaccugauuaccgagaugggacgccugccgacguuuaugacccagaaggcccgggacgcccucgauaaucuugcugugcugcacacagcggaagccggcgggagagcuuauaaccaugcccugucugagcucccugagacccuggaaacacuucugcuccugacccugcucgccacagucaccggaggcaucuuccuuuuucugaugagcgggaaaggagugggcaagaugacgcugggcaugugcugcauuaucacagcuuccauucuccugugguacgcccaaauccagccccacuggaucgcggccagcauuauccuugaguucuuucugauuguucuccugauccccgaaccugagaaacagcggaccccgcaggacaaucaacugaccuauguggucauugcuauccucacaguggucgccgcuaccauggccaacgaaaugggguuccuugagaagaccaagaaggaccugggacugggcucuaucgcgacgcaggagcccgaauccaauauucucgauaucgaccugcgcccugccagcgcuuggacccuuuacgccguggcuacaaccuuuguuacacccaugcugagacacuccauugagaacucuagcgugaaugugucccucaccgccaucgcuaaccaggccacgguccugauggggcugggaaagggcuggccucucucuaaaauggauauugggguuccccuucuggcgaucggauguuacagccaggugaauccuauuacccugacagccgcucuccugcuucugguggcccauuaugcuaucaucggcccgggccuccaagccaaggccacccgggaagcgcagaaacgcgcugccgcugggauuaugaagaaccccacagucgacggagugaccguuaucgaucuggacccuauucccuacgauccuaaauucgagaagcagcugggccaggugaugcuccuuauccugugcgucacgcaagugcugaugaugagaacaaccugggcccucugugaagcccugacacuugcuaccgggcccauuuccacccugugggagggaaauccgggccgguuuuggaacacaacgaucgccgucagcauggcgaauaucuuccgcgggucuuaucucgccggagcuggccugcuguuuuccauuaugaagaacaccacaaauaccagacggggcacagggaacaucggagagacccucggcgaaaaauggaaaagccgccuuaaugcccuggggaaaucugaguuccagauuuacaagaaauccggaauccaggaaguggacagaacgcuggcuaaggagggcauuaaaagaggggaaacagaucaccaugccguuagcagaggaucugcgaagcuccgcugguuuguggaacggaacauggucaccccugagggcaaggugguugaccugggcugcgggagaggaggcuggagcuauuacugugggggacuuaaagaugugcgcgaagucaagggccugaccaaagggggacccggccacgaggaacccaucccuauguccacauauggcuggaaccucgugcggcugcaaucugggguggacguuuucuucacacccccugagaagugcgauacccugcucugugacaucggagagagcuccccgaaucccacgauugaagccggcagaacccuucgcguccugagccugguggagaacuggcucaauaacgacacacaguuuugcaucaaagugcugaauccuuacaugcccuccgucauugaaaagauggagacccuucagcggaaguacgggggagcucugguuagaaacccucucucucgcaauagcacacaugaaauguauuggguguccaacgccaccggcaauaucgugucuagcgucaacaugauuucccggaugcugaucaauagauucacgaugaaacacaagaaagcuaccuacgagcccgauguggaccuggggucuggaacacgcaacaucggcauugagagcgaaaucccgaaucucgauauuaucggcaagcggauugagaaaaucaagcaggaacacgagaccuccuggcauuaugaccaagaucacccuuacaagacaugggccuaucaugggagcuacgaaaccaaacagacaggaucugcuuccagcaugguuaacggcguggucagacuucugaccaagcccugggacgugguuccuauggugacgcagauggccaugacagauaccacccccuuugggcagcaacgcgucuucaaagagaagguggacacaagaacgcaggagccuaaagaaggaaccaagaagcugaugaaaauuacagcggaguggcucuggaaggaacugggcaaaaagaaaacaccccggauguguacacgcgaggaguuuaccagaaaggugcggucuaaugccgcucuuggggccaucuucacagaugaaaacaaauggaaguccgcuagagaggccgucgaagacagccgguuuugggagcugguugauaaggaacgcaaccuccaccuggagggaaaaugcgagaccuguguguauaauaugaugggcaagagagagaagaagcugggcgaguucgggaaagccaagggaucucgggcgaucugguacauguggcucggcgcucgcuuucuggaguucgaggcccuuggguuucugaacgaagaccacugguucuccagagagaauagccucuccggaguggagggcgaagggcugcauaaacuuggcuacauucugcgggacgucagcaaaaaggagggaggcgccauguaugcugaugacacggccgggugggauacccgcaucacacucgaagaccugaaaaacgaggaaauggugaccaaucacauggagggagagcauaagaaacuggcugaagccauuuuuaagcucacauaccagaacaagguugugagaguccagcggccgaccccucgcggcacggugauggauaucauuucuagacgggaccaacgcgggagcggacagguuggcacauaugggcugaauaccuucacaaacauggaggcgcagcuuaucagacaaauggaaggcgagggaguguucaaauccauccagcggcugaccgucacggaggaaauugccgugcagaauuggcucgcucgcguuggcagagagcggcugucuagaauggccaucagcggggaugacugcguggucaagccccuugaugaccgcuuugcuuccgcccugaccgcgcucaacgauaugggaaaagugcggaaggacauucagcaaugggaacccucuagaggcuggaaugauuggacacaggucccuuucugcagccaccauuuucacgagcugaucaugaaagacgggcgcgugcugguugugccgugucggaaccaggacgaacucauuggacgggcccgcaucucccagggcgcuggguggucucugaaggagaccgccugccuuggcaagagcuacgcucaaauguggucccugauguauuuccaccggagagaucuccgccuggccgcuaaugccaucuguagcgcgguccccucucauugggugccuacaucccggaccacauggagcauucacgccaaacaugaguggaugaccacggaagacaugcuuacaguguggaacagaguuuggauccaggagaaucccuggauggaagauaagaccccuguggagucuugggaagagguccccuaccugggaaaacgcgaggaccaguggugcggcucccucauugggcugaccagccgggcuacaugggccaagaacauccagaccgccauuaaccaagugagaucccugaucggaaaugaagaguauacagauuacaugccuucuaugaaacgguuuagacgcgaagaggaagaggcuggcguucucugguga

SEQ ID NO: 20130 - RNA, 9876 nt, Artificial Sequence
  derived and/or modified CDS sequence (opt5) from DENV-2__EU482780__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgaauaccggcacaauuggggcggugagccucgauuuuucccccggaaccagcggcucuccuaucguugaccggaaggggaagguggucggacuguauggcaacggcguggugacaagauccggggcuuacguuagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccuguccccugugcggguucccaacuauaaccuuaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccugcggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucucacagacggcgaagaacgggugauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaaggucgacgccauugauggagaauauagacugcggggcgaggcucgcaaaacauucguugaccugaugagaagaggggaucuccccguguggcuugccuaccgcguggcugccgagggaaucaauuaugcggacagacggugguguuuugauggcgucaagaacaaucagauucuggaagagaacguggaaguugagaucuggaccaaggagggggaacgcaagaagcugaaaccucgcuggcucgacgcccggaucuacagcgauccccuggcucuuaaggaguucaaagaguucgccgcuggcagaaagucccugacacucaaccugauuaccgagaugggacgccugccgacguuuaugacccagaaggcccgggacgcccucgauaaucuugcugugcugcacacagcggaagccggcgggagagcuuauaaccaugcccugucugagcucccugagacccuggaaacacuucugcuccugacccugcucgccacagucaccggaggcaucuuccuuuuucugaugagcgggaaaggagugggcaagaugacgcugggcaugugcugcauuaucacagcuuccauucuccugugguacgcccaaauccagccccacuggaucgcggccagcauuauccuugaguucuuucugauuguucuccugauccccgaaccugagaaacagcggaccccgcaggacaaucaacugaccuauguggucauugcuauccucacaguggucgccgcuaccauggccaacgaaaugggguuccuugagaagaccaagaaggaccugggacugggcucuaucgcgacgcaggagcccgaauccaauauucucgauaucgaccugcgcccugccagcgcuuggacccuuuacgccguggcuacaaccuuuguuacacccaugcugagacacuccauugagaacucuagcgugaaugugucccucaccgccaucgcuaaccaggccacgguccugauggggcugggaaagggcuggccucucucuaaaauggauauugggguuccccuucuggcgaucggauguuacagccaggugaauccuauuacccugacagccgcucuccugcuucugguggcccauuaugcuaucaucggcccgggccuccaagccaaggccacccgggaagcgcagaaacgcgcugccgcugggauuaugaagaaccccacagucgacggagugaccguuaucgaucuggacccuauucccuacgauccuaaauucgagaagcagcugggccaggugaugcuccuuauccugugcgucacgcaagugcugaugaugagaacaaccugggcccucugugaagcccugacacuugcuaccgggcccauuuccacccugugggagggaaauccgggccgguuuuggaacacaacgaucgccgucagcauggcgaauaucuuccgcgggucuuaucucgccggagcuggccugcuguuuuccauuaugaagaacaccacaaauaccagacggggcacagggaacaucggagagacccucggcgaaaaauggaaaagccgccuuaaugcccuggggaaaucugaguuccagauuuacaagaaauccggaauccaggaaguggacagaacgcuggcuaaggagggcauuaaaagaggggaaacagaucaccaugccguuagcagaggaucugcgaagcuccgcugguuuguggaacggaacauggucaccccugagggcaaggugguugaccugggcugcgggagaggaggcuggagcuauuacugugggggacuuaaagaugugcgcgaagucaagggccugaccaaagggggacccggccacgaggaacccaucccuauguccacauauggcuggaaccucgugcggcugcaaucugggguggacguuuucuucacacccccugagaagugcgauacccugcucugugacaucggagagagcuccccgaaucccacgauugaagccggcagaacccuucgcguccugagccugguggagaacuggcucaauaacgacacacaguuuugcaucaaagugcugaauccuuacaugcccuccgucauugaaaagauggagacccuucagcggaaguacgggggagcucugguuagaaacccucucucucgcaauagcacacaugaaauguauuggguguccaacgccaccggcaauaucgugucuagcgucaacaugauuucccggaugcugaucaauagauucacgaugaaacacaagaaagcuaccuacgagcccgauguggaccuggggucuggaacacgcaacaucggcauugagagcgaaaucccgaaucucgauauuaucggcaagcggauugagaaaaucaagcaggaacacgagaccuccuggcauuaugaccaagaucacccuuacaagacaugggccuaucaugggagcuacgaaaccaaacagacaggaucugcuuccagcaugguuaacggcguggucagacuucugaccaagcccugggacgugguuccuauggugacgcagauggccaugacagauaccacccccuuugggcagcaacgcgucuucaaagagaagguggacacaagaacgcaggagccuaaagaaggaaccaagaagcugaugaaaauuacagcggaguggcucuggaaggaacugggcaaaaagaaaacaccccggauguguacacgcgaggaguuuaccagaaaggugcggucuaaugccgcucuuggggccaucuucacagaugaaaacaaauggaaguccgcuagagaggccgucgaagacagccgguuuugggagcugguugauaaggaacgcaaccuccaccuggagggaaaaugcgagaccuguguguauaauaugaugggcaagagagagaagaagcugggcgaguucgggaaagccaagggaucucgggcgaucugguacauguggcucggcgcucgcuuucuggaguucgaggcccuuggguuucugaacgaagaccacugguucuccagagagaauagccucuccggaguggagggcgaagggcugcauaaacuuggcuacauucugcgggacgucagcaaaaaggagggaggcgccauguaugcugaugacacggccgggugggauacccgcaucacacucgaagaccugaaaaacgaggaaauggugaccaaucacauggagggagagcauaagaaacuggcugaagccauuuuuaagcucacauaccagaacaagguugugagaguccagcggccgaccccucgcggcacggugauggauaucauuucuagacgggaccaacgcgggagcggacagguuggcacauaugggcugaauaccuucacaaacauggaggcgcagcuuaucagacaaauggaaggcgagggaguguucaaauccauccagcggcugaccgucacggaggaaauugccgugcagaauuggcucgcucgcguuggcagagagcggcugucuagaauggccaucagcggggaugacugcguggucaagccccuugaugaccgcuuugcuuccgcccugaccgcgcucaacgauaugggaaaagugcggaaggacauucagcaaugggaacccucuagaggcuggaaugauuggacacaggucccuuucugcagccaccauuuucacgagcugaucaugaaagacgggcgcaugcuggugguuccgugucggaaccaggacgaacucauuggacgggcccgcaucucccagggcgcuggguggucucugaaggagaccgccugccuuggcaagagcuacgcucaaauguggucccugauguauuuccaccggagagaucuccgccuggccgcuaaugccaucuguagcgcggugcccucucauugggucccuacaucccggaccacauggagcauucacgccaaacaugaguggaugaccacggaagacaugcuuacaguguggaacagaguguggauccaggagaaucccuggauggaagauaagaccccuguugagucuugggaagaggugcccuaccugggaaaacgcgaggaccaguggugcggcucccucauugggcugaccagccgggcuacaugggccaagaacauccagaccgccauuaaccaagucagaucccugaucggaaaugaagaguauacagauuacaugccuucuaugaaacgguuuagacgcgaagaggaagaggcuggcgugcucugguga

SEQ ID NO: 20131 - RNA, 9876 nt, Artificial Sequence
  derived and/or modified CDS sequence (opt5) from DENV-2__EU482781__SS-prME
accgccggcgugaucauuaugcucauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcagcccggaaagcggucccuuagaccucaacccacagaacucaaauauucuuggaagaccuggggcaaggccaaaaugcugagcacggagucccauaaccagaccuuccugaucgaugggccugaaacagcugagugccccaauaccaaccgcgccuggaauagccucgaggucgaagacuacggauuuggcguguucacaaccaacaucuggcugaaacuucgggagaaacaggacgucuuuugugauucuaagcugauguccgcugccauuaaagacaauagagcggugcacgccgauaugggcuauuggaucgaaagcgcucucaacgacacauggaagauggagaaggccucuuucauugaggucaaauccugccacuggcccaagagccauacccuguggucuaauggggugcuggaaagcgagaugaucauuccuaaauccuucgcuggacccguuagccagcacaacuaccgccccggcuauuacacgcaaacagccgggccuuggcaucuuggaaagcucgaaauggauuuugacuucugugagggcaccaccguggucgugacagaagauugcgggaaccggggaccgucucugagaaccacgacagccuccggcaaacugaucaccgaguggugcugucggagcugcacacugcccccucugcgcuacagaggcgaggacggguguugguauggaauggaaauucggccccuuaaggagaaggaagagaaucuggugaacucccucgucaccgcuggccacgggcagaucgauaauuuuucucugggaguucugggcauggcgcuuuuccucgaagagaugcugagaacacgcguggggaccaaacaugccauccugcucgugacggucagcuuugugacccugauuacaggaaacauguccuuccgggaccuuggcagaguuauggugauggucggcgcugccaugaccgaugacaucgggaugggagugacauaccuggcccuccuggcugccuuuaagguucgcccuaccuucgcggcuggccugcuucugagaaaacucacgucuaaggagcugaugauggccacaauugggaucgcccuccugagccaguccaccauucccgaaacaauccuugagcugaccgaugcucucgcccugggaaugauggugcugaaaaucguccggaauauggaaaaguaucaacuugcggugaccauuauggcuaucucuugcguuccuaacgccgugauucugcagaaugccuggaaggucagcuguacaauccucgcugccguguccgugagcccccugcuccugacgucuucccagcagaaagcugacuggauuccgcuugcccugaccaucaagggccucaacccuacagcgaucuuucugaccacacugagccgcaccucuaaaaagagauccuggccccuuaaugaggccauuauggcugucgggaugguuagcauccuggccucuucccuccugaaaaacgacauuccuaugacgggaccccucguggcuggcggccugcuuacagugugcuacguccugaccgggcggagcgccgaucuggaacucgagcgcgccaccgacgugaagugggaggaucaagcugaaaucuccggaagcucuccgauucugagcaucacaauugcggaggacggcuccaugucuaucaaaaaugaagaggaggaacagacccuuacaauccugauuagaacggggcuccugguuaucagcggacucuucccuguguccauucccaucaccgccgcugccugguaucugugggaggucaagaagcagcgggccggcgugcuuugggauguuccuucuccgcccccuguggggaaagcugaacuggaggacggagccuaccgcauuaagcagaaaggcauccugggcuauagccaaaucggggcgggagucuacaaggaaggcacauuucacaccauguggcacgugacaagaggggcuguccucaugcaucggggaaaacgcauugagccguccugggccgaugugaagaaggaccugaucucuuacggcgggggauggaaacuugagggcgaauggaaggagggcgaagagguucaggugcuggcccucgaacccgggaaaaacccuagagcuguccagaccaagcccggacuguucaaaacgaauaccggcacaauuggggccgugagccucgauuuuuccccuggaaccagcggcucucccaucguugaccggaaggggaagguggucggacuguauggcaacggcguggugacaagauccggggcguacguuagcgcuauugcccagaccgagaaaucuaucgaggauaauccugaaaucgaggacgauauuuuccgcaagaaacggcuuacaaucauggaccugcacccgggagccggcaagacgaaaagauaucugcccgcuauuguccgcgaagccaucaagcgggggcucagaacccugauucuugcuccuacacgcgugguggccgcggagauggaagaggcccugcggggacuccccaucagauaccaaaccccugcuauucgcgccgagcauaccggccgggaaaucgucgaccugaugugucacgcuacauucacgaugagacuccugucccccgugcggguuccgaacuauaaccuuaucauuauggaugaggcccauuuuaccgacccugccagcaucgcugcgcgcggguacauuuccacaagaguggaaaugggcgaggccgcuggaaucuucaugaccgccacaccgcccggcucucgggauccuuuuccccagagcaaugccccuauuauggacgaggaacgcgagaucccggaaagauccuggaacagcgggcacgagugggucaccgauuucaagggaaaaacggugugguuuguucccucuaucaaggcuggcaaugacauugccgcgugccugcggaaaaacgggaagaaagugauccagcuguccagaaagacauucgauagcgaauaugucaagacccgcaccaaugacugggauuuugugguuacaaccgacauuucugagaugggagcuaacuucaaagccgagcgggugaucgauccuagacgcuguaugaagcccgucauucucacagacggcgaagaacgggugauccuggccgggccuaugcccgugacccacagcuccgcugcccaaagacgcggccggaucggaagaaauccgaaaaacgaaaaugaccaguacauuuacaugggcgagccucuugaaaacgaugaggacugcgcgcauuggaaggaggccaaaaugcugcucgauaauaucaacacgcccgaagggauuaucccuucuauguuugagcccgaacgcgagaaggucgacgcuauugauggagaauauagacugcggggcgaggcccgcaaaacauucguugaccugaugagaagaggggaucucccuguguggcuugcuuaccgcguggccgcugagggaaucaauuaugccgacagacggugguguuuugauggcgucaagaacaaucagauucuggaagagaacguggaaguugagaucuggaccaaggagggggaacgcaagaagcugaaaccccgcuggcucgacgcgcggaucuacagcgauccgcuggcccuuaaggaguucaaagaguucgcugccggcagaaagucccugacacucaaccugauuaccgagaugggacgccugccuacguuuaugacccagaaggcucgggacgcccucgauaaucuugccgugcugcacacagcugaagcgggcgggagagccuauaaccaugcucugucugagcuccccgagacccuggaaacacuucugcuccugacccugcucgccacagucaccggaggcaucuuccuuuuucugaugagcgggaaaggagugggcaagaugacgcugggcaugugcugcauuaucacagccuccauucuccugugguacgcucaaauccagccccacuggaucgccgcgagcauuauccuugaguucuuucugauuguucuccugaucccugaaccggagaaacagcggacaccccaggacaaucaacugaccuauguggucauugccauccucacaguggucgcugccaccauggcuaacgaaaugggguuccuugagaagaccaagaaggaccugggacugggcucuaucgccacgcaggagccugaauccaauauucucgauaucgaccugcgccccgcgagcgccuggacccuuuacgcuguggccacaaccuuuguuacaccuaugcugagacacuccauugagaacucuagcgugaaugugucccucaccgcuaucgccaaccaggcuacgguccugauggggcugggaaagggcuggccccucucuaaaauggauauugggguuccucuucuggccaucggauguuacagccaggugaauccgauuacccugacagcggcccuccugcuucugguggcucauuaugccaucaucggccccggccuccaagcuaaggccacccgggaagcccagaaacgcgcggcugccgggauuaugaagaacccuacagucgacggagugaccguuaucgaucuggaccccauuccuuacgaucccaaauucgagaagcagcugggccaggugaugcuccuuauccugugcgucacgcaagugcugaugaugagaacaaccugggcucucugugaagcccugacacuugccaccgggccgauuuccacccugugggagggaaauccuggccgguuuuggaacacaacgaucgcugucagcauggccaauaucuuccgcgggucuuaucucgcgggagccggccugcuguuuuccauuaugaagaacaccacaaauaccagacggggcacagggaacaucggagagacccucggcgaaaaauggaaaagccgccuuaaugcucuggggaaaucugaguuccagauuuacaagaaauccggaauccaggaaguggacagaacgcuggccaaggagggcauuaaaagaggggagacagaucaccaugcuguuagcagaggaucugccaagcuccgcugguuuguggaacggaacauggucacccccgagggcaaggugguugaccugggcugcgggagaggaggcuggagcuauuacugugggggacuuaaagaugugcgcgaagucaagggccugaccaaagggggacccggccacgaggaaccuauccccauguccacauauggcuggaaccucgugcggcugcaaucugggguggacguuuucuucaccccuccggagaagugcgauacacugcucugugacaucggagagagcucccccaauccuacgauugaagcgggcagaacccuucgcguccugagccugguggagaacuggcucaauaacgacacacaguuuugcaucaaagugcugaaucccuacaugccuuccgucauugaaaagauggagacccuucagcggaaguacgggggagcccugguuagaaacccccucucucgcaauagcacacaugaaauguauuggguguccaacgcuaccggcaauaucgugucuagcgucaacaugauuucccggaugcugaucaauagauucacgaugaaacacaagaaagccaccuacgagccggauguggaccuggggucuggaacacgcaacaucggcauugagagcgaaaucccuaaucucgauauuaucggcaagcggauugagaaaaucaagcaggaacacgagaccuccuggcauuaugaccaagaucaccccuacaagacaugggcuuaucaugggagcuacgaaaccaaacagacaggaucugccuccagcaugguuaacggcguggucagacuucugaccaagccuugggacgugguucccauggugacgcagauggcuaugacagauaccaccccuuuugggcagcaacgcgucuucaaagagaagguggacacaagaacgcaggagcccaaagaaggaaccaagaagcugaugaaaauuacagccgaguggcucuggaaggaacugggcaaaaagaaaaccccgcggauguguacacgcgaggaguuuaccagaaaggugcggucuaaugcggcccuuggggcuaucuucacagaugaaaacaaauggaaguccgccagagaggcugucgaagacagccgguuuuggaagcugguugauaaagagcgcaaccuccaccuggaaggaaagugcgagaccuguguguauaauaugaugggcaaaagagagaagaaacugggcgaguucgggaaggccaagggaucucgggccaucugguacauguggcucggcgcgcgcuuucuggaguucgaagcucuuggguuucugaacgaggaccacugguucuccagagaaaauagccucuccggaguggagggcgaggggcugcauaaacuuggcuacauucugcgggacgucagcaagaaagaaggaggcgccauguaugccgaugacacggcugggugggauacccgcaucacacucgaggaccugaagaacgaagagauggugaccaaucacauggaaggagagcauaaaaagcuggccgaggcuauuuuuaagcucacauaccagaacaaaguugugagaguccagcggccuacgccccgcggcaccgugauggauaucauuucuagacgggaccaacgcgggagcggacagguuggcacauaugggcugaauaccuucacaaacauggaagcccagcuuaucagacaaauggagggcgaaggaguguucaaguccauccagcggcugaccgucacggaggagauugcggugcagaauuggcucgcccgcguuggcagagaacggcugucuagaauggcuaucagcggggaugacugcguggucaaaccccuugaugaccgcuuugccuccgcucugaccgcccucaacgauaugggaaaggugcggaaagacauucagcaaugggagccuucuagaggcuggaaugauuggacacaggucccguucugcagccaccauuuucacgaacugaucaugaaggacgggcgcgugcugguugugcccugucggaaccaggacgagcucauuggacgggcgcgcaucucccagggcgccggguggucucugaaggaaaccgcuugccuuggcaaaagcuacgcccaaauguggucccugauguauuuccaccggagagaucuccgccuggcugccaaugcuaucuguagcgccgucccuucucauugggugcccacaucccggaccacauggagcauucacgcgaagcaugaguggaugaccacggaggacaugcuuacaguguggaacagaguuuggauccaggaaaauccuuggauggaggauaaaacccccguggaaucuugggaggaagucccuuaccugggaaagcgcgaggaccaguggugcggcucccucauugggcugaccagccgggccacaugggcuaaaaacauccagaccgccauuaaccaagugagaucccugaucggaaaugaggaauauacagauuacaugcccucuaugaagcgguuuagacgcgaggaagaggaagccggcguucucugguga

SEQ ID NO: 20132 - RNA, 9876 nt, Artificial Sequence
  derived and/or modified CDS sequence (opt5) from DENV-2__EU482782__SS-prME
agcgccggcaugaucauuaugcugauccccaccgugauggcuuuccaccugacaacgagaaauggggaaccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuuguggcgggacuucugcucagaaagcugaccuccaaggagcucaugaugacaaccauuggcaucguccugcuuucucaaagcacgauucccgaaacagugcuggagcucaccgaugcucuggcccuggggaugauggugcuuaaaaucguccgcaauauggaaaaguaccagcuggccguuacaaucauggcuauucucugcgugccuaacgccgugauccugcagaaugcguggaaagucuccuguaccauucucgcugugguuucugugagcccccugcuucugaccuccagccagcaaaagacagacuggaucccucucgcccugacgauuaaaggacugaaccccaccgccaucuuccuuacaacccugucuagaacaaauaagaaacgguccuggccgcucaacgaggcuaucauggccgucggcauggugagcauucuggcuucuucccuccugaagaaugacaucccuaugaccgggccccuuguugccggaggccugcugacggugugcuauguccucacaggccgcagcgcggaucuggaacuugagagagccaccgacgugaagugggaggaucaggcugaaauuucuggguccagcccuauccuguccauuaccaucagcgaggacggaucuaugagcauuaaaaacgaagaggaggaacagacacucaccauccugauccggacaggccuccuggucauuuccgggcuuuuucccaucucuauuccgaucacggccgcugccugguaccugugggaggugaagaaacagcgcgccggaguucugugggaugugccuucucccccucccaugggcaaggcugaacucgaggacggggcguauagaauuaaacaaaagggaauccugggcuacucccagaucggcgccggggucuacaaggaaggaaccuuccacacaauguggcaugugacccggggcgcuguucuuaugcacaaagggaagcgcauugagcccuccugggccgaugugaaaaaggaccugaucagcuauggaggcggguggaaacucgagggagaauggaaggagggcgaagagguccaggugcuggcccucgaaccuggcaagaauccgagagcugugcagacaaaacccgggcuguuuaagaccaacacgggaaccauuggcgccguuucccuugauuucucuccugggacaagcggaucccccaucauugacaaaaagggcaaagucguggggcuguacggaaacggcguggucacccggagcggcgcguaugugucugcuaucgcccaaacagagaaguccaucgaggauaauccugaaauugaggacgauaucuuucgcaagagacggcugaccauuauggaccuccaccccggggccggaaaaacaaagagauaccugccugcuaucguucgcgaagccauuaaacggggccuuagaacgcugauccucgcgccgacccgcguggucgcugccgagauggaagaggcccugcgggggcuccccauuagauaucagaccccugcuauccgcgccgagcauaccggacgggaaaucguggaccugaugugucacgcuaccuucacaaugagacuucugagccccguucgcgugccuaacuacaaucugauuaucauggaugaggcccauuucacggaccccgcgucuauugccgcucggggcuauaucuccaccagagucgaaaugggggaggccgcuggcauuuuuaugacagccaccccgccuggaagccgggaucccuucccccaguccaacgccccuaucaucgacgaggaacgcgagauucccgaaagaucuuggaauagcggccacgagugggugacagauuuuaaggggaaaaccguuugguucgugccuuccaucaaggcuggaaacgacauugcggccugccuccggaagaauggcaaaaaggucauccaacugagccgcaaaacguuugauucugaauacgugaagacaagaaccaacgacugggauuucguggucaccacagacauuuccgagaugggggcuaauuuuaaagccgagcggguuaucgauccgagacgcuguaugaagcccgugauccuuaccgacggagaggaacgggugauucuggccggcccuaugcccgucacacauagcucugcugcccagagacgcgggcggaucggcagaaacccuaaaaaugaaaacgaccaguacauuuauaugggagagccccucgaaaaugaugaggacugcgcgcacuggaaggaggcuaagaugcugcuggauaacaucaauaccccggaaggcauuaucccuagcauguucgagcccgaacgcgagaaaguggacgccauugauggggaauaccggcucagaggagaggcccgcaagacguuuguugaccuuaugagacggggcgaucugccuguguggcuggcuuauaaagucgccgcggaggggaucaacuacgccgaccgcagaugguguuucgauggaaucaagaacaaucagauucucgaagagaacguggaaguugagaucuggacaaaagagggcgaacggaagaagcugaaaccccgcuggcuugacgcuagaauuuauuccgauccucuggcccucaaggaguuuaaagaguucgcugccgggcggaagucucugacccugaaucucaucacagagaugggcagacuucccaccuucaugacgcagaagacccgcgacgcucuggauaaccuggccgugcuccacacagcggaagccggaggccgggcuuacaaucaugcccugagcgagcuuccggagacccuggaaacacuccugcugcucacccuucuggcuacagucaccgggggaauuuuucuguuccucauguccggcagagggaucggaaagaugacgcugggcaugugcugcaucauuacagccucuauccuucugugguaugcccagauucagccucacuggaucgcugcgagcauuauccucgaguuuuuccugaucgugcugcucauucccgaacccgagaagcagcgcaccccucaagacaaccagcuuaccuacgucgugaucgccauucugacaguuguggcugccaccauggccaaugaaaugggcuuucuggagaaaacaaagaaagaccucgggcugggauccaucgcuacgcagcagccggagagcaacauucuugauaucgaccugcggcccgccucugcguggacccucuacgccguggcuacaaccuucgucacaccuaugcugagacauuccauugaaaauagcuccguuaacgugucucugaccgccaucgcuaaucaagccacggugcucaugggccuugggaagggauggccccugagcaaaauggauaucggcgucccucugcucgcgauuggguguuauucccaggugaaccccaucacccugacagccgcccuucugcuccugguugcccacuacgcuauuaucggaccuggccugcaggccaaggcuacccgggaggcccagaagcgcgcggccgcuggcauuaugaaaaauccgacaguggacgggaucaccgucaucgaucucgaccccauuccuuaugaucccaaguuugaaaaacaacuuggacaggugaugcugcugauccucugcgucacgcagguccugaugaugagaacaaccugggcccuuugugaggcucugacacucgccaccggcccuauuucuacccugugggaagggaaccccggacgguucuggaauacaacgaucgccguuagcauggcgaacauuuuucgcggcuccuaccuggcuggggccggacuccuuuucagcaucaugaagaauaccacaaacaccagacggggcacaggcaacaucggggagacccugggagagaaauggaagucucgccugaaugcucucggcaaauccgaauuucaaauuuauaaaaagagcgggauccaggagguggacagaacgcuggccaaagaaggaauuaagcggggcgagacagaucaccaugccgucucucgcggguccgcuaaacuuagaugguucguggagcggaacaugguuaccccggaaggaaagguggucgaccugggcugcggcagagggggauggagcuacuauuguggcgggcucaaaaaugugcgcgaggugaagggacugaccaagggcgggccuggacacgaagaacccauccccaugucuacauacggcuggaaccugguucggcuccagagcggcgucgauguguuuuucauuccucccgaaaaaugcgacacccuucugugugauaucggggaguccucuccuaauccgacaguggaggccggaagaacgcugcgcguccucaaccugguugaaaauuggcuuaacaauaacacccaguucugcaucaaggugcugaaucccuacaugccuagcgugauugagaaaauggaagcgcuccaacggaaguauggcggggcccuggucagaaacccccugucccgcaauagcacacaugagauguacuggguguccaacgcuucuggaaauaucguuagcuccgugaacaugauuucucggaugcucaucaacagauuuaccaugcgccacaaaaaggccacauaugaaccugacgucgaccuuggcagcgggacccggaauauuggaaucgaguccgagauucccaaccuggauaucaucggcaagagaauugagaagaucaagcaggagcaugaaacgucuuggcacuacgaccaggaucacccguauaaaaccugggcuuaccauggcagcuaugagacaaagcagaccggguccgccagcucuauggugaauggaguugugcgccugcucacaaaaccuugggacguccugcccaccgugacacaaauggcgaugaccgauacgacaccuuucggccagcagcggguguuuaaggaaaaggucgacaccagaacccaggagcccaaagaggggacaaagaaacuuaugaagauuacggccgaauggcuguggaaagagcucggaaagaaaaagaccccucgcauguguacaagagaagaguucacccggaagguucgcuccaacgcugcccugggcgcuaucuuuacagaugagaauaaauggaaaagcgccagagaagcuguggaggacucucgguucugggaacugguggauaaagagagaaaccuccaccuggaagggaagugcgagaccugugucuacaauaugaugggaaaacgggagaagaaacuuggcgaauuuggcaaagccaaggggucccgcgcgauuugguacauguggcugggagccagauuccucgaguuugaagcucugggcuuccuuaacgaggaccauugguuuagccgggaaaauucucuguccgggguggagggagagggccuccacaaacugggguauauccugcgcgauguuagcaagaaagaaggcggagccauguacgcugacgacacagccggcugggauaccagaaucacgcucgaggaccugaagaacgaagagauggugaccaaucacauggaaggggagcauaagaaacuugccgaggcgauuuucaagcugacauaucaaaacaaagucgugcggguucagcgccccaccccgagaggaacagugauggauaucauuucccggcgcgaccagagaggcagcgggcaagucggaaccuacggccucaauacguuuacaaacauggaagcucagcugauccggcagauggagggggaaggcguguucaagaauauucagcaccuuaccguuacagaggagguggccguccauaacuggcuggcccgcgugggaagagaacggcucucucgcauggcuaucagcggcgaugacugcgucgugaaaccucuggaugacagauucgccaacgcucugaccgcccucaaugauauggggaagauccggaaggacauucaacagugggagcccuccaaaggauggaacgauuggacgcagguucccuuuugcucucaccauuuccacgaacugaucaugaaggacggcagagugcuugucgugccuugucgcaaucaggaugagcugauugggcgggcgagaaucagccaaggagccggcuggucccuccgcgaaaccgcuugccuggggaaaucuuaugcccagauguggagccuuauguacuuucaccggagagaccugcgccucgcugccaacgcgauuuguuccgccgugccgucucauuggguucccacaagccggaccacaugguccauccacgcuaagcaugaguggaugaccacagaggacaugcugaccguguggaauagagucuggauucgcgaaaacccuuggauggaggauaaaacgcccguggaaagcugggaggaaaucccuuaucugggcaagcgggaggaccaguggugcggaucucucaucggccugacauccagagccaccugggcuaagaauauucaggccgcuaucaaccaaguucgcagccuuauugggaaugaggaauacaccgauuacaugcccucuaugaaacgguucagacgggaggaagaggaagccggagugcugugguga

SEQ ID NO: 20133 - RNA, 9876 nt, Artificial Sequence
  derived and/or modified CDS sequence (opt5) from DENV-2__EU482783__SS-prME
accgccggcgugaucauuaugcugauccccaccgcuauggccuuccaccucacgaccagaaacggggagccucauaugauugucggacggcaggaaaagggcaaaagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggaaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgggaucaaaggaauuaugcaggccggcaagcggucccuuagaccccaaccuacagaacucaaauauucuuggaagaccugggggaaggcuaaaaugcugagcacggagucccauaaccagaccuuccugaucgacggacccgaaacagccgagugcccuaauaccaaccgcgcuuggaauagccucgaggucgaagauuacggcuuuggcguguucacaaccaacaucuggcugaaacuucgggagaaacaggacgucuuuugugacucuaagcugauguccgccgcgauuaaagauaauagagccgugcacgcugacaugggguauuggaucgaaagcgcccucaacgauacauggaagauggagaaggcuucuuucauugaggucaaauccugccacuggcccaagagccauacccuguggucuaauggagugcuggaaagcgagaugaucauuccgaaauccuucgccggcccuguuagccagcacaacuaccgccccggguauuacacgcaaacagccggacccuggcaucuuggcaagcucgaaauggacuuugauuucugugaggggaccaccguggucgugacagaagacugcggaaaccggggcccuucucugagaaccacgacagcuuccggcaaacugaucaccgaguggugcugucggagcugcacacucccgccccugcgcuacagaggggaggauggauguugguauggcauggaaauucggccucuuaaggagaaggaagagaaucuggugaacucccucgucaccgcggggcacggacagaucgacaauuuuucucugggcguucuggggauggcccuuuuccucgaagagaugcugagaacacgcgugggaaccaaacaugcuauccugcucgugacggucagcuuugugacccugauuacaggcaacauguccuuccgggaucuuggcagaguuauggugauggucggggccgccaugaccgacgauaucggaaugggcgugacauaccuggcucuccuggccgcguuuaagguucgccccaccuucgcugccgggcugcuucugagaaaacucacgucuaaggagcugaugauggccacaauuggaaucgcucuccugagccaguccaccauuccugaaacaauccuugagcugaccgacgcccucgcgcugggcaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgauuggauuccccuugcgcugaccaucaaggggcucaacccgacagccaucuuucugaccacacugagccgcaccucuaaaaagagauccuggccucuuaaugaggcuauuauggccgucggaaugguuagcauccuggcuucuucccuccugaaaaacgacauucccaugacgggcccucucguggccggcgggcugcuuacagugugcuacguccugaccggacggagcgccgaccuggaacucgagcgcgcuaccgaugugaagugggaggaccaagcggaaaucuccggcagcucucccauucugagcaucacaauugccgaggauggguccaugucuaucaaaaaugaagaggaggaacagacccuuacaauccugauuagaacgggacuccugguuaucagcggccucuucccgguguccauuccuaucaccgcugccgccugguaucugugggaggucaagaagcagcgggcuggggugcuuugggacguucccucuccuccgcccgugggaaaagccgaacuggaggauggcgcguaccgcauuaagcagaaaggcauccugggguauagccaaaucggagcuggcgucuacaaggaagggacauuucacaccauguggcacgugacaagaggagccguccucaugcaucggggcaaacgcauugagccuuccugggccgacgugaagaaggaucugaucucuuacgggggaggcuggaaacuugagggcgaauggaaggagggggaagagguucaggugcuggcucucgaaccgggcaagaaccccagagccguccagaccaagccuggccuguucaaaacgaauaccgggacaauuggagcggugagccucgacuuuucccccggcaccagcgggucuccuaucguugaucggaagggaaagguggucggccuguauggcaacgggguggugacaagauccggagcuuacguuagcgccauugcccagaccgagaaaucuaucgaggacaaucccgaaaucgaggaugacauuuuccgcaagaaacggcuuacaaucauggaucugcacccuggcgcugggaagacgaaaagauaucugccggccauuguccgcgaagcuaucaagcggggacucagaacccugauucuugcccccacacgcgugguggcggccgagauggaagaggcucugcggggccucccuaucagauaccaaacccccgccauucgcgcugagcauaccgggcgggaaaucgucgaccugaugugucacgccacauucacgaugagacuccuguccccugugcggguucccaacuauaaccuuaucauuauggacgaggcccauuuuaccgauccggcuagcaucgcggcccgcggcuacauuuccacaagaguggaaaugggagaggcugccggcaucuucaugaccgccacaccucccgggucucgggaccccuuuccucagagcaaugcucccauuauggaugaggaacgcgagaucccugaaagauccuggaacagcggacacgagugggucaccgacuucaagggcaaaacggugugguuuguuccgucuaucaaggccgggaaugauauugcggcuugccugcggaaaaacggaaagaaagugauccagcuguccagaaagacauucgacagcgaauaugucaagacccgcaccaaugauugggacuuugugguuacaaccgauauuucugagaugggcgccaacuucaaagccgagcgggugaucgaccccagacgcuguaugaagccugucauucucacagauggggaagaacgggugauccuggcuggccccaugccugugacccacagcuccgccgcgcaaagacgcggacggaucggcagaaaucccaaaaacgaaaaugaccaguacauuuacaugggggagccgcuugaaaacgacgaggauugcgcccauuggaaggaggcuaaaaugcugcucgacaauaucaacacgccugaaggaauuauccccucuauguuugagccugaacgcgagaaggucgaugccauugacggcgaauauagacugagaggggaagcucgcaaaacauucguugaucugaugagacggggagaccuccccguguggcuugccuaccgcguggcugccgagggcaucaauuaugcggauagacggugguguuuugacggggucaagaacaaucagauucuggaagagaacguggaaguugagaucuggaccaaggagggcgaacgcaagaagcugaaaccucgcuggcucgaugcccggaucuacagcgacccccuggcucuuaaggaguucaaagaguucgccgcuggaagaaagucccugacacucaaccugauuaccgagaugggccgccugccgacguuuaugacccagaaggcccgggaugcccucgacaaucuugcugugcugcacacagcggaagccgggggacgggcuuauaaccaugcccugucugagcucccugagacccuggaaacacuucugcuccugacccugcucgccacagucaccggcgggaucuuccuuuuucugaugagcggaaaaggcgugggcaagaugacgcuggggaugugcugcauuaucacagcuuccauucuccugugguacgcccaaauccagccccacuggaucgcggccagcauuauccuugaguucuuucugauuguucuccugauccccgaaccugagaaacagcggaccccgcaggauaaucaacugaccuauguggucauugcuauccucacaguggucgccgcuaccauggccaacgaaaugggauuccuugagaagaccaagaaggaccugggccuggggucuaucgcgacgcaggagcccgaauccaauauucucgacaucgaucugcgcccugccagcgcuuggacccuuuacgccguggcuacaaccuuuguuacacccaugcugagacacuccauugagaacucuagcgugaaugugucccucaccgccaucgcuaaccaggccacgguccugaugggacugggcaagggguggccucucucuaaaauggacauuggaguuccccuucuggcgaucggcuguuacagccaggugaauccuauuacccugacagccgcucuccugcuucugguggcccauuaugcuaucaucggcccggggcuccaagccaaggccacccgggaagcgcagaaacgcgcugccgcuggaauuaugaagaaccccacagucgauggcaucaccgugauugaccuggauccuauccccuacgacccuaaauucgagaagcagcuggggcagguuaugcuccuuauucugugcgugacgcaaguccugaugaugagaacaaccugggcccucugugaagcccugacacuugcuaccggacccaucuccacccugugggagggcaauccggggcgguuuuggaacacaacgaucgccgugagcauggcgaauauuuuccgcggaucuuaucucgccggcgcuggccugcuguuuuccaucaugaagaacaccacaaauaccagacgggggacaggaaacauuggcgagacccucggggaaaaauggaaaagccgccuuaaugcccugggaaaaucugaguuccagaucuacaagaaauccggcauucaggaagucgauagaacgcuggcuaaggaggggaucaaacggggagagacagaccaccaugccgugagcagaggcucugcgaagcuccgcugguuuguugaacggaacauggugaccccugagggcaaggucguggaucuggggugcggaagaggcggguggagcuauuacuguggaggccuuaaagacguucgcgaagugaaggggcugaccaaaggaggccccggccacgaggaacccaucccuauguccacauauggguggaaccucguccggcugcaaucuggaguggauguguucuucacacccccugagaagugcgacacccugcucugugauauuggcgagagcuccccgaaucccacgaucgaagccgggagaacccuucgcguucugagccuggucgagaacuggcucaauaacgacacacaguuuugcauuaaagugcugaauccuuacaugcccuccgugaucgaaaagauggagacccuucagcggaaguacggaggcgcucuggucagaaacccucucucucgcaauagcacacaugaaauguauuggguuuccaacgccaccgggaauauugugucuagcgugaacaugaucucccggaugcugaucaauagauucacgaugaaacacaagaaagcuaccuacgagcccgacgucgaucugggaucuggcacacgcaacauuggcaucgagagcgaaauuccgaaucucgacaucauugggaagcggaucgagaaaauuaagcaggaacacgagaccuccuggcauuaugaucaagaccacccuuacaagacaugggccuaucauggaagcuacgaaaccaaacagacaggcucugcuuccagcauggugaacgggguugugagacuucugaccaagcccugggaugucgugccuaugguuacgcagauggccaugacagacaccacccccuuuggacagcaacgcguguucaaagagaaggucgauacaagaacgcaggagccuaaagaaggcaccaagaagcugaugaaaaucacagcggaguggcucuggaaggaacuggggaaaaagaaaacaccccggauguguacacgcgaggaguuuaccagaaaggugcggucuaaugccgcucuuggagccaucuucacagacgaaaacaaauggaaguccgcuagagaggccguggaagauagccgguuuugggagcuggucgacaaggaacgcaaccuccaccuggagggcaaaugcgagaccuguguuuauaauaugaugggcaagagagagaagaagcugggggaguucggaaaagccaagggcucucgggcgauuugguacauguggcucggggcucgcuuucuggaguucgaggcccuuggauuucugaacgaagaucacugguucuccagagagaauagccucuccggcguggagggggaaggccugcauaaacuuggauacauccugcgggacgugagcaaaaaggagggcggggccauguaugcugacgauacggccggaugggacacccgcauuacacucgaagaucugaaaaacgaggaaauggucaccaaucacauggagggcgagcauaagaaacuggcugaagccaucuuuaagcucacauaccagaacaaggugguuagagugcagcggccgaccccucgcgggacggucauggacauuaucucuagacgggaucaacgcggaagcggccagguggggacauauggccugaauaccuucacaaacauggaggcgcagcuuaucagacaaauggaaggagagggcguuuucaaauccauucagcggcugaccgugacggaggaaaucgccguccagaauuggcucgcucgcguggggagagagcggcugucuagaauggccauuagcggagacgauugcguugugaagccccuugacgaucgcuuugcuuccgcccugaccgcgcucaacgacaugggcaaaguccggaaggauauccagcaaugggaacccucuagaggguggaaugacuggacacaggugccuuucugcagccaccauuuucacgagcugauuaugaaagauggacgcguccuggugguuccgugucggaaccaggacgaacucaucggcagagcccgcaucucccagggggcuggcuggucucugaaggagaccgccugccuuggaaagagcuacgcucaaauguggucccugauguauuuccaccggagagaccuccgccuggccgcuaaugccauuuguagcgcggugcccucucauugggucccuacaucccggaccacauggagcauccacgccaaacaugaguggaugaccacggaagauaugcuuacaguguggaacagaguguggauucaggagaaucccuggauggaagacaagaccccuguugagucuugggaagaggugcccuaccugggcaaacgcgaggaucaguggugcgggucccucaucggacugaccagccgggcuacaugggccaagaacauucagaccgccaucaaccaagucagaucccugauuggcaaugaagaguauacagacuacaugccuucuaugaaacgguuuagacgcgaagaggaagaggcuggggugcucugguga

SEQ ID NO: 20134 - RNA, 9876 nt, Artificial Sequence
  derived and/or modified CDS sequence (opt5) from DENV-2__EU482784__SS-prME
agcgccggcaugaucauuaugcugauccccaccgugauggcuuuccaccucaccacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauuguuaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgucuuuugugacuccaagcugaugagcgcugccaucaaggauucucgggcugugcaugccgacaugggcuauuggaucgaguccgcgcucaaugauaccuggaaaauugagaaggccagcuucaucgaagucaaaucuugccacuggccuaagagccauacacugugguccaacggcgugcuggagagcgaaaugauuauccccaaaaauuucgcugggccggugucucaacacaacuacagaccuggauaccacacccagacggccggccccuggcaucuugggcgccucgagauggacuuugauuucugugaaggaacaaccgucguugugaccgaggacugcggcaaccgggggcccucccugagaacaaccacggcuagcggaaagcugauuacagaguggugcugucgguccugcacccucccuccgcugcgcuauagaggcgaagauggcuguugguacgggauggagauccggccccuuaaggaaaaagaggaaaaucuggugaacucucucgucacagccggacacggccagauugacaauuuuagccugggggugcugggaauggcccuuuuccucgaggagaugcugagaacccgcaucggcacaaagcaugcuauccugcucguugcgguguccuuugucacccugauuacggggaacaugucuuuccgggaucuuggaagagugaugguuauggugggcgccaccaugacagacgauaucggcaugggggucaccuaucuggcucuccuggccgccuuuaaagugcgcccuacauucgcugccggacugcuucugagaaagcucaccagcaaagaacugaugaugacgacaauuggcaucguucuccugucccaaucuaccauucccgagacagugcuugaacugaccgacgcgcucgcucuggggaugaugguccugaagaucgugcggaauauggagaaguaccagcuugccgugaccaucauggccauucugugcgucccuaacgcuguuauccuccagaaugccuggaaagugagcuguacaauucuggcgguggucuccgugagcccccuccugcuuacgucuucccagcaaaagaccgauuggaucccucuggcucucacaauuaaaggacugaaccccaccgccaucuuucugacaacccuuagccgcacgaauaagaaaagaucuuggccgcugaacgaagccaucauggcuguuggcaugguguccauucucgccagcucucugcucaagaaugacaucccuaugacagggccccuggucgcuggaggccuucugaccgugugcuauguucugaccggccgguccgccgaccucgagcuggagcgcgcgacagaugugaaaugggaagaccaggccgagauuagcggguccagcccuauccuuucuauuaccaucagcgaagauggauccaugucuauuaagaacgaggaggaagaacagacacugacgauccucaucagaaccggccugcucgucauuagcgggcuguuccccaucuccauuccgaucacagcugccgcuugguaccuuugggaagugaagaaacagcgggccggaguccugugggacgugccuucucccccucccaugggcaaggccgagcuggaagauggggcuuaucgcauuaaacaaaagggaauccucggcuacagccagaucggcgcggggguuuacaaagagggaaccuuucacacaauguggcaugugaccagaggcgccguccugaugcacaaggggaagcggauugagcccuccugggcugacgugaaaaaggaucuuaucucuuauggaggcggguggaaacuggaaggagaguggaaggaaggcgaggaaguucaggugcucgcccuggagccuggcaaaaauccgcgcgccguccagacgaagcccgggcuguucaagaccaacacaggaaccauuggcgcugugagccuggacuuuuccccugggacaagcggaucucccaucauugauaaaaagggcaaagugguugggcuuuacggaaauggcgucgugaccagauccggcgccuaugugagcgcgaucgcucaaacagagaagucuaucgaagacaacccugagauugaagaugacaucuuccggaaaagacgccugacgauuauggaucugcaccccggggccggaaagaccaagcgguaccucccugccaucgucagagaggcuauuaaacgcggccugcggacacuuauccuggccccgaccagagugguugcggcugaaauggaggaggcccuccgcgggcugcccauucgguaucagaccccugccaucagagcugaacauacaggacgcgagaucguggaccucaugugucacgccacguucaccaugcggcugcuuucccccgucagagugccuaacuacaaucugauuaucauggacgaagcucauuuuacagaucccgccagcauugcggcccggggcuauaucuccacccgcguugagaugggggaggcugccggcauuuucaugacagcuaccccgccuggaucuagagaccccuuuccccagagcaacgccccuaucaucgaugaagaacgggaaauucccgagcgcuccuggaauagcggccacgaaugggugacggacuucaaggggaaaacagucugguuugugccuucuaucaaggccggaaacgauauugcugcgugccugcgcaaaaauggcaagaagguuauccaacucucccggaaaaccuucgacagcgaguacgugaagaccagaacaaacgauugggacuuugucgugaccacagauauuucugagaugggggccaauuucaaagcugaacgcgugaucgacccgcggagauguaugaagcccgucauccugaccgauggagaggaacgcguuauucuugccggcccuaugcccgugacgcauagcuccgccgcucagcggagagggcgcaucggccggaacccuaaaaaugagaacgaccaguacauuuauaugggagaaccccuggagaaugacgaggauugcgcccacuggaaggaagcgaaaaugcuccuggacaacaucaauacaccggagggcauuaucccuucuauguuugaacccgagagagaaaagguggaugcuauugacggggaguaccgccugagaggagaggcccggaagaccuucgucgaucucaugcgcagaggcgaccuuccuguguggcuggccuauaaaguugcugccgaagggaucaacuacgcggaucggcgcugguguuuugacggaaucaagaauaaccagauucuggaggaaaacguggaggucgagaucuggacaaaagaaggcgagagaaagaaacucaagccccgguggcuggaugccagaauuuauagcgacccucuugcucugaaggaguucaaagaguucgccgcugggcgcaagucccucacccugaaucugaucacggaaaugggccggcuccccaccuuuaugacacagaagaccagagaugcccuugacaaccuggcugugcugcacacagccgaggcgggaggccgcgccuacaaucaugcucucucugagcugccggaaacccuugagacacugcuccugcugacccuccuugccacgguuacagggggaauuuuccuguuucugaugagcggccgggggaucggaaagaugacccucggcaugugcugcaucauuaccgcuuccauccugcuuugguaugcccagauucagccucacuggaucgccgcuagcauuauccuggaguucuuucucaucgugcugcugauucccgagcccgaaaaacagagaacaccucaagauaaccagcucaccuacgucgugaucgcgauucuuacagucguggccgcuacgauggccaaugagaugggcuuccuggagaagaccaagaaagaccuggggcucggaucuaucgccacacagcagccggaauccaacauucuggacaucgaucuucggcccgcuagcgccuggacccuguacgcgguugccacaaccuuugugacgccuaugcuccgccauuccauugaaaauucuagcgugaacgucucccugaccgcuaucgccaaucaagcuacaguucugaugggccucgggaagggauggccccuuucuaaaauggacaucggcgugccucugcuggccauuggguguuauagccaggugaaccccaucacccucacagcggcccugcuucugcucgucgcucacuacgccauuaucggaccuggccugcaggcuaaggccaccagagaagcucagaaacgggccgcggccggcauuaugaagaauccgacgguggaugggaucacaguuaucgaccuggaucccauuccuuaugaccccaaguucgagaaacaacucggacaggugaugcuucugauccugugcgucacccaggugcucaugaugcgcacaaccugggcucugugugaagcccuuacccuggcuacaggcccuauuuccacgcucugggaggggaaccccggaagauuuuggaauaccacaaucgccgucagcauggccaacauuuuccggggcucuuaccuggcgggggcuggacugcucuuuuccaucaugaagaauaccacaaacacccgcagaggcacgggcaauaucggggagacacuuggagaaaaauggaaaagccggcugaacgcccugggcaaaucugaguuccaaauuuauaagaaauccgggauccaggaaguggaucgcacccucgcuaaggagggaauuaagagaggcgagaccgaccaccaugccguuagccgggggucugccaaacugagaugguuuguggaacgcaacauggucacaccggagggaaaggugguugaucuuggcugcggcagagggggauggagcuacuauuguggcgggcugaaaaaugugcgggaagucaagggacucaccaaaggcgggccuggacacgaggaacccauccccauguccacauacggcuggaaccuggugcgccugcagucuggcguggacguuuucuucauuccucccgagaagugcgauacgcuccuuugugacaucggggagagcuccccuaauccgaccgucgaagcuggacggacacugagagugcugaaccucguggagaauuggcugaacaauaacacccaguuuugcaucaagguccuuaaucccuacaugccuagcguuauugagaagauggaggcccugcaacgcaaguauggcggggcgcucgugcggaacccccuguccagaaauucuacacaugaaauguacugggugagcaacgccuccggaaauaucgucucuagcgugaacaugauuucccgcaugcugaucaaucgguucaccaugagacacaaaaaggcuacguaugagccugauguugaccucggcucugggacccgcaacauuggaaucgagagcgaaauucccaaccuugacaucaucggcaaacggauugagaagaucaagcaggaacaugagacauccuggcacuacgaucaggaccacccguauaaaaccugggccuaccauggcagcuaugaaacaaagcagaccgggucugcuuccagcauggugaauggagucgugagacugcugacaaaaccuugggauguucuccccaccgugacgcaaauggccaugacagacaccaccccuuuuggccagcagcgcgucuucaaggagaaaguggauacaagaacgcaggagcccaaggaagggaccaagaaacugaugaagauuacagcggaguggcuuuggaaagaacugggaaagaaaaagaccccucggauguguacacgcgaggaguuuaccagaaaagugcggucuaacgccgcucucggcgccaucuucacagacgaaaauaaguggaaguccgcuagagaggccgucgaagauagccgguuuugggagcugguugacaaagaacgcaaccugcaccucgaggggaagugcgagaccuguguguacaauaugaugggaaaaagagaaaagaaacugggcgaguucggcaaggcuaaggggucucgggccauuugguacauguggcuuggagcgcgcuuucuggaguucgaggcccucggcuuucugaacgaagaucauugguucuccagagagaauagccuuuccgggguggagggagaaggccugcacaaacucggguauauccugcgggacgucagcaagaaagagggcggagcuauguacgccgaugacacggcuggcugggacacccgcaucacacuggaagaucucaagaacgaggaaauggugaccaaucacauggagggggagcauaaaaagcuggccgaagccauuuuuaaacuuacauaucaaaacaaaguugugagaguccagcggcccaccccgcgcggaacggugauggacaucauuucuagacgggaucagcgcggcagcgggcaaguuggaacauacggccugaauaccuucacaaacauggaggcgcagcucaucagacagauggaaggggagggcguguucaagaauauucagcaccugaccgucacggaggaaguggcuguucauaacuggcuugcccgggugggacgcgagagacugucccggauggccaucucuggcgacgauugcgucgugaaaccucucgacgauagauuugcuaaugcccugaccgcucugaacgacauggggaagauccgcaaagauauucaacagugggaacccagcaagggauggaacgacuggacacagguccccuucugcucccaccauuuucacgagcucaucaugaaggauggccgggugcugguugugccuuguagaaaucaggacgaacuuauugggcgcgcccggaucucucaaggagcgggcuggagccugagagagaccgccugccucgggaaauccuaugcucagauguggucucugauguacuuccaccgccgggaucuuagacuggccgcuaacgccauuuguagcgcggucccgucccauugggugcccacaagccgcaccacauggucuauccacgccaagcaugaguggaugaccacggaagacaugcucacaguguggaaucggguuuggauuagagagaacccuuggauggaagacaaaacccccguggaguccugggaagagaucccuuaucugggcaagcgcgaggaucaguggugcggaagccugaucggccucaccucucgggcuacaugggccaaaaauauucaggcugccaucaaccaagucagaucccugauugggaaugaagaguacaccgacuacaugcccagcaugaagcgguuuagacgcgaagaggaagaggcuggagugcuuugguga

SEQ ID NO: 20135 - RNA, 9876 nt, Artificial Sequence
  derived and/or modified CDS sequence (opt5) from DENV-2__EU482785__SS-prME
accgccggcgugaucauuaugcugauccccaccgcuauggccuuccaccucacgaccagaaacggggaaccucauaugauugucggacggcaggaaaagggcaaaagccugcuuuuuaagaccgaagacgggguuaauaugugcacccugauggcgaucgaucucggagaacugugugaggacacaauuaccuacaaaugcccccuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaaggcgggaucguuacaugcgccauguuuacaugcaaaaagaauauggaagggaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggaaaaagccgagcuggaagacggggcguaccgcauuaagcagaaaggaauccugggcuauagccaaaucggcgcuggggucuacaaggagggaacauuucacaccauguggcacgugacaagaggcgccguccucaugcaucgggggaaacgcauugagccuuccugggccgaugugaagaaggaccugaucucuuacggaggcggguggaaacuugaaggagaguggaaggaaggcgaggaaguucaggugcuggcucucgagccgggcaaaaaccccagagccguccagaccaagccugggcuguucaaaacgaauaccggaacaauuggcgcggugagccucgauuuuucccccgggaccagcggaucuccuaucguugaccggaagggcaagguggucgggcuguauggaaacggcguggugacaagauccggcgcuuacguuagcgccauugcccagaccgagaaaucuaucgaagauaaucccgagaucgaagacgauauuuuccgcaagaaacggcuuacaaucauggaccugcacccuggggcuggaaagacgaaaagauaucugccggccauuguccgcgaggcuaucaagcggggccucagaacccugauucuugcccccacacgcgugguggcggccgaaauggaggaggcucugcgggggcucccuaucagauaccaaacccccgccauucgcgcugaacauaccggacgggagaucgucgaccugaugugucacgccacauucacgaugagacuccuguccccugugcggguucccaacuauaaccuuaucauuauggaugaagcccauuuuaccgacccggcuagcaucgcggcccgcggcuacauuuccacaagaguggagaugggggaggcugccggcaucuucaugaccgccacaccucccggaucucgggaucccuuuccucagagcaaugcucccauuauggacgaagaaagagaaaucccugagagauccuggaacagcggccacgaaugggucaccgauuucaaggggaaaacggugugguuuguuccgucuaucaaggccggaaaugacauugcggcuugccugcggaaaaacggcaagaaagugauccagcuguccagaaagacauucgauagcgaguaugucaagacccgcaccaaugacugggauuuugugguuacaaccgacauuucugagaugggggccaacuucaaagccgaacgggugaucgaucccagacgcuguaugaagccugucauucucacagacggagaggaacgggugauccuggcuggccccaugccugugacccacagcuccgccgcgcaaagacgcgggcggaucggcagaaaucccaaaaacgagaaugaccaguacauuuacaugggagaaccgcuugagaacgaugaggacugcgcccauuggaaggaagcuaaaaugcugcucgauaauaucaacacgccugagggcauuauccccucuauguuugaaccugagcgcgaaaaggucgacgccauugauggggaguauagacugcggggagaggcucgcaaaacauucguugaccugaugagacggggcgaucuccccguguggcuugccuaccgcguggcugccgaagggaucaauuaugcggacagacggugguguuuugauggagucaagaacaaucagauucuggaggaaaacguggagguugagaucuggaccaaggaaggcgagcgcaagaagcugaaaccucgcuggcucgacgcccggaucuacagcgauccccuggcucuuaaggaguucaaagaguucgccgcugggagaaagucccugacacucaaccugauuaccgaaaugggccgccugccgacguuuaugacccagaaggcccgggacgcccucgauaaucuugcugugcugcacacagcggaggccggaggcagagcuuauaaccaugcccugucugagcucccugaaacccuggagacacuucugcuccugacccugcucgccacagucaccgggggaaucuuccuuuuucugaugagcggcaaaggggugggaaagaugacgcugggcaugugcugcauuaucacagcuuccauucuccugugguacgcccaaauccagccccacuggaucgcggccagcauuauccuugaguucuuucugauuguucuccugauccccgagccugaaaaacagcggaccccgcaggacaaucaacugaccuauguggucauugcuauccucacaguggucgccgcuaccauggccaacgagaugggcuuccuugagaagaccaagaaggaccuggggcugggaucuaucgcgacgcaggaacccgaguccaauauucucgauaucgaccugcgcccugccagcgcuuggacccuuuacgccguggcuacaaccuuuguuacacccaugcugagacacuccauugaaaacucuagcgugaaugugucccucaccgccaucgcuaaccaggccacgguccugaugggccuggggaagggauggccucucucuaaaauggauauuggcguuccccuucuggcgaucggguguuacagccaggugaauccuauuacccugacagccgcucuccugcuucugguggcccauuaugcuaucaucggaccgggccuccaagccaaggccacccgggaggcgcagaaacgcgcugccgcuggcauuaugaagaaccccacagucgacggggugaccguuaucgaucuggacccuauucccuacgauccuaaauucgaaaagcagcugggacaggugaugcuccuuauccugugcgucacgcaagugcugaugaugagaacaaccugggcccucugugaggcccugacacuugcuaccggccccauuuccacccugugggaggggaauccgggacgguuuuggaacacaacgaucgccgucagcauggcgaauaucuuccgcggcucuuaucucgccggggcuggacugcuguuuuccauuaugaagaacaccacaaauaccagacggggcacaggcaacaucggggaaacccucggagagaaauggaaaagccgccuuaaugcccugggcaaaucugaguuccagauuuacaagaaauccgggauccaggagguggacagaacgcuggcuaaggagggaauuaaacggggcgaaacagaucaccaugccguuagcagagggucugcgaagcuccgcugguuuguggagcggaacauggucaccccugaaggaaaggugguugaccugggcugcggcagagggggauggagcuauuacuguggcgggcuuaaagaugugcgcgaggucaagggacugaccaaaggcgggcccggacacgaagaacccaucccuauguccacauauggcuggaaccucgugcggcugcaaucuggcguggacguuuucuucacacccccugagaagugcgauacccugcucugugacaucggggaaagcuccccgaaucccacgauugaggccggaagaacccuucgcguccugagccugguggaaaacuggcucaauaacgacacacaguuuugcaucaaagugcugaauccuuacaugcccuccgucauugagaagauggaaacccuucagcggaaguacggcggggcucugguuagaaacccucucucucgcaauagcacacaugagauguauuggguguccaacgccaccggaaauaucgugucuagcgucaacaugauuucccggaugcugaucaauagauucacgaugaaacacaagaaagcuaccuacgagcccgauguggaccugggcucugggacacgcaacaucggaauugaaagcgagaucccgaaucucgauauuaucggcaagcggauugagaagaucaagcaggagcacgaaaccuccuggcauuaugaccaagaucacccuuacaagacaugggccuaucauggcagcuacgagaccaaacagacagggucugcuuccagcaugguuaacggaguggucagacuucugaccaagcccugggacgugguuccuauggugacgcagauggccaugacagauaccacccccuuuggccagcaacgcgucuucaaagagaagguggacacaagaacgcaggaaccuaaagaggggaccaagaagcugaugaaaauuacagcggaauggcucuggaaggagcugggcaagaagaaaacaccccggauguguacacgcgaggaauuuaccagaaaggugcggucuaaugccgcucuuggcgccaucuucacagaugagaacaaauggaaguccgcuagagaagccgucgaggacagccgguuuugggaacugguugauaaggagcgcaaccuccaccuggaggggaaaugcgaaaccuguguguauaauaugaugggaaagagagagaaaaagcugggcgaguucggcaaagccaaggggucucgggcgaucugguacauguggcucggagcucgcuuucuggaguucgaagcccuuggcuuucugaacgaggaccacugguucuccagagagaauagccucuccgggguggaaggagagggccugcauaaacuuggguacauucugcgggacgucagcaaaaaggaaggcggagccauguaugcugaugacacggccggcugggauacccgcaucacacucgaggaccugaaaaacgaagagauggugaccaaucacauggagggggaacauaagaaacuggcugaggccauuuuuaagcucacauaccagaacaagguugugagaguccagcggccgaccccucgcggaacggugauggauaucauuucuagacgggaccaacgcggcagcgggcagguuggaacauauggccugaauaccuucacaaacauggaagcgcagcuuaucagacaaauggagggggagggcguguucaaauccauccagcggcugaccgucacggaagagauugccgugcagaauuggcucgcucgcguuggaagagaacggcugucuagaauggccaucagcggcgaugacugcguggucaagccccuugaugaccgcuuugcuuccgcccugaccgcgcucaacgauauggggaaagugcggaaggacauucagcaaugggagcccucuagaggauggaaugauuggacacaggucccuuucugcagccaccauuuucacgaacugaucaugaaagacggccgcgugcugguugugccgugucggaaccaggacgagcucauugggagagcccgcaucucccagggagcuggcuggucucugaaggagaccgccugccuuggaaagagcuacgcucaaauguggucccugauguauuuccaccggagagaucuccgccuggccgcuaaugccaucuguagcgcgguccccucucauugggugccuacaucccggaccacauggagcauucacgccaaacaugaauggaugaccacggaggacaugcuuacaguguggaacagaguuuggauccaggaaaaucccuggauggaggauaagaccccuguggaaucuugggaggagguccccuaccugggcaaacgcgaagaccaguggugcggaucccucauuggccugaccagccgggcuacaugggccaagaacauccagaccgccauuaaccaagugagaucccugaucgggaaugaggaauauacagauuacaugccuucuaugaaacgguuuagacgcgaggaagaggaggcuggaguucucugguga

SEQ ID NO: 20136 - RNA, 9876 nt, Artificial Sequence
  derived and/or modified CDS sequence (opt5) from DENV-2__EU482786__SS-prME
agcgccggaaugaucauuaugcugauccccaccgugauggcuuuccaccucacgacgagaaauggggagccucauaugauugucgggauccaggaaaagggaaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagagauacgugcugggacgccugauuacagucaacccuaucgugacgggcaaggauucuccgguuaacauugaggcggaacccccuuuuggggacuccuacaucauuaucggcguggagcccggacagcucaagcugaauugguucaaaaagggcagcucuauugggcaaauguuugagaccacaaugcggggagccaaaagaauggcuauccuuggcgauaccgccugggacuucgggagccugggaggcgucuuuacauccaucgggaaggcccuccaucagguguucggcgcuauuuauggagccgcguuuucuggcgugagcuggaccaugaaaauccugauugggguuaucauuacguggaucggaaugaacucccgcagcacaucucuguccgucagccuugugcucgugggcaucgucacccuguaccugggggugaugguucaggcugauucuggauguguggucuccuggaagaauaaggaacucaaaugcggcagcgggauuuucaucaccgacaacgugcacacauggaccgagcaguauaaguuucaaccugaaucccccucuaaacuggccagcgccauucagaaggcucaggaggaaggcaucuguggcauucgguccguuacaagacuugagaaucugauguggaaacagaucacgccggagcucaaccacauccuggccgaaaaugaggugaagcugaccauuaugacaggcgauaucaaagggauuaugcaagcuggaaagcgcucucuucggccucagcccaccgaacucaaguacagcuggaaaacauggggcaaggccaaaaugcuguccaccgagagcuauaaccagacguuccugaucgacgggccugaaaccgcggagugccccaauacaaacagagccuggaacucucucgaggucgaagauuacggauuuggcguguucaccacaaacauuuggcugaaacuuaaagagaagcaggacgcuuuuugugacuccaagcugaugagcgccgcuaucaaagauaaucgcgccguucaugcggacaugggcuauuggaucgaaucugcccucaacgauaccuggaagauugagaaggcuagcuucaucgaggugaagaauugccacuggccuaaaagccauacacuguggucuaacgggguccuggaaagcgagaugauuauccccaagaaccuugccggaccggugucccaacacaauuaccggccuggcuaccacacccagauugcugggcccuggcaucucggaaagcuggaaauggacuucgauuuuugugacggcacgacagugaucgucaccgaggauugcgggaacagaggacccagccugcgcaccacaaccgccucuggcaaacucauuacggaauggugcugucgguccugcacacugccuccgcuuagauaucggggcgaggacggguguugguacggaauggagauccgcccccugaaggaaaaagaggaaaaucucguuaacagccuggugaccgccggccacgggcaggucgauaauuucucccugggaguccuuggcauggcucucuuucuggaggaaaugcugagaacacggguggggaccaagcaugcgauccuccugguugccgugucuuucgucacacuuauuaccggaaacaugagcuuuaaagaccugggcagagugguugugauggucggcgcuacgauggccgaugacaucgggaugggagugaccuaucucgcccugcuggcugccuucaagguucgcccuacauuugcggcuggccuucugcuccggaagcugaccuccaaagagcucaugaugacaaccauugggaucgugcugcuuucucaaagcacgauucccgagacaguccuggaacucaccgaugcccuggcccugggaaugauggugcuuaagaucgugagaaauauggagaaauaccagcuggcugucacaaucauggccauucucugcguuccuaacgcgguggugcugcagaaugcuuggaaggucuccuguaccauccucgccgugguuucugugagcccccugcuucugaccuccagccagcagaagaccgacuggauuccucucgcccugacgaucaagggccugaaccccaccgcuauuuuccuuacaacccugucucgcacaaauaaaaagagauccuggccgcucaacgaagccaucauggcugucgggauggugagcauccuggccucuucccuccugaagaaugacauuccuaugaccggaccccuuguugcgggcggccugcugacggugugcuauguccucacagggcggagcgccgaucuggagcuugaacgcgcuaccgacgugaaaugggaggaucaggccgagaucucuggauccagcccuauucuguccaucaccauuagcgaagacggcucuaugagcaucaagaacgaggaagaggagcagacacucaccauucugaucagaacagggcuccuggucaucuccggacuuuuucccauuucuaucccgauuacggcugccgccugguaccugugggaagugaaaaagcagcgggcuggcguucugugggaugugccuucucccccucccauggggaaagcggagcucgaagacggagccuaucgcaucaagcaaaagggcauucugggcuacucccagaucggggcuggagucuacaaagagggcaccuuccacacaauguggcaugugaccagaggggccguucuuaugcacaagggaaaacggaucgaacccuccugggccgaugugaagaaagaccugauuagcuauggcgggggauggaagcucgagggcgaguggaaggaaggcgaggaaguccaggugcuggcucucgagccugggaaaaauccgcgcgccgugcagacaaagcccggacuguuuaaaaccaacacgggcaccaucggggcgguuucccuugauuucucuccuggaacaagcggcucccccauuaucgacaagaaagggaaggucgugggacuguacggcaacggcguggucaccagaagcggggcuuaugugucugccauugcccaaacagaaaaguccaucgaggauaauccugagaucgaagacgauauuuuucggaaacgcagacugaccaucauggaccuccaccccggagcuggcaagacaaaacgguaccugccugccauuguuagagaggcgaucaagcgcgggcuucggacgcugauucucgcuccgaccagaguggucgccgccgaaauggaggaagcucugcgcggacuccccauccgguaucagaccccugccauuaaagcugagcauaccggcagagagaucguggaccugaugugucacgccaccuucacaaugcgccuucugagccccguucgggugccuaacuacaaucugaucauuauggaugaagcgcauuucacggaccccgccucuaucgcugccagaggguauauuuccacccgcgucgagaugggcgaagcugccggaaucuuuaugacagccaccccgccuggcagccgggaucccuucccccaguccaacgcuccuauuaucgacgaggagagagaaauccccgagcggucuuggaauagcgggcacgaaugggugacagauuuuaagggaaagaccguuugguucgugccuuccauuaaagcgggcaacgacaucgccgcuugccuccgcaagaaugggaaaaaggucauucaacugagcagaaaaacguuugauucugaguacgugaagacacggaccaacgacugggauuucguggucaccacagacaucuccgaaaugggagccaauuuuaaagccgagcgcguuauugauccgagacgguguaugaagcccgugauccuuaccgacggcgaggaaagagugauccuggcugggccuaugcccgucacacauagcucugccgcgcagcgccggggcagaauuggacgcaacccuaagaaugagaacgaccaguacaucuauaugggcgaaccccucgagaaugauggggacugcgcucacuggaaagaagccaagaugcugcuggauaacauuaauaccccggagggaaucauuccuagcauguucgagcccgaacgggagaaaguggacgccaucgauggcgaauacagacuccgcggggaggcucggaagacguuuguugaccuuaugagacgcggagaucugccuguguggcuggccuauaaagucgcggccgaaggcauuaacuacgcugacagacggugguguuucgaugggaucaagaacaaucagauccucgaggagaacguggaaguugagauuuggacaaaggaaggcgagcgcaaaaagcugaaacccagauggcuugacgcccggaucuauuccgauccucuggcucucaaggaguuuaaagaguucgccgcuggacgcaagucucugacccugaaucucauuacagagaugggcagacuucccaccuucaugacgcaaaagacccgggacgcccuggauaaccuggcggugcuccacacagccgaagcugggggcagagccuacaaucaugcucugagcgagcuuccggaaacccuggagacacuccugcugcucacccuucuggccacagucaccggcgggaucuuucuguuccucauguccggacgcggcauuggcaaaaugacgcuggggaugugcugcaucaucacagccucuauucuucugugguaugcucagauccagccucacuggauugcggccagcaucauucucgaguuuuuccugaucgugcugcucauccccgaacccgagaagcagcggaccccucaagacaaccagcuuaccuacgucgugauugcuauccugacaguuguggccgccaccauggcuaaugaaaugggauuucuggagaaaacaaagaaagaccucggccugggguccauugccacgcagcagccggaaagcaacauccuugauauugaccugagacccgcgucugccuggacccucuacgcuguggccacaaccuucgucacaccuaugcugcgccauuccaucgagaauagcuccguuaacgugucucugaccgcuauugccaaucaagcgacggugcucaugggacuuggcaagggguggccccugagcaagauggauaucggagucccucugcucgccaucggcuguuauucccaggugaaccccauuacccugacagcugcccuucugcuccugguugcucacuacgccaucauuggcccugggcugcaggcuaaagccacccgggaggcgcagaagagagccgcugccggaaucaugaaaaauccgacaguggacggcauuaccgucaucgaucucgaccccaucccuuaugaucccaaguuugaaaaacaacuuggacaggugaugcugcugauucucugcgucacacaggugcugaugaugcggacaaccugggcucuuugugaggcccugacacucgccaccggaccuaucucuacccugugggaaggcaaccccgggcgcuucuggaauacaacgauugcgguuagcauggcuaacaucuuuagaggauccuaccuggccggcgcuggccuccuuuucagcauuaugaagaauaccacaaacacccggcgcgggacaggaaacaucggcgagacccugggggaaaaauggaagucuagacugaaugcccucggaaaguccgaguuucaaaucuauaaaaagagcggcauucaggagguggaccggacgcuggccaaagaagggaucaagcgcggagagacagaucaccaugcugucucuagaggcuccgccaaacuucggugguucguggaacgcaacaugguuaccccggagggcaagguggucgaccuggggugcggaagaggcggguggagcuacuauuguggaggccucaagaaugugcgggaggugaaagggcugaccaagggaggcccuggccacgaagaacccauucccaugucuacauacggguggaaccugguuagacuccagagcggagucgauguguuuuucaucccucccgaaaaaugcgacacccuucugugugauauuggcgaguccucuccuaauccgacaguggaagcggggcgcacgcugcggguccucaaccugguugagaauuggcuuaacaauaacacccaguucugcaucaaggugcugaaucccuacaugccuagcgugaucgagaaaauggaagcccuccaaagaaaguauggaggcgcucugguccgcaacccccugucccggaauagcacacaugagauguacuggguguccaacgccucugggaauauuguuagcuccgugaacaugaucucuagaaugcucauuaaccgcuuuaccaugcggcacaagaaagcuacauaugaaccugacgucgaccuuggaagcggcaccagaaauaucggcauugaguccgaaauccccaaccuggauauuaucgggaagcgcaucgagaaaauuaagcaggagcaugaaacgucuuggcacuacgaccaggaucacccguauaaaaccugggccuaccauggaagcuaugagacaaagcagaccggcuccgcgagcucuauggugaaugggguugugcggcugcucacaaagccuugggacguccugcccaccgugacacaaauggccaugaccgauacgacaccuuucggacagcagagaguguuuaaagaaaaggucgacacccgcacccaggagcccaaagaaggcacaaagaaacuuaugaagaucacggcuaaauggcuguggaaggagcucgggaagaaaaagaccccucggauguguacaagagaggaguucacccgcaaaguuagauccaacgccgcucugggagccauuuuuacagaugagaauaaguggaaaagcgcucgggaagccguggaggacucucgcuucugggagcugguggauaaggaaagaaaccuccaccuggagggcaagugcgaaaccugugucuacaauaugaugggcaaacgggagaagaaacuuggggaauuuggaaaggcgaaaggcuccagagccaucugguacauguggcugggggcucgguuccucgaguuugaggcccugggauuccuuaacgaagaccauugguuuagccgcgaaaauucucuguccggcguggaaggggagggccuccacaagcugggauauauucugagagauguuagcaagaaagaaggcggggcuauguacgccgacgacacagccggaugggauacccggaucacgcucgaggaccugaagaacgaggaaauggugaccaaucacauggagggcgaacauaagaaacuugcggaggcuaucuucaaacugacauaucaaaacaaagucgugcgcguucagagacccaccccgcgggggacagugauggauauuaucucccgcagagaccagcggggaagcggccaagucgggaccuacggccucaauacguuuacaaacauggaagcccagcugauucgccagauggagggagagggcguguucaagaauauccagcaccuuaccguuacagaagagguggccguccaaaacuggcuggcuagaguggggcgggaacgccucucuagaauggccauuagcggagaugacugcgucgugaaaccucuggaugaccgguucgcuaacgcccugaccgcgcucaaugauaugggcaagauccgcaaagacauccagcagugggagcccuccaagggguggaacgauuggacgcagguucccuuuugcucucaucacuuccaugagcugauuaugaaagacggaagagugcuugucgugccuugucggaaucaagaugaacugaucggcagagcccgcauuagccagggggcuggcuggucccuccgggagaccgccugccugggaaagucuuaugcucagauguggagccuuauguacuuucacagacgcgaccugcggcucgccgcgaacgccaucuguuccgcugugccgucucacuggguucccacaagcagaaccacaugguccauucaugccaagcacgaauggaugaccacagaggacaugcugaccguguggaaucgcgucuggauccgggaaaacccuuggauggaggauaaaacgcccguggagagcugggaagagauuccuuaucugggcaagagagaagaccaguggugcgggucucucaucggacugacaucccgcgcuaccugggccaaaaauauccaagcugccauuaaccagguucggagccuuaucggcaaugaggaauacaccgauuacaugcccucuaugaagagauuccgccgggaggaggaagaggcgggggugcugugguga

SEQ ID NO: 20137 - RNA, 9876 nt, Artificial Sequence
  derived and/or modified CDS sequence (opt5) from DENV-2__EU482787__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgagcaccggcacaauuggggcggugucccucgauuuuagccccggaaccucuggcuccccuaucguugaccggaaggggaagguggucggacuguauggcaauggcguggugacaagaagcggggcuuacguuucugccauugcccagaccgagaaauccaucgaggauaaccccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccugagcccugugcggguucccaauuauaaccuuaucauuauggaugaggcccauuuuaccgacccggcuuccaucgcggcccgcggguacauuucuacaagaguggaaaugggcgaggcugccggaaucuucaugaccgccacaccucccggcagccgggaucccuuuccucaguccaacgcucccauuauggacgaggaacgcgagaucccugaaagaagcuggaacucugggcacgagugggucaccgauuucaagggaaaaacggugugguuuguuccguccaucaaggccggcaaugacauugcggcuugccugcggaaaaaugggaagaaagugauccagcugagcagaaagacauucgauucugaauaugucaagacccgcaccaacgacugggauuuugugguuacaaccgacauuagcgagaugggagccaauuucaaagccgagcgggugaucgaucccagacgcuguaugaagccugucauucucacagacggcgaagaacgggugauccuggcugggcccaugccugugacccacuccucugccgcgcaaagacgcggccggaucggaagaaaccccaaaaaugaaaacgaccaguacauuuacaugggcgagccgcuugaaaaugaugaggacugcgcccauuggaaggaggcuaaaaugcugcucgauaacaucaauacgccugaagggauuauccccagcauguuugagccugaacgcgagaaggucgacgccauugauggagaauauagacugcggggcgaggcucgcaaaacauucguugaccugaugagaagaggggaucuccccguguggcuugccuaccgcguggcugccgagggaaucaacuaugcggacagacggugguguuuugauggcgucaagaauaaccagauucuggaagagaauguggaaguugagaucuggaccaaggagggggaacgcaagaagcugaaaccucgcuggcucgacgcccggaucuacuccgauccccuggcucuuaaggaguucaaagaguucgccgcuggcagaaagucucugacacucaaccugauuaccgagaugggacgccugccgacguuuaugacccagaaggcccgggacgcccucgauaaccuugcugugcugcacacagcggaagccggcgggagagcuuauaaucaugcccugagcgagcucccugagacccuggaaacacuucugcuccugacccugcucgccacagucaccggaggcaucuuccuuuuucugauguccgggaaaggagugggcaagaugacgcugggcaugugcugcauuaucacagcuagcauucuccugugguacgcccaaauccagccccacuggaucgcggccucuauuauccuugaguucuuucugauuguucuccugauccccgaaccugagaaacagcggaccccgcaggacaaccaacugaccuauguggucauugcuauccucacaguggucgccgcuaccauggccaaugaaaugggguuccuugagaagaccaagaaggaccugggacugggcuccaucgcgacgcaggagcccgaaagcaacauucucgauaucgaccugcgcccugccuccgcuuggacccuuuacgccguggcuacaaccuuuguuacacccaugcugagacacucuauugagaauagcuccgugaacgugucucucaccgccaucgcuaaucaggccacgguccugauggggcugggaaagggcuggccucucagcaaaauggauauugggguuccccuucuggcgaucggauguuacucccaggugaacccuauuacccugacagccgcucuccugcuucugguggcccauuaugcuaucaucggcccgggccuccaagccaaggccacccgggaagcgcagaaacgcgcugccgcugggauuaugaagaaucccacagucgacggagugaccguuaucgaucuggacccuauucccuacgauccuaaauucgagaagcagcugggccaggugaugcuccuuauccugugcgucacgcaagugcugaugaugagaacaaccugggcccucugugaagcccugacacuugcuaccgggcccauuagcacccugugggagggaaacccgggccgguuuuggaauacaacgaucgccgucucuauggcgaacaucuuccgcggguccuaucucgccggagcuggccugcuguuuagcauuaugaagaauaccacaaacaccagacggggcacagggaauaucggagagacccucggcgaaaaauggaagucucgccuuaacgcccuggggaaauccgaguuccagauuuacaagaaaagcggaauccaggaaguggacagaacgcuggcuaaggagggcauuaaaagaggggaaacagaucaccaugccguuucuagaggaagcgcgaagcuccgcugguuuguggaacggaauauggucaccccugagggcaaggugguugaccugggcugcgggagaggaggcugguccuauuacugugggggacuuaaagaugugcgcgaagucaagggccugaccaaagggggacccggccacgaggaacccaucccuaugucuacauauggcuggaaccucgugcggcugcaaagcgggguggacguuuucuucacacccccugagaagugcgauacccugcucugugacaucggagaguccagcccgaaccccacgauugaagccggcagaacccuucgcguccugucccugguggagaauuggcucaacaaugacacacaguuuugcaucaaagugcugaacccuuacaugcccucugucauugaaaagauggagacccuucagcggaaguacgggggagcucugguuagaaauccucucagccgcaacuccacacaugaaauguauugggugucuaaugccaccggcaacaucgugagcuccgucaauaugauuucucggaugcugaucaacagauucacgaugaaacacaagaaagcuaccuacgagcccgauguggaccuggggagcggaacacgcaauaucggcauugaguccgaaaucccgaaccucgauauuaucggcaagcggauugagaaaaucaagcaggaacacgagaccagcuggcauuaugaccaagaucacccuuacaagacaugggccuaucaugggucuuacgaaaccaaacagacaggauccgcuagcucuaugguuaauggcguggucagacuucugaccaagcccugggacgugguuccuauggugacgcagauggccaugacagauaccacccccuuugggcagcaacgcgucuucaaagagaagguggacacaagaacgcaggagccuaaagaaggaaccaagaagcugaugaaaauuacagcggaguggcucuggaaggaacugggcaaaaagaaaacaccccggauguguacacgcgaggaguuuaccagaaaggugcgguccaacgccgcucuuggggccaucuucacagaugaaaauaaauggaaaagcgcuagagaggccgucgaagacucucgguuuugggagcugguugauaaggaacgcaaccuccaccuggagggaaaaugcgagaccuguguguauaacaugaugggcaagagagagaagaagcugggcgaguucgggaaagccaagggaucccgggcgaucugguacauguggcucggcgcucgcuuucuggaguucgaggcccuuggguuucugaaugaagaccacugguucagcagagagaacucccucagcggaguggagggcgaagggcugcauaaacuuggcuacauucugcgggacgucucuaaaaaggagggaggcgccauguaugcugaugacacggccgggugggauacccgcaucacacucgaagaccugaaaaaugaggaaauggugaccaaccacauggagggagagcauaagaaacuggcugaagccauuuuuaagcucacauaccagaauaagguugugagaguccagcggccgaccccucgcggcacggugauggauaucauuagcagacgggaccaacgcggguccggacagguuggcacauaugggcugaacaccuucacaaauauggaggcgcagcuuaucagacaaauggaaggcgagggaguguucaaaucuauccagcggcugaccgucacggaggaaauugccgugcagaacuggcucgcucgcguuggcagagagcggcugagcagaauggccaucuccggggaugacugcguggucaagccccuugaugaccgcuuugcuucugcccugaccgcgcucaaugauaugggaaaagugcggaaggacauucagcaaugggaacccagcagaggcuggaacgauuggacacaggucccuuucugcucccaccauuuucacgagcugaucaugaaagacgggcgcgugcugguugugccgugucggaaucaggacgaacucauuggacgggcccgcaucucucagggcgcuggguggagccugaaggagaccgccugccuuggcaaguccuacgcucaaauguggagccugauguauuuccaccggagagaucuccgccuggccgcuaacgccaucuguucugcgguccccucccauugggugccuacaagccggaccacauggucuauucacgccaaacaugaguggaugaccacggaagacaugcuuacaguguggaauagaguuuggauccaggagaaccccuggauggaagauaagaccccuguggaguccugggaagagguccccuaccugggaaaacgcgaggaccaguggugcggcagccucauugggcugaccucccgggcuacaugggccaagaauauccagaccgccauuaaccaagugagaucucugaucggaaacgaagaguauacagauuacaugccuagcaugaaacgguuuagacgcgaagaggaagaggcuggcguucucugguga

SEQ ID NO: 20138 - RNA, 9876 nt, Artificial Sequence
  derived and/or modified CDS sequence (opt5) from DENV-2__EU482788__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaggaacaggacaaacgcuuugugugcaagcauuccaugguggauagaggcuggggcaacggguguggacuguucggcaaagggggaaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgaauaccggcacaauuggggcggugagccucgauuuuucccccggaaccagcggcucuccuaucguugaccggaaggggaagguggucggacuguauggcaacggcguggugacaagauccggggcuuacguuagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccuguccccugugcggguucccaacuauaaccuuaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccugcggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucucacagacggcgaagaacgggugauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaaggucgacgccauugauggagaauauagacugcggggcgaggcucgcaaaacauucguugaccugaugagaagaggggaucuccccguguggcuugccuaccgcguggcugccgagggaaucaauuaugcggacagacggugguguuuugauggcgucaagaacaaucagauucuggaagagaacguggaaguugagaucuggaccaaggagggggaacgcaagaagcugaaaccucgcuggcucgacgcccggaucuacagcgauccccuggcucuuaaggaguucaaagaguucgccgcuggcagaaagucccugacacucaaccugauuaccgagaugggacgccugccgacguuuaugacccagaaggcccggaaugcccucgacaaccuugcugugcugcacacagcggaagccggcgggagagcuuauaaucaugcccugucugagcucccugagacccuggaaacacuucugcuccugacccugcucgccacagucaccggaggcaucuuccuuuuucugaugagcgggaaaggagugggcaagaugacgcugggcaugugcugcauuaucacagcuuccauucuccugugguacgcccaaauccagccccacuggaucgcggccagcauuauccuugaguucuuucugauuguucuccugauccccgaaccugagaaacagcggaccccgcaggauaaccaacugaccuauguggucauugcuauccucacaguggucgccgcuaccauggccaaugaaaugggguuccuugagaagaccaagaaggaccugggacugggcucuaucgcgacgcaggagcccgaauccaacauucucgacaucgaucugcgcccugccagcgcuuggacccuuuacgccguggcuacaaccuuuguuacacccaugcugagacacuccauugaaaauucuagcgugaacgugucccucaccgccaucgcuaaucaggccacgguccugauggggcugggaaagggcuggccucucucuaaaauggacauugggguuccccuucuggcgaucggauguuacagccaggugaacccuauuacccugacagccgcucuccugcuucugguggcccauuaugcuaucaucggcccgggccuccaagccaaggccacccgggaagcgcagaaacgcgcugccgcugggauuaugaagaaucccacagucgauggaaucaccgugauugaccuggauccuauccccuacgacccuaaauucgagaagcagcugggccagguuaugcuccuuauucugugcgugacgcaaguccugaugaugagaacaaccugggcccucugugaagcccugacacuugcuaccgggcccaucuccacccugugggagggaaacccgggccgguuuuggaauacaacgaucgccgugagcauggcgaacauuuuccgcgggucuuaucucgccggagcuggccugcuguuuuccaucaugaagaauaccacaaacaccagacggggcacagggaauauuggagagacccucggcgaaaaauggaaaagccgccuuaacgcccuggggaaaucugaguuccagaucuacaagaaauccggcauucaggaagucgauagaacgcuggcuaaggagggcaucaaaagaggggaaacagaccaccaugccgugagcagaggaucugcgaagcuccgcugguuuguugaacggaacauggugaccccugagggcaaggucguggaucugggcugcgggagaggaggcuggagcuauuacugugggggacuuaaagacguucgcgaagugaagggccugaccaaagggggacccggccacgaggaacccaucccuauguccacauauggcuggaaucucguccggcugcaaucugggguggauguguucuucacacccccugagaagugcgacacccugcucugugauauuggagagagcuccccgaaccccacgaucgaagccggcagaacccuucgcguucugagccuggucgagaauuggcucaacaaugacacacaguuuugcauuaaagugcugaacccuuacaugcccuccgugaucgaaaagauggagacccuucagcggaaguacgggggagcucuggucagaaauccucucucucgcaacagcacacaugaaauguauuggguuuccaaugccaccggcaacauugugucuagcgugaauaugaucucccggaugcugaucaacagauucacgaugaaacacaagaaagcuaccuacgagcccgacgucgaucuggggucuggaacacgcaauauuggcaucgagagcgaaauuccgaaccucgacaucauuggcaagcggaucgagaaaauuaagcaggaacacgagaccuccuggcauuaugaucaagaccacccuuacaagacaugggccuaucaugggagcuacgaaaccaaacagacaggaucugcuuccagcauggugaauggcguugugagacuucugaccaagcccugggaugucgugccuaugguuacgcagauggccaugacagacaccacccccuuugggcagcaacgcguguucaaagagaaggucgauacaagaacgcaggagccuaaagaaggaaccaagaagcugaugaaaaucacagcggaguggcucuggaaggaacugggcaaaaagaaaacaccccggauguguacacgcgaggaguuuaccagaaaggugcggucuaacgccgcucuuggggccaucuucacagacgaaaacaaauggaaguccgcuagagaggccguggaagauagccgguuuugggagcuggucgacaaggaacgcaaucuccaccuggagggaaaaugcgagaccuguguuuauaacaugaugggcaagagagagaagaagcugggcgaguucgggaaagccaagggaucucgggcgauuugguacauguggcucggcgcucgcuuucuggaguucgaggcccuuggguuucugaaugaagaucacugguucuccagagagaacagccucuccggaguggagggcgaagggcugcauaaacuuggcuacauccugcgggacgugagcaaaaaggagggaggcgccauguaugcugacgauacggccgggugggacacccgcauuacacucgaagaucugaaaaaugaggaaauggucaccaaccacauggagggagagcauaagaaacuggcugaagccaucuuuaagcucacauaccagaauaaggugguuagagugcagcggccgaccccucgcggcacggucauggacauuaucucuagacgggaucaacgcgggagcggacaggugggcacauaugggcugaacaccuucacaaauauggaggcgcagcuuaucagacaaauggaaggcgagggaguuuucaaauccauucagcggcugaccgugacggaggaaaucgccguccagaacuggcucgcucgcgugggcagagagcggcugucuagaauggccauuagcggggacgauugcguugugaagccccuugacgaucgcuuugcuuccgcccugaccgcgcucaaugacaugggaaaaguccggaaggauauccagcaaugggaacccucuagaggcuggaacgacuggacacaggugccuuucugcagccaccauuuucacgagcugauuaugaaagaugggcgcguccuggugguuccgugucggaaucaggacgaacucaucggacgggcccgcaucucccagggcgcuggguggucucugaaggagaccgccugccuuggcaagagcuacgcucaaauguggucccugauguauuuccaccggagagaccuccgccuggccgcuaacgccauuuguagcgcggugcccucucauugggucccuacaucccggaccacauggagcauccacgccaaacaugaguggaugaccacggaagauaugcuuacaguguggaauagaguguggauucaggagaaccccuggauggaagacaagaccccuguugagucuugggaagaggugcccuaccugggaaaacgcgaggaucaguggugcggcucccucaucgggcugaccagccgggcuacaugggccaagaacauucagaccgccaucaaucaagucagaucccugauuggaaacgaagaguauacagacuacaugccuucuaugaaacgguuuagacgcgaagaggaagaggcuggcgugcucugguga

SEQ ID NO: 20139 - RNA, 9876 nt, Artificial Sequence
  derived and/or modified CDS sequence (opt5) from DENV-2__EU482697__SS-prME
agcgccggaaugaucauuaugcugauccccaccgugauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgaugaccgaugacaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagaugcucuggcccuggggaugauggugcuuaaaaucgugagaaauauggaaaaguaccagcuggccgucaccaucauggcuauucucugcguuccuaacgccgugauccugcagaaugcguggaaaguguccuguaccauucucgcugucgugucuguuagcccccugcuucugacauccagccaacagaagacggacuggaucccucucgcccugaccauuaaaggacugaaccccacagccaucuuccuuaccacacugucucgcaccaauaagaaaagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaagugggaggaucaggcugaaauuucuggguccagcccuauccuguccauuacaaucagcgaggacggaucuaugagcauuaaaaacgaagaggaggaacagacccucacaauccugaucagaacgggccuccuggugauuuccgggcuuuuucccaucucuauuccgaucaccgccgcugccugguaccugugggaggucaagaaacaacgggccggagugcugugggauguuccuucucccccucccaugggcaaggcugaacucgaggacggggcguaucgcauuaaacagaagggaauccugggcuacucccagaucggcgccgggguguacagagaaggaacauuccacaccauguggcaugucacacggggcgcugugcuuaugcacaaggggaaacgcauugagcccuccugggccgauguuaagaaagaccugaucagcuauggaggcggguggaagcucgagggagaauggaaagagggcgaagaggugcagguccuggcccucgaaccuggcaagaauccgagagcugugcaaaccaagcccgggcuguuuaaaacgaacaccggaacaauuggcgccgugucccuugauuucucuccugggaccagcggaucccccaucauugacaagaaaggcaagguugucgggcuguacggaaacggcguggugacacggagcggcgcguaugucucugcuaucgcccagaccgagaaauccaucgaggauaauccugaaauugaggacgauaucuuucgcaagagacggcugacaauuauggaccuccaccccggggccggaaagacgaaaagauaccugccugcuaucgugcgcgaagccauuaagcggggccuuagaacccugauccucgcgccgacacgcguuguggcugccgagauggaagaggcccugcgggggcuccccauuagauaucagaccccugcuauccgcgccgagcauaccggacgggaaaucgucgaccugaugugucacgcuacauucacgaugagacuucugagccccgugcgcguuccuaacuacaaucugauuaucauggaugaggcccauuucaccgaccccgcgucuauugccgcucggggcuauaucuccacaagaguggaaaugggggaggccgcuggcauuuuuaugaccgccacaccgccuggaagccgggaucccuucccccaauccaacgccccuaucaucgacgaggaacgcgagauucccgaaagaucuuggaauagcggccacgagugggucaccgauuuuaaagggaagacggugugguucguuccuuccaucaaagcuggaaacgacauugcggccugccuccggaagaauggcaagaaagugauccagcugagccgcaagacauuugauucugaauacgucaaaaccagaaccaacgacugggauuucguggugacaaccgacauuuccgagaugggggcuaauuuuaaggccgagcgggucaucgauccgagacgcuguaugaaacccguuauccuuacagacggagaggaacgggugauucuggccggcccuaugcccgugacccauagcucugcugcccagagacgcgggcggaucggcagaaacccuaagaaugaaaacgaccaguacauuuauaugggagagccccucgaaaaugaugaggacugcgcgcacuggaaagaggcuaagaugcugcuggauaacaucaauacgccggaaggcauuaucccuagcauguucgagcccgaacgcgagaaggucgacgccauugauggggaauaccggcucagaggagaggcccgcaaaacauuuguggaccuuaugagacggggcgaucugccuguuuggcuggcuuauaagguggccgcggaggggaucaacuacgccgaccgcagaugguguuucgauggaaucaaaaacaaucaaauucucgaagagaacgucgaaguggagaucuggaccaaggagggcgaacggaaaaagcugaagccccgcuggcuugacgcuagaauuuauuccgauccucuggcccucaaagaguuuaaggaguucgcugccgggcggaaaucucugacacugaaucucaucaccgagaugggcagacuucccacguucaugacccagaagacacgcgacgcucuggauaaccuggccguucuccacaccgcggaagccggaggccgggcuuacaaucaugcccugagcgagcuuccggagacacuggaaacccuccugcugcucacacuucuggcuaccgugacagggggaauuuuucuguuccucauguccggcagagggaucggaaaaaugacacugggcaugugcugcaucauuaccgccucuauccuucugugguaugcccagauucagccucacuggaucgcugcgagcauuauccucgaguuuuuccugaucguccugcucauucccgaacccgagaagcaacgcaccccucaggacaaccagcuuacauacguggucaucgccauucugaccgugguugcugccacaauggccaaugaaaugggcuuucuggagaagacgaaaaaggaccucgggcugggauccaucgcuacccagcaaccggagagcaacauucuugauaucgaccugcggcccgccucugcguggacacucuacgccguggcuaccacauucgugaccccuaugcugagacauuccauugaaaauagcuccgucaacguuucucugacggccaucgcuaaucaggccaccgugcucaugggccuugggaaaggauggccccugagcaagauggauaucggcgugccucugcucgcgauuggguguuauucccaggucaaccccaucacacugaccgccgcccuucugcuccugguggcccacuacgcuauuaucggaccuggccugcaggccaaagcuacacgggaggcccaaaagcgcgcggccgcuggcauuaugaagaauccgaccguugacgggaucacggugaucgaucucgaccccauuccuuaugaucccaaauuugaaaagcagcuuggacaggucaugcugcugauccucugcgugacacaaguccugaugaugagaaccacaugggcccuuugugaggcucugacccucgccaccggcccuauuucuacacugugggaagggaaccccggacgguucuggaauacgaccaucgccgugagcauggcgaacauuuuucgcggcuccuaccuggcuggggccggacuccuuuucagcaucaugaaaaauacaaccaacacaagacggggcaccggcaacaugggggagacgcugggagagaaguggaaaucucgccugaaugcucucggcaaguccgaauuucagaucuauaaaaagagcgggauucaggagguugacagaacacuggccaaggaaggaaucaaacggggcgagaccgaucaccaugccgugucucgcggguccgcuaaacuuagaugguucgucgagcggaacauggugaccccggaaggaaaaguuguggaccugggcugcggcagagggggauggagcuacuauuguggcgggcucaagaauguccgcgaggugaaaggacugacaaagggcgggccuggacacgaagaacccauucccaugucuaccuacggcuggaaccuggugcggcuccagagcggcguugaugucuuuuucaucccucccgaaaagugcgacacacuucugugugauauuggggaguccucuccuaauccgacgguggaggccggaagaacccugcgcgugcucaaccuggucgaaaauuggcuuaacaauaacacacaauucugcaucaaaguucugaaucccuacaugccuagcgugaucgagaagauggaagcgcuccagcggaaauauggcggggcccuggugagaaacccccugucccgcaauagcacccaugagauguacugggucuccaacgcuucuggaaauauugugagcuccguuaacaugaucucucggaugcucauuaacagauuuacaaugcgccacaagaaagccaccuaugaaccugacguggaccuuggcagcgggacgcggaauaucggaaccgaguccgagauucccaaccuggauaucauuggcaagagaaucgaaaagaucaaacaggagcaugaaacaucuuggcacuacgaccaggaucacccguauaagaccugggcuuaccauggcagcuaugagacaaaacaaaccggguccgccagcucuauggucaauggagugguucgccugcucacaaagccuugggacgugcugcccauggucacccagauggcgaugacggauacaaccccuuucggccagcagcggguguuuaaagaaaagguggacaccagaacacaagagcccaaggaggggacgaagaaacuuaugaaaauuaccgccgaauggcuguggaaagagcucggcaagaagaaaacaccucgcauguguaccagagaagaguucacacggaagguccgcuccaacgcugcccugggcgcuaucuuuaccgaugagaauaaguggaaaagcgccagagaagcuguugaggacucucgguucugggaacugguggauaaggagagaaacuuucaccucgaagggaaaugcgagacauguguguacaauaugaugggaaagcgggagaaaaagcugggcgaguucggcaaggccaaagggucccgcgcgauuugguacauguggcuuggagccagauuucuggaguucgaagcucucggcuuucugaacgaggaccauugguucagccgggaaaauucucuuuccggggucgagggagagggccugcacaagcucggguauauccugcgcgaugugagcaaaaaggaaggcggagccauguacgcugacgacaccgccggcugggauacgagaauuacccuggaggaccucaaaaacgaagagaugguuacaaaucacauggaaggggagcauaagaagcuggccgaggcgaucuuuaaacuuaccuaucagaacaaggugguccgggugcagcgccccacaccgagaggaaccguuauggauaucauuucccggcgcgaccaaagaggcagcgggcaggucggaacguacggccugaauacauucaccaacauggaagcucagcucauccggcagauggagggggaaggcgucuucaaaaauauucaacaccugacagugaccgaggagguugccgugaagaacuggcuugcccgcgucggaagagaacggcugucucgcauggcuaucagcggcgaugacugcguggucaaaccucucgaugacagauuugccaacgcucugacggcccugaaugauauggggaagauucggaaggacauccagcagugggagcccuccaaaggauggaacgauuggacccaggugcccuucugcucucaucacuuucaugaacucaucaugaaggacggcagaguucugguggucccuugucgcaaucaagaugagcuuauugggcgggcgagaaucagccagggagccggcuggucccugcgcgaaacagcuugccucgggaaaucuuaugcccagauguggagccugauguacuuccaccggagagaccuucgccuggcugccaacgcgauuuguuccgccgugccgucucacugggugcccaccagccggacaaccugguccauccaugcuaagcacgaguggaugacaaccgaggacaugcucacgguuuggaauagaguguggauucgcgaaaacccuuggauggaggauaaaacacccgucgaaagcugggaggaaaucccuuaucugggcaagcgggaggaccaguggugcggaucucugauuggccucaccuccagagccaccugggcuaagaauauccaagccgcuaucaaccaggugcgcagccugauugggaaugaggaauacacagauuacaugcccucuaugaaacgguuuagacgggaggaagaggaagccggaguucuuugguga

SEQ ID NO: 20140 - RNA, 9876 nt, Artificial Sequence
  derived and/or modified CDS sequence (opt5) from DENV-2__EU482699__SS-prME
agcgccggcaugaucauuaugcugauccccacagugauggcuuuccaccugacgacgcggaauggggaaccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagccauaaccagacguuccugaucgacggcccugagaccgcggagugccccaauacaaacagagccuggaacucucucgaagucgaggauuauggguuuggaguguucaccacaaacauuuggcugcgccuuaaggaaaaacaggacgcuuuuugugacuccaagcugaugagcgccgcuaucaaggauaaucgggccguucacgcggacaugggcuacuggaucgagucugcccucaacgauaccuggaaaauugagaaggcuuccuucaucgaagugaaaaauugccauuggccuaagagccacacacuguggucuaacggcguccuggagagcgaaaugauuauccccaaaaaccuugccgggccggugucccaacacaauuauagaccuggauaccauacccagauugcuggccccuggcaccucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaccgcggcgaggacggcuguugguaugggauggaaaucagaccccugaaagagaaggaagagaaucucguuaacagccuggugaccgccggacauggccagguggauaauuucucccuggggauccuuggaauggcucucuuucuggaagagaugcugcggacaagagucggcaccaaacacgcgauucuccuggccgcugugucuuucguuacacuuaucaccgggaacaugagcuuuaaggaccugggacgcgugauggucauggugggcgccacgauggccgaugacauuggcauggggguuaccuaccucgcucugcuggccgcguucaaagugcggccuacauuugcugccggacuucugcucagacgccugaccuccaaggagcucaugaugacaaccaucggcauuguccugcuuucucaaagcacgauccccgaaacagugcuggagcucaccgaugcccuggcucuggggaugaugguucuuaagaucgugagaaaaauggaaaaguaucagcuggccgucacaauuauggcgauccucugcgugccuaaugcugugauucugcagaacgccuggaaagucuccuguaccauccucgccguugugucugugagcccccugcuucugaccuccagccagcaaaagacagacuggauuccucucgcucugacgaucaaaggacugaaucccaccgccaucuuccuuacaacccugucucggacaaacaagaaacgcuccuggccgcucaaugaggcuauuauggccgucggcauggugagcauccuggcgucuucccuccugaagaacgacauuccuaugaccgggccccuuguugccggaggccugcugacggugugcuacguccucacaggcagaagcgcugaucuggaacuugagcgggccaccgacgugaagugggaggaucaggcugaaaucucuggguccagcccuauucuguccaucaccauuagcgaggacggaucuaugagcaucaaaaaugaagaggaggaacagacacucaccauccugauucgcacaggccuccugguuaucuccgggcuuuuucccauuucuaucccgauuacggccgccgcuugguaucugugggaggugaagaaacagagagcgggaguccugugggaugugccuucucccccucccgucggcaaggccgaacucgaggacggggcuuaccggaucaaacaaaagggaauccugggcuauucccagauuggcgccgggguguacaaggaaggaaccuuccauacaauguggcacguuacccgcggcgccgugcuuaugcacaaagggaagagaaucgagcccuccugggcugaugucaaaaaggaccugauuagcuacggaggcggguggaaacucgagggagaauggaaggagggcgaagaggugcagguucuggcccucgaaccuggcaagaacccgcgggcggugcagacaaaacccgggcuguuuaagaccaauacgggaaccaucggcgcugucucccuugauuucucuccugggacaagcggaucccccauuaucgacaaaaagggcaaagugguggggcuguauggaaacggcguugucacccgcagcggcgccuacgugucugccaucgcucaaacagagaaguccauugaggauaacccugaaaucgaggacgauauuuuuagaaagcggagacugaccaucauggaccuccaucccggggccggaaaaacaaagcgcuaucugccugcgauugugcgggaagcuaucaaaagaggccuucgcacgcugauucucgccccgacccgggucguggccgcugagauggaagaggcccugagagggcuccccauccgcuaccagaccccugcuauccgggccgagcacaccggaagagaaauuguugaccugaugugucaugcgaccuucacaaugcgccuucugagccccgugcgggucccuaauuauaaccugaucauuauggaugaggcccacuucacggaccccgcuucuaucgccgcuagaggcuacauuuccacccggguggaaaugggggaggccgccggcaucuuuaugacagcuaccccgccuggaagccgcgaucccuucccccaguccaaugcgccuaucauugacgaggaaagagagauccccgaacggucuuggaacagcggccaugaguggguuacagauuuuaaggggaaaaccgugugguucgucccuuccauuaaggccggaaaugacaucgcugccugccuccgcaagaacggcaaaaaggugauucaacugagcagaaaaacguuugauucugaauauguuaagacacggaccaaugacugggauuucguggucaccacagacaucuccgagaugggggccaacuuuaaagcugagagagugaucgauccgcgccgguguaugaagcccgugauucuuaccgacggagaagagagagucauccuggccggcccuaugcccguuacacacagcucugcggcucagcgccgggggagaauuggccgcaauccuaaaaacgaaaaugaccaguacaucuacaugggagagccccucgaaaacgaugaggacugcgcccacuggaaggaggccaagaugcugcuggauaauauuaacaccccggaaggcaucauuccuagcauguucgagcccgaacgggagaaaguggacgcuaucgauggggaauauagacuccgcggagaggccagaaagacguuuguggaccuuaugcggcgcggcgaucugccugucuggcuggcguacaaaguggccgcugaggggaucaauuaugccgacagacggugguguuucgauggaauuaagaacaaccagauccucgaagagaauguugaaguggagauuuggacaaaaggcggggagaagaagaaacugaagccccgcuggcuugacgcuagaaucuacuccgauccucuggcccucaaagaauuuaaggaguucgcugccggccggaaaucucugacccugaaccucauuacagaaaugggaagacuucccaccuucaugacgcaaaagacccgcgacgcgcuggauaaucuggccguccuccauacagcugaggccggcgggcgggcuuauaaccacgcccugagcgaacuuccggagacccuggagacacuccugcugcucacccuucuggccacagugaccggaggcaucuuucuguuccucauguccgggagaggaaucggcaagaugacgcugggcaugugcugcauuaucacagcuucuauucuucugugguacgcgcagauccagccucauuggauugccgcuagcaucauccucgaauuuuuccugauuguucugcucauccccgagcccgaaaaacagcgcaccccucaagacaaucagcuuaccuauguggucauugccauccugacaguggucgccgcuaccauggccaacgagaugggguuucuggaaaagaccaagaaggaccucggacugggcuccauugcgacgcagcagccggagagcaauauccuugauauugaccugcggcccgccucugcuuggacccucuacgccguggcuacaaccuucguuacaccuaugcugagacacuccaucgagaacagcuccgugaaugugucucugaccgccaucgcgaaccaagccacgguccucauggggcuuggaaaaggcuggccccugagcaagauggauauugggguuccucugcucgcuaucggauguuacucccaggugaaucccauuacccugacagccgcccuucugcuccugguggcccacuaugcuaucauuggcccuggccugcaggccaaggcgacccgggaagcccagaaacgcgcugccgcugggaucaugaagaacccgacagucgacggaaucaccgugauugaucucgaccccaucccuuacgaucccaaauuugagaagcaacuuggccagguuaugcugcugauucucugcgugacgcagguccugaugaugagaacaaccugggcccuuugugaagcccugacacucgcgaccgggccuaucucuacccugugggagggaaaucccggccgguucuggaacacaacgauugcugugagcauggccaauaucuuucgcggguccuaucuggcuggagccggccuccuuuucagcaucaugaaaaacaccacaaauaccagacggggcacagggaacaugggagaaacccugggcgagaaguggaaaucucgccugaacgcccucgggaaguccgaguuucaaauuuacaagaaaagcggaauccaggaagucgacagaacgcuggcuaaggagggcauuaaaagaggggaaacagaucaucacgccgugucucgcggauccgcgaaacuuagaugguucguugagcggaauauggugaccccggagggcaaagucguggaccugggcugcgggagaggaggcuggagcuauuacugugggggacucaagaacguucgcgaagugaagggccugaccaaagggggaccuggccaugaggaacccauccccaugucuacauauggcuggaaucugguccggcuccagagcgggguggauguguuuuucauuccucccgagaagugcgacacccuucugugugauaucggagaauccucuccuaacccgacaguugaggccggcagaacgcugcgcguccucaaucugguggagaacuggcuuaauaacaauacccaguucugcaucaaagugcugaaccccuacaugccuagcgucauugaaaagauggaggcucuccaacggaaauacgggggagcccugguuagaaauccccugucccgcaacagcacacacgaaauguauuggguguccaaugcuucuggcaacaucgugagcuccgucaauaugauuucucggaugcucaucaacagauuuaccaugcgccauaagaaggccacauacgagccugacguggaccuugggagcggaacccggaacauuggcaucgaauccgagauucccaaucuggauaucaucggcaaaagaauugagaagaucaaacaggaacacgagacgucuuggcacuaugaccaggaucauccguacaagaccugggcguaucacgggagcuacgaaacaaaacagaccggauccgccagcucuaugguuaacggcgugguccgccugcucacaaagccuugggacgugcugcccaccguuacacaaauggcuaugaccgauacgacaccuuucgggcagcagcggguguuuaaggagaaagucgacaccagaacccaggaacccaaggagggaaccaagaaacuuaugaaaauuacggccgaguggcuguggaaggaacucggcaaaaagaagaccccucgcauguguacaagagaggaguucacccggaaagugcgcuccaaugcugcccugggggcuaucuuuacagaugagaacaaguggaaaagcgccagagaggcgguggaagacucucgguucugggagcuggucgauaaggaaagaaaucuccaucuggagggaaaaugcgaaaccuguguuuauaacaugaugggcaagcgggagaagaaacuuggcgaguuugggaaggccaaaggaucccgcgcuauuugguacauguggcugggcgccagauuccucgaauuugaggcucugggguuccuuaaugaagaccacugguuuagccgggagaacucucuguccggaguggaaggcgaggggcuccacaagcugggcuacauccugcgcgaugugagcaaaaaggagggaggcgccauguaugccgacgacacagcggggugggauaccagaaucacgcucgaagaccugaagaaugaggaaauggucaccaaccauauggagggagaacacaagaaacuugcugaggccauuuucaaacugacauaccaaaauaaagugguucgggugcagcgccccaccccgagaggcacagucauggauaucauuucccggcgcgaccagagagggagcggacaagugggcaccuaugggcucaacacguuuacaaauauggaggcccagcugauccggcagauggaaggcgagggaguuuucaaaaacauucagcaucuuaccgugacagaagaggucgcugugcaaaauuggcuggcccgcguuggcagagagcggcucucucgcauggcuaucagcggggaugacugcguggucaagccucuggaugacagauucgccaacgcgcugaccgcccucaacgauaugggaaagauccggaaagacauucagcagugggaacccuccaagggcuggaaugauuggacacaggugcccuuuugcucucaccauuuccacgagcugaucaugaaagacgggagaguccuugugguuccuugucgcaaccaagaugaacugauuggacgggcuagaaucagccagggcgccggguggucccuccgcgagaccgcuugccugggcaagucuuacgcccagauguggagccuuauguauuuucaccggagagaccugcgccucgcggccaaugcuauuuguuccgccgugccgucucauuggguccccacaagccggaccacaugguccauccacgcuaaacaugaauggaugaccacagaggacaugcugaccguguggaacagaguguggauucgcgagaauccuuggauggaagauaagacgcccguugagagcugggaagagaucccuuaccugggaaagcgggaagaccaguggugcggcucucucaucgggcugacauccagagccaccugggcuaaaaacauucaagccgcgaucaaucaggugcgcagccuuauuggaaacgaggaguauaccgauuacaugcccucuaugaagcgguucagacgggaagaggaagaggccggcguccugugguga

SEQ ID NO: 20141 - RNA, 9876 nt, Artificial Sequence
  derived and/or modified CDS sequence (opt5) from DENV-2__EU482701__SS-prME
agcgcuggaaugaucauuaugcugauccccaccgugauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugaagcaaaacgaacccgaggauaucgacuguuggugcaauucuaccagcacaugggugaccuauggcacguguaccacaaccggggagcaccggagagagaagagauccguggcgcucgucccucaugugggaaugggccuggagacacggaccgaaacguggaugucuagcgagggcgcuuggaagcacgcccagcgcaucgagacauggauucugagacaucccggguucaccaucauggccgcuauucucgccuacacaaucggaaccacccacuuucagcggguucugauuuucauccuucugacagcuguggccccuuccaugacgaugcgcugcauuggcaucucuaacagagauuuugucgaaggggugagcggaggcuccuggguugacaucgugcucgagcacgggagcugugucaccacaauggcgaagaauaaacccacccuggauuucgaacuuauuaagacagaggccaaacagccugcuacccugcggaaguauugcaucgaagccaaacucacgaacacaaccaccgagucucgcuguccgacacaaggagagcccucccugaaggaagaacaagacaagagauuugugugcaaacauagcaugguggaucggggcuggggcaauggguguggacuguucggcaaagggggaauugugaccugcgcuauguuuacaugcaaaaagaacauggaaggcaaaaucguucagccugagaaucucgaauacacgauuguggugacaccccacucuggggaggagcaugccgucggaaacgacacaggcaagcacggcaaagaaaucaaggugaccccucaguccagcaucacagaggcggaacugaccggguauggaacgguuaccauggaguguucuccccgcacaggccuugauuucaaugaaauggugcugcuccaaauggagaacaaggccuggcugguccacagacagugguuucuugaccugccgcucccuuggcugcccggggcugauaaacaggaguccaauuggauucagaaggaaacccuggugacauucaaaaacccucaugccaagaaacaagacguugugguccucggaagccaggagggcgcuaugcacgccgcccugaccggggcuacggaaauccagauguccucuggcaaucuucuguuuacaggacaucucaagugccggcugcgcauggacaaacuucaacugaaaggcaugagcuacuccauguguaccgggaaguucaaaguggucaaggagauugcggagacacagcacggaaccaucgugauuagaguucaguaugaaggcgaugggagccccugcaaaauccccuucgagaucauggaccucgaaaagcgguacgugcugggaagacugauuaccgucaacccuaucgugacagagaaggauucuccgguuaacauugaagccgagcccccuuuuggcgacuccuacaucauuaucgggguggagcccggccagcucaaacugaauugguucaagaaaggaagcucuauuggccaaauguuugaaacgaccaugcgcggggcuaagcggauggccauccuuggagauacagccugggacuucggcagccucgggggagucuuuaccuccaucggcaaagcucuccaucagguguucggggccauuuauggcgcggcuuuuucuggagugagcuggacaaugaagauccugauuggcguuaucauuaccuggaucgggaugaacuccagaagcacgucucuguccgucagccuugugcucgugggaaucgucacacuguaccugggcgugaugguucaggccgauucuggguguguggucuccuggaagaauaaagagcucaagugcggaagcggcauuuucaucaccgacaacgugcacaccuggacagaacaguauaaauuucaaccugagucccccucuaagcuggccagcgcuauucagaaagcccaggaagaggggaucuguggcauucgcuccguuacccggcuugagaaucugauguggaagcagaucacaccggaacucaaccacauccuggcugagaaugaagugaaacugacgauuaugaccggagauaucaagggcauuaugcaagccgggaagagaucucuucgcccucagcccacagagcucaaauacagcuggaagaccuggggaaaagcgaagaugcuguccacagaaagccauaaccagaccuuccugaucgacggcccugagacggccgagugccccaauaccaaccgggcuuggaacucucucgaagucgaggauuauggguuuggaguguucacaaccaacauuuggcugagacuuaaagaaaagcaggacgccuuuugugacuccaagcugaugagcgcugccguuaaagauaaucgcgcggugcacgccgacaugggcuacuggaucgagucugcucucaacgauacauggaagaucgagaaagccuccuucauugaagucaagaauugccauuggccuaaaagccacacccuguggucuaacggcgugcuggagagcgaaauggugauccccaagaaccuugcugggccggucucccaacacaauuaucggccuggauaccauacacagauugccggccccuggcaccucgggaagcuggagauggacuucgauuuuugugacggaaccacgguuaucgugacagaagauugcggcaacagagggcccagccugcgcaccaccacagccucuggaaaacucauuaccgaguggugcugucgguccugcacgcugccuccgcuuagauaccggggcgaggacggcuguugguaugggauggaaauccgcccccugaaggagaaagaagagaaucucgugaacagccuggucacagcuggacauggccagguggauaauuucucccuggggauucuuggaauggcgcucuuucuggaagagaugcugagaacccggguuggcacaaagcacgccauccuccugguggcugucucuuucgugacccuuaucacagggaacaugagcuuuaaagaccugggaagaguuguggucauggugggcgccaccauggccgaugacauuggcauggggguuacguaccucgcucugcuggccgcguucaaggugcgcccuaccuuugcugccggacuucugcuccggaagcugacauccaaagagcucaugaugaccacaaucggcgucgugcugcuuucucaaagcaccauucccgauacggugcuggaacucacagacgcccuggcucuggggaugaugguccuuaagaucguuagaaauauggagaaauaucagcuggccgugaccauuauggcgauccucugcgugccuaacgcugucauccugcagaaugccuggaagguguccuguacaauucucgccguugugucugucagcccccugcuucugaccuccagccagcagaagaccgacuggaucccucucgcucugacaauuaagggacugaaccccacggccaucuuccuuaccacacugucucgcaccaauaaaaagagauccuggccgcucaacgaagcuauuauggccgugggcaugguuagcauccuggcgucuucccuccugaagaaugauaucccuaugacagggccccuuguggccggaggccugcugaccgucugcuacgugcucacgggccggagcgcugaccuggagcuugaacgcgccacagaugucaaaugggaggaccaggcugagauuucuggguccagcccuauccuguccauuaccaucagcgaagauggaucuaugagcauuaagaacgaggaagaggagcagacccucacaauccugauuagaaccggccuccuggugaucuccgggcuuuuucccaucucuauuccgaucacagccgccgcuugguaucugugggaaguuaaaaagcagcgggcgggagugcugugggacgucccuucucccccucccaugggcaaagccgagcucgaagauggggcuuaccgcauuaagcaaaagggaauccugggcuauucccagauuggcgccgggguguacaaagagggaacguuccauaccauguggcacguuacaagaggcgccgugcuuaugcacaaggggaaacggaucgaacccuccugggcugacgucaagaaagaucugaucagcuacggaggcggguggaagcucgagggagaguggaaggaaggcgaggaaguccaggugcuggcccucgagccuggcaaaaauccgcgcgcgguucagaccaagcccgggcuguuuaaaacaaacaccggaacgauuggcgcugucucccuugacuucucuccugggaccagcggaucccccaucauugauaagaaaggcaaggugguggggcuguauggaaacggcgucgugacaagaagcggcgccuacguuucugccaucgcucaaaccgaaaaguccauugaggacaauccugagaucgaagaugacaucuuucggaaacgcagacugacaauuauggaccuccaucccggggccggaaagaccaaacgguaucugccugcgaucgugagagaggcuauuaagcgcggccuucggacacugauccucgccccgacgagagucguggccgcugaaauggaggaagcccugcgcgggcuccccauucgguaccagaccccugcuaucagagccgagcacacaggacgcgagauuguugaucugaugugucaugcgaccuucaccaugcggcuucugagccccgugagagucccuaacuauaaucugaucaucauggacgaagcccacuucacagaucccgcuucuauugccgcucgcggcuacaucuccacgcggguggagaugggggaagccgccggcauuuuuaugaccgcuacaccgccuggaagcagagaccccuucccccaguccaacgcgccuaucauugaugaggagcgggaaauccccgagcgcucuuggaauagcggccaugaauggguuaccgacuuuaaagggaagacagugugguucgucccuuccaucaaggccggaaacgauauugcugccugccuccgcaagaauggcaagaaagugauccaacugagccggaagaccuuugacucugaguaugugaaaacgcgcacaaacgauugggacuucgucguuaccaccgauauuuccgaaaugggggccaauuuuaaggcugagagagugaucgacccgcggagauguaugaaacccgugauucuuacagacggagaggaacgcgucauccuggccggcccuaugcccgugacccacagcucugcggcucagcggagagggcgcaucggccggaacccuaagaaugagaacgaucaguacauuuacaugggagaaccccucgagaaugacgaagauugcgcccacuggaaggaggccaaaaugcugcuggacaacaucaauacaccggagggcauuaucccuagcauguucgaacccgagagagaaaagguugaugcuauugacggggaguaucgccuccggggagaagccagaaaaaccuuuguggaucuuaugcgcagaggcgaccugccugucuggcuggcguacaagguggccgcugaggggaucaacuaugccgaucggcgcugguguuucgacggaauuaaaaacaaucagauccucgaggaaaacguugagguggaaaucuggacgaaggagggcgagagaaagaaacugaagccccgguggcuugaugcucgcauuuacuccgacccucuggcccucaaagaauuuaaggaguucgcugccgggagaaaaucucugacacugaaucucaucaccgaaaugggccggcuucccacauucaugacccaaaagacgagagaugcgcuggacaaccuggccguccuccauaccgcugaggccggaggccgcgcuuauaaucacgcccugagcgaacuuccggagacacuggagacccuccugcugcucacacuucuggccaccgugacagggggaauuuuucuguuccucauguccggccgggggaucggaaagaugacccugggcaugugcugcauuaucacggcuucuauccuucugugguacgcgcagauucagccucauuggaucgccgcuagcauuauccucgaauuuuuccugauuguccugcucauccccgagcccgaaaaacagagaacaccucaagacaaccagcuuaccuaugugguuaucgccauucugaccgugguggccgcuacaauggccaaugagaugggcuuucuggaaaagaccaaaaaggaucucgggcugggauccaucgcgacacagcagccggagagcaacauucuugacaucgaucugcgccccgccucugcuuggacgcucuacgccgucgcuaccacauucguuaccccuaugcugcggcacuccauugagaauagcuccgugaacgugucucugacagccaucgcgaaucaagccaccguccucaugggccuugggaaaggauggccccugagcaagauggacauuggcgugccucugcucgcuaucggguguuacucccagguuaaccccaucacgcugaccgccgcccuucugcuccugguggcccacuaugcuauuaucggaccuggccugcaggccaaggcgacaagagaagcccagaaacgggcugccgcuggcauuaugaagaauccgaccgucgaugggaucacagugauugaccucgaucccaucccuuacgaccccaaauuugagaagcaacuuggacaggucaugcugcugauccucugcgugacccagguucugaugaugcgcacgacaugggcccuuugugaagcccugacccucgcgacaggcccuauuucuacccugugggaggggaaccccggaagauucuggaauaccacaaucgcugugagcauggccaacauuuuucggggcuccuaucuggcuggggccggacuccuuuucagcaucaugaaaaauacgaccaacacacgcagaggcaccggcaacaugggggaaacacugggagagaaguggaaaucucggcugaaugcccucggcaaguccgaguuucaaauuuacaagaaaagcgggauccaggaagucgaucgcacccuggcuaaggagggaaucaaaagaggcgaaacggaccaucacgccgugucucggggguccgcgaaacuucgcugguucguugagagaaacauggugacaccggagggaaaagucguggaucugggcugcggcagagggggauggagcuauuacuguggcgggcucaagaaugugcgggaaguuaagggacugaccaaaggcgggccuggacaugaggaacccauucccaugucuaccuauggcuggaaccugguccgccuccagagcggcguggacguguuuuucaucccucccgagaagugcgauacacuucugugugacauuggggaauccucuccuaauccgaccgucgaggccggacggacacugagaguucucaaccugguggagaauuggcuuaacaauaacacgcaguucugcaucaaagugcugaaucccuacaugccuagcgucauugaaaagauggaggcucuccaacgcaaauacggcggggcccuggugcggaacccccuguccagaaauagcacccacgaaauguauuggguuuccaacgcuucuggaaauaucgugagcuccgucaacaugaucucucgcaugcucauuaaccgguuuacaaugagacauaagaaggccaccuacgagccugacguggaucuuggcagcgggacacgcaauaucggaauugaauccgagauccccaaccuggacauuaucggcaaacggauugagaagaucaaacaggaacacgagaccucuuggcacuaugaucaggaccauccguacaagacgugggcguaucacggcagcuacgaaaccaaacagacaggguccgccagcucuaugguuaauggaguggucagacugcucaccaagccuugggaugugcugcccacagugacccaaauggcuaugacagacaccacgccuuucggccagcagcgcgucuuuaaggagaaaguugauacacggacccaggaacccaaggaggggaccaagaaacuuaugaaaaucacagccgaguggcuguggaaagaacucggcaagaagaagacgccuagaauguguacccgcgaggaguucacaagaaaagugcgguccaacgcugcccugggcgcuauuuuuaccgacgagaauaaguggaaaagcgcccgcgaggcgguggaagauucuagauucugggagcuggucgacaaggaacggaaccuccaucuggaggggaaaugcgaaacauguguguauaauaugaugggaaagagagagaagaaacuuggcgaguuuggcaaggccaaagggucccgggcuaucugguacauguggcugggagcccgcuuccucgaauuugaggcucugggcuuccuuaacgaagaucacugguuuagcagagaaaauucucuguccgggguugaaggagagggccuccacaagcugggguacauucugcgggacgugagcaaaaaggagggcggagccauguaugccgacgauaccgcgggcugggacacacgcaucacccucgaagaucugaagaacgaggaaauggucacgaaucauauggagggggaacacaagaaacuugcugaggccauuuucaaacugaccuaccaaaacaaagugguuagagugcagcggcccacaccgcgcggaaccgucauggacaucaucuccagacgggaucagcgcggcagcgggcaagugggaacauauggccucaauaccuuuacgaacauggaggcccagcugauuagacagauggaaggggagggcguuuucaaaaauauccagcaucuuacagugaccgaagaggucgcugugcaaaacuggcuggcccgggucggacgcgagagacucucucggauggcuauuagcggcgacgauugcgugguuaagccucuggacgaucgcuucgccaacgcgcugacagcccucaaugacauggggaagaucagaaaagauauucagcagugggaacccuccaagggauggaacgacuggacccaggugcccuuuugcucucaccauuuccacgagcugaucaugaaagauggccggguccuuguggugccuuguagaaaucaagacgaacugaucgggcgcgcucggauuagccagggagccggcuggucccucagagagacggcuugccuggggaagucuuacgcccagauguggagccuuauguauuuucaccgccgggaccugagacucgcggccaacgcuaucuguuccgccguuccgucucauugggugcccaccagccgcacaaccugguccauucacgcuaaacaugaauggaugacaaccgaggauaugcugacagucuggaaucggguguggaucagagagaacccuuggauggaagacaagacccccguugagagcugggaagagauuccuuaccugggcaagcgcgaagaucaguggugcggaucucucaucggccugacgucccgggccacaugggcuaaaaauauucaagccgcgaucaaccaggugagaagccuuaucgggaaugaggaguauaccgacuacaugcccucuaugaagcgcuuccggagagaagaggaagaggccggaguccugugguga

SEQ ID NO: 20142 - RNA, 9876 nt, Artificial Sequence
  derived and/or modified CDS sequence (opt5) from DENV-2__EU482703__SS-prME
agcgccggaaugaucauuaugcugauccccacagugauggcuuuccaccugacgacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaaugaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuuccuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaaggugggauguaccauucucgccgucguguccguuucuccccugcuucugaccagcucccagcagaagaccgacuggaucccucucgcccugacgauuaagggccugaaccccaccgcuaucuuccuuacaacccugagccgcacaaauaaaaagagaucuuggccgcucaacgaggccaucauggcuguggggauggucuccauucuggccagcucucuccugaagaaugacaucccuaugaccggaccccuuguggcgggcggccugcugacgguuugcuaugugcucacagggcgguccgccgaucuggaacuugagcgcgcuaccgacgucaaaugggaggaucaggccgaaauuagcggaucuuccccuauccugagcauuaccaucuccgaggacggcagcaugucuauuaagaacgaagaggaggaacagacacucaccauccugaucagaacagggcuccuggugauuagcggacuuuuucccaucuccauuccgaucacggcugccgccugguaccugugggaggucaaaaagcagcgggcuggcgugcugugggauguuccuucucccccucccauggggaaagcggaacucgaggacggagccuaucgcauuaagcaaaagggcauccugggcuacagccagaucggggcuggaguguacaaagaaggcaccuuccacacaauguggcaugucaccagaggggccgugcuuaugcacaagggaaaacggauugagcccuccugggccgauguuaagaaagaccugaucucuuauggcgggggauggaagcucgagggcgaauggaaggagggcgaagaggugcagguccuggcucucgaaccugggaaaaauccgcgcgccgugcagacaaagcccggacuguuuaaaaccaacacgggcaccauuggggcggugagccuugauuucuccccuggaacaucuggcagccccaucauugacaagaaagggaagguugucggacuguacggcaacggcguggugaccagauccggggcuuaugucagcgccaucgcccaaacagagaagucuaucgaggauaauccugaaauugaggacgauaucuuucggaaacgcagacugaccauuauggaccuccaccccggagcuggcaagacaaaacgguaccugccugccaucgugagagaagcgauuaagcgcgggcuucggacgcugauccucgcuccgaccagaguuguggccgccgagauggaagaggcucugcgcggacuccccauucgguaucagaccccugccaucagagcugagcauaccggccgcgaaaucgucgaccugaugugucacgccaccuucacaaugcggcuucugucccccgugagaguuccuaacuacaaucugauuaucauggaugaggcgcauuucacggaccccgccagcauugcugcccgcggguauaucucuacccggguggaaaugggcgaggcugccggaauuuuuaugacagccaccccgccuggcuccagagaucccuucccccagagcaacgcuccuaucaucgacgaggaacgggagauucccgaacgcuccuggaacucugggcacgagugggucacagauuuuaaaggaaagaccgugugguucguuccuagcaucaaggcgggcaacgacauugccgcuugccuccgcaaaaaugggaagaaagugauccaacugucccggaagacguuugauagcgaauacgucaaaacacgcaccaacgacugggauuucguggugaccacagacauuucugagaugggagccaauuuuaaggccgagagagucaucgauccgcggagauguaugaaacccguuauccuuaccgacggcgaggaacgcgugauucuggcugggccuaugcccgugacacauuccagcgccgcgcagcggagaggccgcaucggacggaacccuaagaaugaaaacgaccaguacauuuauaugggcgagccccucgaaaaugaugaggacugcgcucacuggaaggaggccaaaaugcugcuggauaacaucaauaccccggaagggauuaucccuucuauguucgagcccgaaagagagaaggucgacgccauugauggagaauaccgccuccggggcgaggcuagaaaaacguuuguggaccuuaugcgcagaggggaucugccuguuuggcuggccuauaagguggcggccgagggaaucaacuacgcugaccggcgcugguguuucgauggcaucaaaaacaaucagauucucgaagagaacgucgaaguggagaucuggacaaaggagggggaaagaaagaaacugaagccccgguggcuugacgcccgcauuuauagcgauccucuggcucucaaagaguuuaaggaguucgccgcuggcagaaaaucccugacccugaaucucaucacagagaugggacggcuucccaccuucaugacgcaaaagaccagagacgcccuggauaaccuggcgguucuccacacagccgaagcuggcgggcgcgccuacaaucaugcucugucugagcuuccggagacccuggaaacacuccugcugcucacccuucuggccacagugaccggaggcauuuuucuguuccucaugagcgggcggggaaucggcaagaugacgcugggcaugugcugcaucauuacagccuccauccuucugugguaugcucagauucagccucacuggaucgcggccucuauuauccucgaguuuuuccugaucguccugcucauucccgaacccgagaaacagagaaccccucaagacaaccagcuuaccuacguggucaucgcuauucugacagugguugccgccaccauggcuaaugaaaugggguuucuggagaagaccaaaaaggaccucggacugggcagcaucgccacgcagcagccggaguccaacauucuugauaucgaccugcgccccgcgagcgccuggacccucuacgcuguggccacaaccuucgugacaccuaugcugcggcauucuauugaaaauuccagcgucaacguuucccugaccgcuaucgccaaucaagcgacggugcucauggggcuuggaaaaggcuggccccugucuaagauggauaucggggugccucugcucgccauuggauguuauagccaggucaaccccaucacccugacagcugcccuucugcuccugguggcucacuacgccauuaucggcccuggccugcaggcuaaggccaccagagaggcgcagaaacgggccgcugccgggauuaugaagaauccgacaguugacggaaucaccgugaucgaucucgaccccauuccuuaugaucccaaauuugaaaagcaacuuggccaggucaugcugcugauccucugcgugacgcagguccugaugaugcgcacaaccugggcucuuugugaggcccugacacucgccaccgggccuauuuccacccugugggaaggaaaccccggcagauucuggaauacaacgaucgcggugucuauggcuaacauuuuucgggggagcuaccuggccggagcuggccuccuuuucuccaucaugaaaaauaccacaaacacccgcagaggcacagggaacaugggagagacccugggcgagaaguggaaaagccggcugaaugcccucgggaagucugaauuucaaaucuauaagcgcuccggcauucaggagguugacagaacgcuggccaaagaaggcaucaagcgcggggaaacagaucaccaugcugugagccggggaucugccaaacuuagaugguucgucgagcggaacauggugaccccggaaggcaagguuguggaccugggcugcgggagaggaggcugguccuacuauugugggggacucaaaaauguccgcgaggugaagggccugaccaaagggggaccuggccacgaagaacccauucccaugagcacauacggcuggaaccuggugcggcuccagucugggguugaugucuuuuucaucccucccgaaaaaugcgacacccuucugugugauauuggagagagcuccccuaauccgacaguggaggcgggcagaacgcugcgcgugcucaaccuggucgaaaauuggcuuaacaauaacacccaguucugcaucaagguucugaaucccuacaugccuucugugaucgagaaaauggaagcccuccaacggaaguaugggggagcucuggugagaaacccccugagccgcaauuccacacaugagauguacugggucagcaacgccuccggcaauauugugucuagcguuaacaugaucucccggaugcucauuaacagauuuaccaugcgccacaaaaaggcuacauaugaaccugacguggaccuugggucuggaacccggaauaucggcauugagagcgagauccccaaccuggauauuaucggcaagagaaucgagaaaauuaagcaggagcaugaaacguccuggcacuacgaccaggaucacccguauaaaaccugggccuaccaugggucuuaugagacaaagcagaccggaagcgcguccagcauggucaauggcgugguucgccugcucacaaaaccuugggacgugcugcccaccgucacacaaauggccaugaccgauacgacaccuuucgggcagcagcggguguuuaaggaaaagguggacaccagaacccaggagcccaaagagggaacaaagaaacuuaugaagaucacggcugaauggcuguggaaagagcucggcaagaaaaagaccccucgcauguguacaagagaagaguucaccaagaaaguccggucuaacgccgcucugggggccauuuuuacagaugagaauaaguggaaauccgcucgcgaagccguugaggacagcagauucugggaacugguggauaaggagcggaaccuccaccuggaaggaaaaugcgagaccuguguguacaauaugaugggcaagagagagaagaaacuuggcgaauuugggaaggcgaaaggaucucgggccaucugguacauguggcugggcgcucgcuuccucgaguuugaagcccugggguuccuuaacgaggaccauugguuuuccagagaaaauagccugucuggagucgagggcgaggggcuccacaagcugggcuauauucugcgggauguguccaaaaaggaaggaggcgcuauguacgccgacgacacagccgggugggauacccgcaucacgcucgaggaccugaagaacgaagagaugguuaccaaucacaugaaaggagaacauaagaaacuugcggaggcuaucuucaagcugacauaucaaaacaaaguggucagagugcagcggcccaccccgcgcggcacaguuauggauauuaucagcagacgggaccagcgcggguccggacaagugggcaccuacgggcucaauacguuuacaaacauggaggcccagcugauuagacagauggaaggcgagggagucuucaagaauauccagcaccuuaccgugacagaagagguugccgugcaaaacuggcuggcucgggucggccgcgagagacucagccggauggccauuucuggggaugacugcguggucaagccucuggaugaccgcuucgcuaacgcccugaccgcgcucaaugauaugggaaaaaucagaaaggacauccagcagugggaacccagcaaaggcuggaacgauuggacacaggugcccuuuugcucccaucacuuccaugagcugauuaugaaggacgggcggguucuuguggucccuuguagaaaucaagaugaacugaucggacgcgcccggauuucucagggcgcuggguggagccucagagagaccgccugccugggcaaauccuaugcucagauguggucucuuauguacuuucaccgccgggaccugagacucgccgcgaacgccaucuguagcgcugugccgucccacugggugcccacaucucgcaccacauggagcauucaugccaagcacgaauggaugaccacagaggacaugcugaccguuuggaaucggguguggaucagagagaacccuuggauggaagauaagacgcccgucgaguccugggaagagauuccuuaucugggaaaacgcgaagaccaguggugcggcagccucaucgggcugacaucucgggcuaccugggccaagaauauccaagcugccauuaaccaggugagaucccuuaucggaaaugaggaguacaccgauuacaugcccagcaugaaacgcuuccggagagaagaggaagaggcgggcguucugugguga

SEQ ID NO: 20143 - RNA, 9876 nt, Artificial Sequence
  derived and/or modified CDS sequence (opt5) from DENV-2__EU482705__SS-prME
agcgccggcaugaucauuaugcugauccccaccgucauggcuuuccaccugacgacgagaaauggggaaccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcgccaccauggcugauaauaucggcaugggggugacauaucucgcccugcuggccgcuuucaagguucgcccuaccuuugccgcgggacuucugcuccggagacugacauccaaggagcucaugaugaccacgauuggcaucgugcugcuuucucaaagcacaauucccgaaaccguccuggagcucacagacgcucuggcccuggggaugauggugcuuaaaaucgugcgcaacauggaaaaguaccagcuggccgucaccaucauggcuauucucugcguuccuaaugccgugauccugcagaacgcguggaaaguguccuguaccauucucgcugucgugucuguuagcccccugcuucugacauccagccagcaaaagacggauuggaucccucucgcccugaccauuaaaggacugaaucccacagccaucuuccuuaccacacugucuagaaccaacaagaaacgguccuggccgcucaaugaggcuaucauggccgugggcauggucagcauucuggcuucuucccuccugaagaacgacaucccuaugacggggccccuuguggccggaggccugcugacaguuugcuaugugcucaccggccgcagcgcggaccuggaacuugagagagccaccgaugucaagugggaggaccaggcugaaauuucuggguccagcccuauccuguccauuacaaucagcgaggauggaucuaugagcauuaaaaaugaagaggaggaacagacccucacaauccugauccggacgggccuccuggugauuuccgggcuuuuucccaucucuauuccgaucaccgccgcugccugguaccugugggaggucaagaaacagcgcgccggagugcugugggacguuccuucucccccucccaugggcaaggcugaacucgaggauggggcguauagaauuaaacaaaagggaauccugggcuacucccagaucggcgccgggguguacaaggaaggaacauuccacaccauguggcaugucacacggggcgcugugcuuaugcacaaagggaagcgcauugagcccuccugggccgacguuaaaaaggaucugaucagcuauggaggcggguggaaacucgagggagaauggaaggagggcgaagaggugcagguccuggcccucgaaccuggcaagaacccgagagcugugcagaccaaacccgggcuguuuaagacgaacaccggaacaauuggcgccgugucccuugacuucucuccugggaccagcggaucccccaucauugauaaaaagggcaaaguugucgggcuguacggaaauggcguggugacacggagcggcgcguaugucucugcuaucgcccaaaccgagaaguccaucgaggacaacccugaaauugaggaugacaucuuucgcaagagacggcugacaauuauggaucuccaccccggggccggaaaaacgaagagauaccugccugcuaucgugcgcgaagccauuaaacggggccuuagaacccugauccucgcgccgacacgcguuguggcugccgagauggaagaggcccugcgggggcuccccauuagauaucagaccccugcuauccgcgccgagcauaccggacgggaaaucgucgaccugaugugucacgcuacauucacgaugagacuucugagccccgugcgcguuccuaauuacaaccugauuaucauggacgaggcccauuucaccgaucccgcgucuauugccgcucggggcuauaucuccacaagaguggaaaugggggaggccgcuggcauuuuuaugaccgccacaccgccuggaagccgggaccccuucccccaguccaaugccccuaucaucgaugaggaacgcgagauucccgaaagaucuuggaacagcggccacgagugggucaccgacuuuaaggggaaaacggugugguucguuccuuccaucaaggcuggaaaugauauugcggccugccuccggaagaacggcaaaaaggugauccaacugagccgcaaaacauuugacucugaauacgucaagaccagaaccaaugauugggacuucguggugacaaccgauauuuccgagaugggggcuaacuuuaaagccgagcgggucaucgacccgagacgcuguaugaagcccguuauccuuacagauggagaggaacgggugauucuggccggcccuaugcccgugacccauagcucugcugcccagagacgcgggcggaucggcagaaauccuaaaaacgaaaaugaccaguacauuuauaugggagagccccucgaaaacgacgaggauugcgcgcacuggaaggaggcuaagaugcugcuggacaauaucaacacgccggaaggcauuaucccuagcauguucgagcccgaacgcgagaaagucgaugccauugacggggaauaccggcucagaggagaggcccgcaagacauuuguggaucuuaugagacggggcgaccugccuguuuggcuggcuuauaaaguggccgcggaggggaucaacuacgccgaucgcagaugguguuucgacggaaucaagaauaaccagauucucgaagagaaugucgaaguggagaucuggaccaaagagggcgaacggaagaagcugaaaccccgcuggcuugaugcuagaauuuauuccgacccucuggcccucaaggaguuuaaagaguucgcugccgggcggaagucucugacacugaaccucaucaccgagaugggcagacuucccacguucaugacccagaagacccgcgaugcucuggacaaucuggccguucuccacaccgcggaagccggaggccgggcuuacaaccaugcccugagcgagcuuccggagacacuggaaacccuccugcugcucacacuucuggcuaccgugacagggggaauuuuucuguuccucauguccggcagagggaucggaaagaugacacugggcaugugcugcaucauuaccgccucuauccuucugugguaugcccagauucagccucacuggaucgcugcgagcauuauccucgaguuuuuccugaucguccugcucauucccgaacccgagaagcagcgcaccccucaagauaaucagcuuacauacguggucaucgccauucugaccgugguugcugccacaauggccaacgaaaugggcuuucuggagaaaacgaagaaagaccucgggcugggauccaucgcuacccagcagccggagagcaauauucuugacaucgaucugcggcccgccucugcguggacacucuacgccguggcuaccacauucgugaccccuaugcugagacauuccauugaaaacagcuccgucaauguuucucugacggccaucgcuaaccaagccaccgugcucaugggccuugggaagggauggccccugagcaaaauggacaucggcgugccucugcucgcgauuggguguuauucccaggucaaucccaucacacugaccgccgcccuucugcuccugguggcccacuacgcuauuaucggaccuggccugcaggccaaggcuacacgggaggcccagaagcgcgcggccgcuggcauuaugaaaaacccgaccguugaugggaucacggugaucgaccucgaucccauuccuuaugaccccaaguuugaaaaacaacuuggacaggucaugcugcugauccucugcgugacacagguccugaugaugagaaccacaugggcccuuugugaggcucugacccucgccaccggcccuauuucuacacugugggaagggaaucccggacgguucuggaacacgaccaucgccgugagcauggcgaauauuuuucgcggcuccuaccuggcuggggccggacuccuuuucagcaucaugaagaacacaaccaacacaagacggggcaccggcaauaucggggagacgcugggagagaaauggaagucucgccugaacgcucucggcaaauccgaauuucaaauuuauaaaaagagcgggauccaggagguugauagaacacuggccaaagaaggaauuaagcggggcgagaccgaccaccaugccgugucucgcggguccgcuaaacuuagaugguucgucgagcggaauauggugaccccggaaggaaagguuguggaucugggcugcggcagagggggauggagcuacuauuguggcgggcucaaaaacguccgcgaggugaagggacugacaaagggcgggccuggacacgaagaacccauccccaugucuaccuacggcuggaaucuggugcggcuccagagcggcguugacgucuuuuucauuccucccgaaaaaugcgauacacuucugugugacaucggggaguccucuccuaacccgacgguggaggccggaagaacccugcgcgugcucaaucuggucgaaaacuggcuuaauaacaauacacaguucugcaucaagguucugaaccccuacaugccuagcgugauugagaaaauggaagcgcuccaacggaaguauggcggggcccuggugagaaauccccugucccgcaacagcacccaugagauguacugggucuccaaugcuucuggaaacaucgugagcuccguuaacaugauuucucggaugcucaucaauagauuuacaaugcgccacaaaaaggccaccuaugaaccugauguggaccuuggcagcgggacgcggaacauuggaaucgaguccgagauucccaaucuggacaucaucggcaagagaauugagaagaucaagcaggagcaugaaaccucuuggcacuacgaucaggaccacccguauaaaacaugggcuuaccauggcagcuaugagaccaagcagacaggguccgccagcucuauggucaacggagugguucgccugcucaccaaaccuugggaugugcugcccacagucacccaaauggcgaugacggacacaaccccuuucggccagcagcggguguuuaaggaaaagguggauaccagaacacaggagcccaaagaggggacgaagaaacuuaugaagauuaccgccgaauggcuguggaaagagcucggaaagaaaaagacaccucgcauguguaccagagaagaguucacacggaagguccgcuccaaugcugcccugggcgcuaucuuuaccgacgagaacaaauggaaaagcgccagagaagcuguugaggauucucgguucugggaacugguggacaaagagagaaaucuccaccuggaagggaagugcgagacauguguguacaacaugaugggaaaacgggagaagaaacuuggcgaauuuggcaaagccaaggggucccgcgcgauuugguacauguggcugggagccagauuccucgaguuugaagcucugggcuuccuuaaugaggaucauugguuuagccgggaaaacucucuguccggggucgagggagagggccuccacaaacugggguauauccugcgcgacgugagcaagaaagaaggcggagccauguacgcugaugacaccgccggcugggacacgagaaucacccucgaggaucugaagaaugaagagaugguuacaaaccacauggaaggggagcauaagcggcuugccgaggcgauuuucaaacugaccuaucaaaauaaggugguccgcgugcagagacccacaccgcggggaaccguuauggacaucauuucccgcagagaucagcggggcagcgggcaagugggaacguacggccucaacacauuuaccaauauggaagcucagcugauccgccagauggagggggaaggcgucuucaaaaacauucagcaccuuacagugaccgaggagguugccgugcaaaacuggcuggccagagucggacgggaacgccucucuagaauggcuaucagcggcgacgauugcguggucaagccucuggacgaucgguucgccaaugcucugacggcccucaacgacauggggaaaaucagaaaggauauucagcagugggagcccuccaagggauggaaugacuggacccaggugcccuuuugcucucaucacuuccaugaacugaucaugaaagauggccgcguucuuguggucccuugucggaaccaagacgagcugauugggagagcgcgcaucagccagggagccggcuggucccuccgggaaacagcuugccuggggaagucuuaugcccagauguggagccuuauguacuuucacagacgcgaucugcggcucgcugccaaugcgauuuguuccgccgugccgucucacugggugcccaccagcagaacaaccugguccauccaugcuaaacacgaguggaugacaaccgaggacaugcugacgguuuggaaccgcguguggauucgggaaaauccuuggauggaggacaagacacccgucgaaagcugggaggaaaucccuuaucugggcaaaagagaggaucaguggugcggaucucucaucggccugaccucccgcgccaccugggcuaagaacauucaagccgcuaucaaucaggugcggagccuuauugggaacgaggaauacacagacuacaugcccucuaugaagagauuccggagagaggaagaggaagccggaguucugugguga

SEQ ID NO: 20144 - RNA, 9876 nt, Artificial Sequence
  derived and/or modified CDS sequence (opt5) from DENV-2__EU482463__SS-prME
uccgccggaaugaucauuaugcugauccccaccgugauggcuuuccaccucacgacgagaaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcguucugauuuucauccuucugacagcuguggccccuucuaugacgaugagaugcauuggaaucagcaaccgggauuuugucgaaggcguguccgggggaagcuggguugacaucgugcucgagcacggcucuugugucaccacaauggcgaagaauaagcccacccuggauuucgaacuuauuaaaacagaggccaagcagccugcuacccugcgcaaauauugcaucgaagccaagcucacgaacacaaccaccgaguccagauguccgacacaaggggagcccagccugaaagaagaacaagacaagcgguuugugugcaagcauucuaugguggaucgcggauggggcaauggcugugggcuguucggaaaaggcgggauugucacaugcgcuauguuuacaugcaagaaaaacauggaaggaaagaucguucagccugagaaucucgaauacacgauuguggugacaccccacuccggcgaggagcaugccgucgggaacgacacaggaaaacacggcaaggaaaucaaagugaccccucagagcucuaucacagaggcggaacugaccggcuaugggacgguuaccauggaguguucccccagaacaggacuugauuucaaugaaauggugcugcuccaaauggagaacaaggccuggcugguccaccggcagugguuucuugaccugccgcucccuuggcugcccggcgcugauaagcaggagagcaauuggauucagaaagaaacccuggugacauucaagaacccucaugccaaaaagcaagacguugugguccucgggucccaggagggagcuaugcacaccgcccugacgggcgccacagaaauccagaugucuagcgggaaucuucuguuuaccggccaucucaaaugccgccugagaauggacaaacuucaacugaagggaauguccuacagcauguguacaggcaaauucaagguggucaaagagauugcugagacccagcacgggaccaucgugauucggguucaguaugaaggagauggcucucccugcaagauccccuucgagaucauggaccucgagaagagauacgugcuggggcgccugauuacagucaacccuaucgugacggagaaggauuccccgguuaacauugaagcggagcccccuuuuggagacagcuacaucauuaucggcguggagcccgggcagcucaagcugaauugguucaaaaagggcucuagcauuggacaaauguuugaaaccacaaugcggggcgccaaaagaauggcuauccuuggggauaccgccugggacuucggaucccugggcggggucuuuacaucuaucggaaaggcccuccaucagguguucggcgcuauuuauggggccgcguuuagcggcguguccuggaccaugaaaauccugauuggaguuaucauuacguggaucggcaugaacagccgcucuacaucccugagcgucucucuugugcucguggggaucgucacccuguaccugggagugaugguucaggcugauuccggcuguguggucagcuggaagaauaaggagcucaaaugcggguccggaauuuucaucaccgacaacgugcacacauggaccgaacaguauaaguuucaaccugagucucccagcaaacuggccuccgccauucagaaggcucaggaagagggcaucugugggauucggucuguuacaagacuugagaaucugauguggaaacagaucacgccggaacucaaccacauccuggccgagaaugaagugaagcugaccauuaugacaggcgauauccgcggaauuaugcaagcuggcaaacggagccuuagaccucagcccaccgagcucaaguacuccuggaagacaugggggaaagccaagaugcugagcaccgaaucuuauaaccagacguuccugaucgacggaccugagaccgcggagugccccaauacaaaccgcgccuggaacucccucgaagucgaggauuacggcuuugggguguucaccacaaacauuuggcugaaacuuaaggaaaaacaggacgcuuuuugugacagcaagcugaugucugccgcuaucaaggauaaucgggccguucaugcggacaugggauauuggaucgaguccgcccucaacgauaccuggaaaauugagaaggcuagcuucaucgaagugaaaaauugccacuggccuaagucucauacacuguggagcaacggcguccuggaguccgaaaugauuauccccaaaaaccuugccggcccggugagccaacacaauuacagaccuggguaccacacccagauugcuggacccuggcaucucggcaagcuggagauggacuucgauuuuugugacgggacgacagugaucgucaccgaagauugcggaaaccgcggccccucucugcggaccacaaccgccuccgggaagcucauuacggaguggugcuguagaagcugcacacugccuccgcuucgguaucgcggagaggacggcuguugguacggcauggaaaucagaccccugaaagagaaggaagagaaucucguuaacucccuggugaccgccgggcacggacagguggauaauuucucucugggcguccuugggauggcucucuuucuggaagagaugcugcggacaagagugggaaccaaacaugcgauccuccugguugccgugagcuucgucacacuuauuaccggcaacauguccuuuaaggaccuggggcgcgugguugugauggucggagcuacgauggccgaugacaucggcaugggcgugaccuaucucgcccugcuggcugccuucaaaguucggccuacauuugcggcugggcuucugcucagaaagcugaccucuaaggagcucaugaugacaaccauuggaaucgugcugcuuagccaauccacgauucccgaaacaguccuggagcucaccgaugcccuggcccugggcaugauggugcuuaaaaucgugcgcaauauggaaaaguaccagcuggcugucacaaucauggccauucucugcguuccuaacgcggugauccugcagaaugcuuggaaagugucuuguaccauucucgccgucgugagcguuagcccccugcuucugaccagcucucagcaaaagacagacuggaucccucucgcccugacgauuaaagggcugaaccccaccgcuaucuuccuuacaacccuguccagaacaaauaagaaacggagcuggccgcucaacgaggccaucauggcugugggaauggucucuauucuggccuccagccuccugaagaaugacaucccuaugaccggcccccuuguggccgggggacugcugacgguuugcuaugugcucacaggccgcucugccgaucuggaacuugagagagcuaccgacgucaagugggaggaucaggccgaaauuuccggcagcuccccuauccugagcauuaccaucucugaggacgggagcauguccauuaaaaacgaagaggaggaacagacacucaccauccugauccggacaggacuccuggugauuucuggccuuuuucccaucagcauuccgaucacggcugccgccugguaccugugggaggucaagaaacagcgcgcuggggugcugugggauguuccuucucccccucccaugggaaaggcggaacucgaggacggcgccuauagaauuaaacaaaaggggauccugggauacagccagaucggcgcuggcguguacaaggaagggaccuuccacacaauguggcaugucacccggggagccgugcuuaugcacaaaggcaagcgcauugagcccagcugggccgauguuaaaaaggaccugaucuccuaugggggaggcuggaaacucgagggggaauggaaggagggagaagaggugcagguccuggcucucgaaccuggcaagaauccgagagccgugcagacaaaacccggccuguuuaagaccaacacggggaccauuggagcggugucucuugauuucagcccuggcacauccgggagccccaucauugacaaaaagggaaaaguugucggccuguacgggaacggaguggugacccggucuggcgcuuaugucuccgccaucgcccaaacagaaaaguccaucgaggauaauccugaaauugaggacgauaucuuucgcaagagacggcugaccauuauggaccuccaccccggcgcugggaaaacaaagagauaccugccugccaucgugcgcgaagcgauuaaacggggacuuagaacgcugauccucgcuccgacccgcguuguggccgccgagauggaagaggcucugcggggccuccccauuagauaucagaccccugcgauccgcgcugagcauaccgggcgggaaaucgucgaccugaugugucacgccaccuucacaaugagacuucugucucccgugcgcguuccuaacuacaaucugauuaucauggaugaggcgcauuucacggaccccgccuccauugcugcccggggauauaucagcaccagaguggaaaugggcgaggcugccgggauuuuuaugacagccaccccgccuggcucccgggaucccuucccccagucuaacgcuccuaucaucgacgaggaacgcgagauucccgaaagaagcuggaacuccggacacgagugggucacagauuuuaagggcaaaaccgugugguucguuccuagcaucaaggcggggaacgacauugccgcuugccuccggaagaauggcaagaaggugauccaacugucucgcaaaacguuugauuccgaauacgucaagacaagaaccaacgacugggauuucguggugaccacagacauuagcgagaugggcgccaauuuuaaagccgagcgggucaucgauccgagacgcuguaugaagcccguuauccuuaccgacggggaggaacgggugauucuggcuggaccuaugcccgugacacauucuagcgccgcgcagagacgcggccggaucgggagaaacccuaaaaaugaaaacgaccaguacauuuauaugggcgagccccucgaaaaugaugaggacugcgcucacuggaaggaggccaagaugcugcuggauaacaucaauaccccggaaggaauuaucccuuccauguucgagcccgaacgcgagaaagucgacgccauugauggcgaauaccggcucagaggggaggcucgcaagacguuuguggaccuuaugagacggggagaucugccuguuuggcuggccuauaaaguggcggccgagggcaucaacuacgcugaccgcagaugguguuucgaugggaucaagaacaaucagauucucgaagagaacgucgaaguggagaucuggacaaaagagggagaacggaagaagcugaaaccccgcuggcuugacgccagaauuuauucugauccucuggcucucaaggaguuuaaagaguucgccgcuggccggaaaagccugacccugaaucucaucacagagauggggagacuucccaccuucaugacgcagaagacccgcgacgcccuggauaaccuggcgguucuccacacagccgaagcuggcggacgggccuacaaucaugcucuguccgagcuuccggagacccuggaaacacuccugcugcucacccuucuggccacagugaccggcgggauuuuucuguuccucaugucuggaagaggcaucgggaagaugacgcugggaaugugcugcaucauuacagccagcauccuucugugguaugcucagauucagccucacuggaucgcggccuccauuauccucgaguuuuuccugaucguccugcucauucccgaacccgagaagcagcgcaccccucaagacaaccagcuuaccuacguggucaucgcuauucugacagugguugccgccaccauggcuaaugaaaugggcuuucuggagaaaacaaagaaagaccucggccuggggagcaucgccacgcagcagccggagucuaacauucuugauaucgaccugcggcccgcguccgccuggacccucuacgcuguggccacaaccuucgugacaccuaugcugagacauagcauugaaaauuccucugucaacguuagccugaccgcuaucgccaaucaagcgacggugcucaugggacuuggcaagggguggccccuguccaaaauggauaucggagugccucugcucgccauuggcuguuauucucaggucaaccccaucacccugacagcugcccuucugcuccugguggcucacuacgccauuaucgggccuggacugcaggcuaaggccacccgggaggcgcagaagcgcgccgcugccggcauuaugaaaaauccgacaguugacggcaucaccgugaucgaucucgaccccauuccuuaugaucccaaguuugaaaaacaacuugggcaggucaugcugcugauccucugcgugacgcagguccugaugaugagaacaaccugggcucuuugugaggcccugacacucgccaccggaccuauuagcacccugugggaaggcaaccccgggcgguucuggaauacaacgaucgcgguguccauggcuaacauuuuucgcggaagcuaccuggccggcgcugggcuccuuuucucuaucaugaagaauaccacaaacaccagacggggaacaggcaacaucggcgagacccugggggagaaauggaagucccgccugaaugcccucggaaaaagcgaauuucaaauuuauaagaagucuggcauccaggagguugacagaacgcuggccaaagaagggauuaagcggggagagacagaucaccaugcugugucccgcggcagcgccaaacuuagaugguucgucgagcggaacauggugaccccggaagggaagguuguggaccugggaugcggcagaggcggguggucuuacuauuguggaggccucaaaaauguccgcgaggugaaggggcugaccaagggaggcccugggcacgaggaacccauccccaugagcacauacggauggaaccuggugcggcuccaguccggcguugaugucuuuuucauuccucccgaaaaaugcgacacccuucugugugauaucggcgagucuagcccuaauccgacaguggaggcggggagaacgcugcgcgugcucaaccuggucgaaaauuggcuuaacaauaacacccaguucugcaucaagguucugaaucccuacaugccuuccgugauugagaaaauggaagcccuccaacggaaguauggaggcgcucuggugagaaacccccugagccgcaauuccacacaugagauguacugggucucuaacgccagcgggaauaucguguccucuguuaacaugauuagccggaugcucaucaacagauuuaccaugcgccacaaaaaggcuacauaugaaccugacguggaccuuggauccggcacccggaauauugggaucgagucugagaagcccaaccuggauauuaucggaaaaagaaucgaaaagauuaaacaggagcaugaaacgagcuggcacuacgaccaggaucacccguauaagaccugggccuaccauggcuccuaugagacaaaacagaccggcagcgcgucuuccauggucaauggggugguucgccugcucacaaagccuugggacgugcugcccaccgucacacaaauggccaugaccgauacgacaccuuucggacagcagcggguguuuaaggaaaaaguggacaccagaacccaggagcccaaggagggcaccaagaaacuuaugaaaaucacggcugaauggcuguggaaggagcucgggaaaaagaagaccccucgcauguguacaagagaagaguucacccggaaaguccgcagcaacgccgcucugggagccauuuuuacagaugagaauaaguggaaaucugcuagagaagccguugaggacucccgguucugggaacugguggauaaggagagaaaccuccaccuggaaggcaaaugcgagaccuguguguacaauaugauggggaagcgggagaagaaacuuggagaauuuggcaaggcgaaaggcagccgcgccaucugguacauguggcugggggcuagauuccucgaguuugaagcccugggauuccuuaacgaggaccauugguuuucucgggaaaauucccugagcggcgucgagggggagggacuccacaagcugggcuauauucugcgcgauguguccaaaaaggaagggggcgcuauguacgccgacgacacagccggaugggauaccagaaucacgcucgaggaccugaagaacgaagagaugguuaccaaucacauggaaggcgagcauaagaaacuugcggaggcuaucuucaaacugacauaucaaaacaaagugguccgggugcagcgccccaccccgagagggacaguuauggauauuaucagccggcgcgaccagagaggaucuggccaaguggggaccuacggacucaauacguuuacaaacauggaagcccagcugauucggcagauggagggcgaaggggucuucaaaaauauccagcaccuuaccgugacagaggagguugccgugcauaacuggcuggcucgcgucggcagagaacggcucagccgcauggccauuuccggagaugacugcguggucaagccucuggaugacagauucgcuaacgcccugaccgcgcucaaugauaugggcaagauccggaaagacauccaacagugggagcccucuaagggguggaacgauuggacacaggugcccuuuugcagccaccauuuccacgaacugauuaugaaagacggaagaguucuuguggucccuugucgcaaucaggaugagcugaucggccgggccagaauuucccaaggggcuggauggucucuccgcgaaaccgccugccugggcaagagcuaugcucagauguggucccuuauguacuuucaccggagagaccugcgccucgccgcgaacgccaucuguucugcugugccgagccauugggugcccacaucccggaccacauggagcauucacgccaaacaugaguggaugaccacagaggacaugcugaccguuuggaauagaguguggauccgcgaaaacccuuggauggaggauaagacgcccgucgaaucuugggaggaaauuccuuaucuggggaagcgggaggaccaguggugcggcucccucaucggacugacaagcagagcuaccugggccaaaaauauccaggcugccauuaaccaagugcgcucucuuaucggcaaugaggaauacaccgauuacaugcccuccaugaagcgguucagacgggaggaagaggaagcggggguucugugguga

SEQ ID NO: 20145 - RNA, 9876 nt, Artificial Sequence
  derived and/or modified CDS sequence (opt5) from DENV-2__EU482464__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcaccacaauggccgaugacaucggcaugggggugaccuaucucgcucugcuggccgccuucaagguucgcccuacauuugcugccggacuucugcuccggaagcugaccuccaaagagcucaugaugacgacaauuggcaucgugcugcuuucucaaagcaccauucccgaaacaguccuggagcucaccgaugcgcuggcucuggggaugauggugcuuaagaucgugagaaauauggaaaaauaccagcuggccgucaccaucauggccauucucugcguuccuaacgcugugauccugcagaaugccuggaagguguccuguacaauucucgcggucgugucuguuagcccccugcuucugacguccagccagcagaagaccgacuggaucccucucgcucugacaauuaagggacugaaccccaccgccaucuuccuuacaacccugucucgcacgaauaaaaagagauccuggccgcucaacgaggccaucauggcugugggcauggucagcauucuggccucuucccuccugaagaaugacaucccuaugacagggccccuuguggcuggaggccugcugaccguuugcuaugugcucaccggccggagcgccgaucuggaacuugagcgcgcgacagacgucaaaugggaggaucaggccgaaauuucuggguccagcccuauccuguccauuaccaucagcgaggacggaucuaugagcauuaagaacgaagaggaggaacagacacucacgauccugaucagaaccggccuccuggugauuuccgggcuuuuucccaucucuauuccgaucacagcugccgcuugguaccugugggaggucaaaaagcagcgggccggagugcugugggauguuccuucucccccucccaugggcaaagccgaacucgaggacggggcuuaucgcauuaagcaaaagggaauccugggcuacucccagaucggcgcggggguguacaaagaaggaaccuuccacacaauguggcaugucaccagaggcgccgugcuuaugcacaaggggaaacggauugagcccuccugggcugauguuaagaaagaccugaucagcuauggaggcggguggaagcucgagggagaauggaaggagggcgaagaggugcagguccuggcccucgaaccuggcaaaaauccgcgcgccgugcagacgaagcccgggcuguuuaaaaccaacacaggaaccauuggcgcugugucccuugauuucucuccugggacaagcggaucccccaucauugacaagaaaggcaagguugucgggcuguacggaaacggcguggugaccagaagcggcgccuaugucucugcgaucgcucaaacagagaaguccaucgaggauaauccugaaauugaggacgauaucuuucggaaacgcagacugacgauuauggaccuccaccccggggccggaaagaccaaacgguaccugccugccaucgugagagaagcuauuaagcgcggccuucggacacugauccucgccccgaccagaguuguggcggcugagauggaagaggcccugcgcgggcuccccauucgguaucagaccccugccaucagagcugagcauacaggacgcgaaaucgucgaccugaugugucacgccacguucaccaugcggcuucugagccccgugagaguuccuaacuacaaucugauuaucauggaugaggcucauuucacagaccccgccucuauugcggcccgcggcuauaucuccacccggguggaaaugggggaggcugccggcauuuuuaugacagcuaccccgccuggaagcagagaucccuucccccaguccaacgccccuaucaucgacgaggaacgggagauucccgaacgcucuuggaauagcggccacgagugggucacggauuuuaaagggaagacagugugguucguuccuuccaucaaggccggaaacgacauugcugcgugccuccgcaaaaauggcaagaaagugauccaacugagccggaagaccuuugauucugaauacgucaaaacccgcacaaacgacugggauuucguggugaccacagacauuuccgagaugggggccaauuuuaaggcugagagagucaucgauccgcggagauguaugaaacccguuauccuuaccgacggagaggaacgcgugauucuggccggcccuaugcccgugacgcauagcucugccgcucagcggagagggcgcaucggccggaacccuaagaaugaaaacgaccaguacauuuauaugggagagccccucgaaaaugaugaggacugcgcccacuggaaggaggcgaaaaugcugcuggauaacaucaauacaccggaaggcauuaucccuagcauguucgagcccgaaagagagaaggucgacgcuauugauggggaauaccgccuccggggagaggccagaaaaaccuuuguggaccuuaugcgcagaggcgaucugccuguuuggcuggccuauaagguggcugccgaggggaucaacuacgcggaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacggagaugggccggcuucccaccuucaugacacaaaagaccagagacgcccuggauaaccuggcuguucuccacacagccgaagcgggaggccgcgccuacaaucaugcucugagcgagcuuccggagacccuggaaacacuccugcugcucacccuucuggccacggugacagggggaauuuuucuguuccucauguccggccgggggaucggaaagaugacccugggcaugugcugcaucauuaccgcuucuauccuucugugguaugcccagauucagccucacuggaucgccgcuagcauuauccucgaguuuuuccugaucguccugcucauucccgaacccgagaaacagagaacaccucaagacaaccagcuuaccuacguggucaucgcgauucugacagugguugccgcuacgauggccaaugaaaugggcuuucuggagaagaccaaaaaggaccucgggcugggauccaucgccacacagcagccggagagcaacauucuugauaucgaccugcgccccgcuucugccuggacccucuacgcgguggccacaaccuucgugacgccuaugcugcggcauuccauugaaaauagcuccgucaacguuucucugaccgcuaucgccaaucaagcuacagugcucaugggccuugggaaaggauggccccugagcaagauggauaucggcgugccucugcucgccauuggguguuauucccaggucaaccccaucacccugacagcggcccuucugcuccugguggcucacuacgccauuaucggaccuggccugcaggcuaaggccaccagagaggcucagaaacgggccgcggccggcauuaugaagaauccgacgguugacgggaucacagugaucgaucucgaccccauuccuuaugaucccaaauuugaaaagcaacuuggacaggucaugcugcugauccucugcgugacccagguccugaugaugcgcacaaccugggcucuuugugaggcccugacccucgcuacaggcccuauuucuacgcugugggaagggaaccccggaagauucuggaauaccacaaucgccgugagcauggccaacauuuuucggggcuccuaccuggcgggggcuggacuccuuuucagcaucaugaaaaauaccacaaacacccgcagaggcacgggcaacaucggggagacacugggagagaaguggaaaucucggcugaaugcccucggcaaguccgaauuucaaauuuauaagaaaagcgggauccaggagguugaccgcacccuggcuaaggaaggaauuaaaagaggcgagaccgaucaccaugccgugucucggggguccgccaaacuucgcugguucgucgagagaaacauggugacaccggaaggaaaaguuguggaccugggcugcggcagagggggauggagcuacuauuguggcgggcucaagaauguccgggaggugaagggacugaccaaaggcgggccuggacacgaagaacccauccccaugucuacauacggcuggaaccuggugcgccuccagagcggcguugaugucuuuuucauuccucccgaaaagugcgacacgcuucugugugauaucggggaguccucuccuaauccgaccguggaggcuggacggacacugagagugcucaaccuggucgaaaauuggcuuaacaauaacacccaguucugcaucaaaguucugaaucccuacaugccuagcgugauugagaagauggaagcccuccaacgcaaauauggcggggcgcuggugcggaacccccuguccagaaauagcacacaugagauguacugggucuccaacgccucuggaaauaucgugagcuccguuaacaugauuucucgcaugcucaucaaccgguuuaccaugagacacaagaaggcuacguaugaaccugacguggaccuuggcagcgggacccgcaauauuggaaucgaguccgagauucccaaccuggauaucaucggcaaacggauugaaaagaucaaacaggagcaugaaacaucuuggcacuacgaccaggaucacccguauaagaccugggccuaccauggcagcuaugagacaaaacagaccggguccgcuagcucuauggucaauggagugguuagacugcucacaaagccuugggacgugcugcccaccgucacgcaaauggccaugacagauaccaccccuuucggccagcagcgcguguuuaaggaaaaaguggacacacggacgcaggagcccaaggaggggaccaagaaacuuaugaaaauuacagcggaauggcuguggaaagagcucggcaagaagaagaccccuagaauguguacacgcgaagaguucaccagaaaaguccgguccaacgccgcucugggcgccaucuuuacagaugagaauaaguggaaaagcgcucgcgaagccguugaggacucuagauucugggaacugguggauaaggagcggaaccuccaccuggaagggaaaugcgagaccuguguguacaauaugaugggaaagagagagaagaaacuuggcgaauuuggcaaggcuaaagggucccgggccauuugguacauguggcugggagcgcgcuuccucgaguuugaagcccugggcuuccuuaacgaggaccauugguuuagcagagaaaauucucuguccggggucgagggagagggccuccacaagcugggguauauccugcgggaugugagcaaaaaggaaggcggagcuauguacgccgacgacacggcuggcugggauacccgcaucacacucgaggaccugaagaacgaagagaugguuaccaaucacauggaaggggagcauaagaaacuugccgaggccauuuucaaacugacauaucaaaacaaaguggucagagugcagcggcccaccccgcgcggaacgguuauggauaucauuuccagacgggaccagcgcggcagcgggcaagugggaacauacggccucaauaccuuuacaaacauggaagcgcagcugaucagacagauggagggggaaggcgucuucaaaaauauucagcaccuuaccgugacggaggagguugcugugcaaaacuggcuggcccgggucggacgcgaaagacucucucggauggccaucagcggcgaugacugcguggucaagccucuggaugaccgcuucgcuaacgcccuggcugcccucaaugauauggggaagaucagaaaagacauucagcagugggagcccuccaagggauggaacgauuggacccaggugcccuuuugcucucaucacuuccaugaacugaucaugaaagacggccggguucuuguggucccuuguagaaaucaagaugagcugauugggcgcgcgcggaucagccagggagccggcuggucccucagagaaacagcuugccuggggaagucuuaugcccagauguggagccuuauguacuuucaccgccgggaccugagacucgcugccaacgcgauuuguuccgccgugccgucucacugggugcccaccagccgcacaaccugguccauccaugcuaaacacgaguggaugacaaccgaggacaugcugacgguuuggaaucggguguggauuagagaaaacccuuggauggaggauaagacacccgucgaaagcugggaggaaaucccuuaucugggcaagcgcgaggaccaguggugcggaucucucaucggccugaccucccgggccaccugggcuaaaaauauucaagccgcuaucaaccaggugagaagccuuauugggaaugaggaauacacagauuacaugcccucuaugaagcgcuuccggagagaggaagaggaagccggaguucugugguga

SEQ ID NO: 20146 - RNA, 9876 nt, Artificial Sequence
  derived and/or modified CDS sequence (opt5) from DENV-2__EU482465__SS-prME
agcgccggcaugaucauuaugcugauccccaccgugauggcuuuccaccugacgacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuuauuugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucgugacacuuaucaccgggaacaugagcuuuaaagaccugggaagagucgugguuauggugggcgcuacgauggccgaugacauuggcaugggggucaccuaucucgcccugcuggcugccuucaaggugcgcccuacauuugcggcuggacuucugcuccggaagcugaccuccaaagagcucaugaugacaaccaucggcauuguucugcuuucucaaagcacgauccccgaaacagugcuggagcucaccgaugcccuggcccuggggaugaugguccuuaagaucgugagaaauauggaaaaauaccagcuggcugugacaauuauggccauccucugcgucccuaacgcgguuauucugcagaaugcuuggaagguguccuguaccauccucgccguggucucugugagcccccugcuucugaccuccagccagcagaagaccgacuggauuccucucgcccugacgaucaagggacugaaccccaccgcuaucuuccuuacaacccugucucgcacaaauaaaaagagauccuggccgcucaacgaggccauuauggcuguuggcauggugagcauccuggccucuucccuccugaagaaugacauuccuaugaccgggccccuugucgcgggaggccugcugacggugugcuauguucucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauccugauuagaacaggccuccuggucaucuccgggcuuuuucccauuucuaucccgauuacggcugccgccugguaccugugggaggugaaaaagcagcgggcuggaguccugugggaugugccuucucccccucccaugggcaaagcggaacucgaggacggggccuaucgcaucaagcaaaagggaauccugggcuacucccagauuggcgcugggguuuacaaagaaggaaccuuccacacaauguggcaugugaccagaggcgccguccuuaugcacaaggggaaacggaucgagcccuccugggccgaugugaagaaagaccugauuagcuauggaggcggguggaagcucgagggagaauggaaggagggcgaagagguucaggugcuggcucucgaaccuggcaaaaauccgcgcgccguccagacaaagcccgggcuguuuaaaaccaacacgggaaccaucggcgcggugucccuugauuucucuccugggacaagcggaucccccauuaucgacaagaaaggcaaggugguugggcuguacggaaacggcgucgugaccagaagcggcgcuuaugugucugccaucgcccaaacagagaaguccaccgaggauaauccugaaauugaggacgauaucuuucggaaacgcagacugacaauuauggaccuccaccccggggcuggaaagacgaaacgguaccugccugccaucgucagagaagcgauuaagcgcggccuucggacccugauccucgcuccgacaagagugguugccgccgagauggaagaggcucugcgcgggcuccccauucgguaucagaccccugccaucagagcugagcauaccggacgcgaaaucguggaccugaugugucacgccacauucacgaugcggcuucugagccccgucagagugccuaacuacaaucugauuaucauggaugaggcgcauuucaccgaccccgccucuauugcugcccgcggcuauaucuccacacggguugaaaugggggaggcugccggcauuuuuaugaccgccacaccgccuggaagcagagaucccuucccccaguccaacgcuccuaucaucgacgaggaacgggagauucccgaacgcucuuggaauagcggccacgagugggugaccgauuuuaaagggaagacggucugguucgugccuuccaucaaggcgggaaacgacauugccgcuugccuccgcaaaaauggcaagaaaguuauccaacugagccggaagacauuugauucugaauacgugaaaacccgcaccaacgacugggauuucgucgugacaaccgacauuuccgagaugggggccaauuuuaaggccgagagagugaucgauccgcggagauguaugaaacccgucauccuuacagacggagaggaacgcguuauucuggcuggcccuaugcccgugacccauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauacgccggaaggcauuaucccuagcauguucgagcccgaaagagagaagguggacgccauugauggggaauaccgccuccggggagaggcuagaaaaacauuugucgaccuuaugcgcagaggcgaucugccuguguggcuggccuauaagguugcggccgaggggaucaacuacgcugaccggcgcugguguuucgauggaaucaaaaacaaucagauucucgaagagaacguggaagucgagaucuggaccaaggagggcgaaagaaagaaacugaagccccgguggcuugacgcccgcauuuauuccgauccucuggcucucaaagaguuuaaggaguucgccgcugggagaaaaucucugacacugaaucucaucaccgagaugggccggcuucccacguucaugacccaaaagacaagagacgcccuggauaaccuggcggugcuccacaccgccgaagcuggaggccgcgccuacaaucaugcucugagcgagcuuccggagacacuggaaacccuccugcugcucacacuucuggccaccguuacagggggaauuuuucuguuccucauguccggccgggggaucggaaagaugacacugggcaugugcugcaucaccaccgccucuauucuucugugguaugcucagauccagccucacuggauugcggccagcaucauucucgaguuuuuccugaucgugcugcucauccccgaacccgagaaacagagaacaccucaagacaaccagcuuaccuacgucgugauugcuauccugacagucguggccgccacgauggcuaaugaaaugggcuuucuggagaagaccaaaaaggaccucgggcugggauccauugccacacagcagccggagagcaacauccuugauauugaccugcgccccgcgucugccuggacccucuacgcuguugccacaaccuucgugacgccuaugcugcggcauuccaucgaaaauagcuccgugaacgucucucugaccgcuauugccaaucaagcgacaguucucaugggccuugggaaaggauggccccugagcaagauggauaucggcgugccucugcucgccaucggguguuauucccaggugaaccccauuacccugacagcugcccuucugcuccuggucgcucacuacgccaucauuggaccuggccugcaggcuaaggccaccagagaggcgcagaaacgggccgcugccggcaucaugaagaauccgacgguggacgggauuacaguuaucgaucucgaccccaucccuuaugaucccaaauuugaaaagcaacuuggacaggugaugcugcugauucucugcgucacccaggugcugaugaugcgcacaaccugggcucuuugugaggcccugacccucgccacaggcccuaucucuacgcugugggaagggaaccccggaagauucuggaauaccacaauugcggucagcauggcuaacaucuuucggggcuccuaccuggccggggcuggacuccuuuucagcauuaugaaaaauaccacaaacacccgcagaggcacgggcaacaugggggagacacugggagagaaguggaaaucucggcugaaugcccucggcaaguccgaauuucaaaucuauaagcgcagcgggauccaggagguggacagaacccuggccaaagaaggaauuaagcggggcgagaccgaucaccaugcuguuucucgcggguccgccaaacuuagaugguucguggagcggaacauggucacaccggaaggaaaggugguugaccugggcugcggcagagggggauggagcuacuauuguggcgggcucaaaaaugugcgcgaggucaagggacugaccaagggcgggccuggacacgaagaacccauccccaugucuacauacggcuggaaccuggugcggcuccagagcggcguggaugucuuuuucauuccucccgaaaaaugcgacacgcuucugugugauaucggggaguccucuccuaauccgaccgucgaggcgggaagaacacugcgcgugcucaaccugguggaaaauuggcuuaacaauaacacccaguucugcauuaagguccugaaucccuacaugccuagcguuaucgagaaaauggaagcccuccaacggaaguauggcggggcucuggugagaaacccccugucccgcaauagcacacaugagauguacuggguguccaacgccucuggaaauaucgucagcuccgugaacaugauuucucggaugcucaucaacagauuuaccaugcgccacaaaaaggcuacguaugaaccugacguugaccuuggcagcgggacccggaauauuggaaucgaguccgagauucccaaccuggauaucauuggcaagagaaucgagaagaucaagcaggagcaugaaacaucuuggcacuacgaccaggaucacccguauaaaaccugggccuaccauggcagcuaugagacaaagcagaccggguccgcgagcucuauggugaauggagucgugcgccugcucacaaaaccuugggacguucugcccaccgugacgcaaauggccaugacagauaccaccccuuucggccagcagcgggucuuuaaggaaaagguggacacaagaacgcaggagcccaaagaggggaccaagaaacuuaugaagauuacagcugaauggcuguggaaagagcucggaaagaaaaagaccccucgcauguguacaagagaagaguucacccggaaggugcgcuccaacgccgcucugggcgccaucuuuacagaugagaauaaauggaaaagcgcuagagaagccgucgaggacucucgguucugggaacugguugauaaagagagaaaccuccaccuggaagggaagugcgagaccuguguguacaauaugaugggaaaacgggagaagaaacuuggcgaauuuggcaaagcgaaggggucccgcgccauuugguacauguggcugggagcuagauuccucgaguuugaagcccugggcuuccuuaacgaggaccauugguuuagccgggaaaauucucuguccgggguggagggagagggccuccacaaacugggguauauccugcgcgaugucagcaagaaagaaggcggagcuauguacgccgacgacacggccggcugggauaccagaauuacacucgaggaccugaagaacgaagagauggugaccaaucacauggaaggggagcauaagaaacuugcggaggcuaucuucaagcugacauaucaaaacaaaguugugcggguccagcgccccaccccgagaggaacggugauggauaucauuucccggcgcgaccagagaggcagcgggcaaguuggaacauacggccucaauaccuuuacaaacauggaagcccagcugauccggcagauggagggggaaggcguguucaagaauauucagcaccuuaccgucacggaggagguggccguucaaaacuggcuggcucgcgugggaagagaacggcucucucgcauggccaucagcggcgaugacugcgucgugaaaccucuggaugacagauucgcuaacgcccugaccgcgcucaaugauauggggaagauucggaaggacauccagcagugggagcccuccaaaggauggaacgauuggacacagguccccuuuugcucucaucacuuccaugaacugaucaugaaggacggcagagugcuuguugugccuugucgcaaucaagaugagcugauugggcgggccagaaucagccagggagcuggcuggucccuccgcgaaaccgccugccuggggaaaucuuaugcucagauguggagccuuauguacuuucaccggagagaccugcgccucgccgcgaacgccauuuguuccgcugucccgucucacugggugcccacaagccggaccacaugguccauccaugccaagcacgaguggaugaccacggaggacaugcugacaguguggaauagaguuuggauucgcgaaaacccuuggauggaggauaaaacccccguggaaagcugggaggaaaucccuuaucugggcaagcgggaggaccaguggugcggaucucucauuggccugaccuccagagcuacaugggccaagaauauccaagcugccaucaaccagguccgcagccuuauugggaaugaggaauacaccgauuacaugcccucuaugaaacgguucagacgggaggaagaggaagcgggagugcugugguga

SEQ ID NO: 20147 - RNA, 9876 nt, Artificial Sequence
  derived and/or modified CDS sequence (opt5) from DENV-2__EU482466__SS-prME
agcgccggcaugaucaucaugcugauccccaccgugauggcuuuccaccugaccacgcggaauggggagccucauaugauugucggaauccaggaaaagggcaagucccugcuuuuuaagaccgaggacgggguuaauaugugcacccugauggccauggaucucggagaacugugugaggacaccauuaccuacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucagagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuagcccccucccuaugggcaaggcggaacuggaggacggggccuaucgcauuaaacagaagggaauccuuggcuacucccagaucggcgcugggguguacaaggaaggaaccuuccacacaauguggcaugucaccagaggcgccgugcugaugcacaaagggaagcggauugagcccucuugggccgauguuaaaaaggaccucaucagcuauggaggcggguggaaacuggagggagaauggaaggagggcgaagaggugcagguccucgcucuggaacccggcaagaauccucgcgccgugcaaacaaaaccggggcuuuuuaagaccaacacgggaaccauuggcgcggugucccuggauuucucucccgggacaagcggauccccuaucauugacaaaaagggcaaaguugucgggcuguacggaaacggcguggugaccagaagcggcgcuuaugucucugccaucgcccagacagagaaguccaucgaggauaaucccgaaauugaggacgauaucuuucggaagcgcagacucaccauuauggaccugcacccuggggcuggaaaaacaaagcgguaccuucccgccaucgugagagaagcgauuaaacgcggccugcggacgcucauccuggcuccuaccagaguuguggccgccgagauggaagaggcucuccgcgggcugccgauucgguaucagacacccgccaucagagcugagcauaccggacgcgaaaucgucgaccuuaugugucacgccaccuucacaaugcggcugcugagcccugugagaguucccaacuacaaucucauuaucauggaugaggcgcauuucacggacccugccucuauugcugcccgcggcuauaucuccacccggguggaaaugggggaggcugccggcauuuuuaugacagccacacccccgggaagcagagauccuuucccccaauccaacgcucccaucaucgacgaggaacgggagauuccugaacgcucuuggaauagcggccacgagugggucacagauuuuaaggggaaaaccgugugguucguucccuccaucaaggcgggaaacgacauugccgcuugccugagaaagaauggcaaaaaggugauccagcuuagccggaaaacguuugauucugaauacgucaagacacgcaccaacgacugggauuucguggugaccacagacauuuccgagaugggggccaauuuuaaagccgagagagucaucgauccucggagauguaugaagccgguuauccugaccgacggagaggaacgcgugauucucgcuggccccaugccugugacacauagcucugccgcgcagcggagagggcgcaucggccggaaccccaaaaaugaaaacgaccaguacauuuauaugggagagccucuggaaaaugaugaggacugcgcucacuggaaggaggccaagaugcugcucgauaacaucaauacccccgaaggcauuaucccgagcauguucgagccugaaagagagaaagucgacgccauugauggggaauaccgccuucggggagaggcuagaaagacguuuguggaccugaugcgcagaggcgaucugcccguuuggcucgccuauaaaguggcggccgaggggaucaacuacgcugaccggcgcugguguuucgauggaaucaagaacaaucaaauucuggaagagaacgucgaaguggagaucuggacaaaagagggcgaaagaaagaaacuuaaaccucgguggcuggacgcccgcauuuauuccgauccccucgcucugaaggaguuuaaagaguucgccgcugggagaaagucucugacccucaaucuuaucacagagaugggccggcugccuaccuucaugacgcagaaaaccagagacgcccuggauaaccucgcgguucugcacacagccgaagcuggaggccgcgccuacaaucaugcucuuagcgagcugcccgagacccucgaaacacugcugcuccuuacccugcuggccacagugaccgggggaauuuuucucuuccugauguccggccgggggaucggaaagaugacgcuuggcaugugcugcaucauuacagccucuauccugcucugguaugcucagauucagccgcacuggaucgcggccagcauuauccuggaguuuuuccugaucguccuccuuauuccugaacccgagaagcaaagaacaccccaggacaaccagcugaccuacguggucaucgcuauucugacagugguugccgccaccauggcuaaugaaaugggcuuucucgagaaaacaaagaaagaccuggggcuuggauccaucgccacgcagcaaccugagagcaacauucuggauaucgaccuccgcccggcgucugccuggacccuguacgcuguggccacaaccuucgugacacccaugcugcggcauuccauugaaaauagcuccgucaacguuucucucaccgcuaucgccaaucaggcgacggugcuuaugggccuggggaagggauggccucugagcaaaauggauaucggcgugccccuccuggccauuggguguuauucccaggucaacccuaucacccuuacagcugcccugcuccugcugguggcucacuacgccauuaucggacccggccuccaggcuaaggccaccagagaggcgcaaaagcgggccgcugccggcauuaugaaaaauccuacaguugacgggaucaccgugaucgaucuugacccgauucccuaugauccuaaguuugaaaaacagcugggacaggucaugcugcucauccugugcgugacgcaaguccuuaugaugcgcacaaccugggcucugugugaggcccucacacuggccaccggccccauuucuacccugugggaagggaacccuggaagauucuggaauacaacgaucgcggugagcauggcuaacauuuuucggggcuccuaccucgccggggcuggacuucuguucagcaucaugaagaauaccacaaacacccgcagaggcacaggcaacaugggggagacccugggagagaaauggaagucucggcucaaugcccugggcaaauccgaauuucagaucuauaaaaagagcgggauucaggagguugaccgcacgcuugccaaagaaggaaucaagagaggcgagacagaucaccaugcugugucucggggguccgccaaacugcgcugguucgucgagagaaacauggugacccccgaaggaaagguuguggaccucggcugcggcagagggggauggagcuacuauuguggcgggcugaaaaauguccgggaggugaagggacugaccaagggcgggccgggacacgaagaaccuauucccaugucuacauacggcuggaaccucgugcgccuucagagcggcguugaugucuuuuucauucccccugaaaaaugcgacacccugcugugugauauuggggaguccucucccaauccuacaguggaggcgggacggacgcucagagugcugaaccuugucgaaaauuggcugaacaauaacacccaauucugcaucaagguucucaauccguacaugcccagcgugaucgagaaaauggaagcccugcagcgcaaguauggcggggcucuggugcggaacccucucuccagaaauagcacacaugagauguacugggucuccaacgccucuggaaauauugugagcuccguuaacaugaucucucgcaugcuuauuaaccgguuuaccaugagacacaaaaaggcuacauaugaacccgacguggaccugggcagcgggacccgcaauaucggaauugaguccgagacgccuaaccuggauaucauuggcaagcggaucgagaagaucaagcaggagcaugaaaccucuuggcacuacgaccaggaucaccccuauaaaacaugggccuaccauggcagcuaugagaccaagcaaacaggguccgcgagcucuauggucaauggagugguuagacuccugaccaaaccgugggacgugcuuccuacagucacccagauggccaugacggauacaacccccuucggccagcagcgcguguuuaaggaaaagguggacacccggacacaagagccuaaagaggggacgaagaaacugaugaagauuaccgcugaauggcucuggaaagagcugggaaagaaaaagacacccagaauguguacccgcgaagaguucacaagaaagguccgguccaacgccgcucugggcgccaucuuuaccgaugagaauaaauggaaaagcgcucgcgaagccguugaggacucuagauucugggaacucguggauaaagagcggaaccugcaccuugaagggaagugcgagacauguguguacaauaugaugggaaaaagagagaagaagcugggcgaauuuggcaaagcgaaggggucccgggccauuugguacauguggcucggagcucgcuuccuggaguuugaagcccuuggcuuccugaacgaggaccauugguuuagcagagaaaauucucucuccggggucgagggagagggccugcacaaacugggguauauccuccgggaugugagcaagaaagaaggcggagcuauguacgccgacgacaccgccggcugggauacgcgcauuacccuggaggaccuuaagaacgaagagaugguuacaaaucacauggaaggggagcauaagaaacuggcggaggcuaucuucaagcucaccuaucagaacaaaguggucagagugcagcggccuacaccccgcggaaccguuauggauaucauuuccagacgggaccaacgcggcagcgggcaggucggaacguacggccugaauacauuuaccaacauggaagcccagcuuaucagacagauggagggggaaggcgucuucaagaauauucaacaccugacagugaccgaggagguugccgugcagaacuggcucgcucgggucggacgcgaaagacugucucggauggccaucagcggcgaugacugcguggucaaaccgcuggaugaccgcuucgcuaacgcccucacggcgcugaaugauauggggaagauuagaaaggacauccagcagugggagccuuccaaaggauggaacgauuggacccaagugcccuuuugcucucaucacuuccaugaacuuaucaugaaggacggccggguucuggugguccccuguagaaaucaggaugagcucauugggcgcgcccggaucagccagggagcuggcuggucccugagagaaacagccugccuugggaaaucuuaugcucagauguggagccugauguacuuucaccgccgggaccucagacuggccgcgaacgccauuuguuccgcugugccuucucacugggugccgaccagccgcacaaccugguccauccaugccaagcacgaguggaugacaaccgaggacaugcugacgguuuggaaucggguguggauuagagaaaaccccuggauggaggauaaaacaccugucgaaagcugggaggaaauccccuaucucggcaagcgcgaggaccaauggugcggaucucugauuggccuuaccucccgggcuaccugggccaagaauauccaggcugccaucaaccaggugagaagccugauugggaaugaggaauacacagauuacaugccuucuaugaaacgcuuccggagagaggaagaggaagcgggaguucucugguga

SEQ ID NO: 20148 - RNA, 9876 nt, Artificial Sequence
  derived and/or modified CDS sequence (opt5) from DENV-2__EU482467__SS-prME
agcgccggaaugaucauuaugcugauccccacagugauggcuuuccaccugacaacgagaaauggggagccucauaugauuguuggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacauuaaaacacgcaccaacgacugggauuucgucgugaccacagacaucuccgagaugggggccaauuuuaaggccgagagagugaucgauccgcggagauguaugaaacccgucauucuuaccgacggagaggaacgcguuauccuggcuggcccuaugcccgugacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuugucgaccuuaugcgcagaggcgaucugccuguguggcuggccuauaagguugcggccgaggggaucaacuacgcugaccggcgcugguguuucgauggaauuaaaaacaaucagauccucgaagagaacguggaagucgagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcaaaagaccagagacgcccuggauaaccuggcggugcuccacacagccgaagcuggaggccgcgccuacaaucaugcucugagcgagcuuccggagacccuggaaacacuccugcugcucacccuucuggccacaguuaccgggggaaucuuucuguuccucauguccggccgggggaucggaaagaugacgcugggcaugugcugcauuaucacagccucuauucuucugugguaugcucagauccagccucacuggauugcggccagcaucauccucgaguuuuuccugauugugcugcucauccccgaacccgagaaacagagaaccccucaagacaaccagcuuaccuacgucgugauugcuauccugacagucguggccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguugccacaaccuucgugacaccuaugcugcggcauuccaucgaaaauagcuccgugaacgucucucugaccgcuaucgccaaucaagcgacgguucucaugggccuugggaaaggauggccccugagcaagauggauauuggcgugccucugcucgccaucggguguuauucccaggugaaccccauuacccugacagcugcccuucugcuccuggucgcucacuacgccaucauuggaccuggccugcaggcuaaggccaccagagaggcgcagaaacgggccgcugccggcaucaugaagaauccgacaguggacgggaucaccguuauugaucucgaccccaucccuuaugaucccaaauuugaaaagcaacuuggacaggugaugcugcugauucucugcgucacacaggugcugaugaugcgcacaaccugggcucuuugugaggcccugacacucgccaccggcccuaucucuacccugugggaagggaaccccggaagauucuggaauacaacgauugcggucagcauggcuaacaucuuucggggcuccuaccuggccggggcuggacuccuuuucagcaucaugaaaaauaccacaaacacccgcagaggcacaggcaacaugggggagacccugggagagaaguggaaaucucggcugaaugcccucggcaaguccgaauuucaaauuuauaagaaaagcgggauccaggagguggaccgcacgcuggccaaggaaggaauuaaaagaggcgagacagaucaccaugcuguuucucggggguccgccaaacuucgcugguucguggagagaaacauggucaccccggaaggaaaagugguugaccugggcugcggcagagggggauggagcuacuauuguggcgggcucaagaaugugcgggaggucaagggacugaccaaaggcgggccuggacacgaagaacccauccccaugucuacauacggcuggaaccuggugcgccuccagagcggcguggaugucuuuuucauuccucccgaaaagugcgacacccuucugugugauaucggggaguccucuccuaauccgacagucgaggcgggacggacgcugagagugcucaaccugguggaaaauuggcuuaacaauaacacccaguucugcaucaaaguccugaaucccuacaugccuagcguuauugagaagauggaagcccuccaacgcaaauauggcggggcucuggugcggaacccccuguccagaaauagcacacaugagauguacuggguguccaacgccucuggaaauaucgucagcuccgugaacaugauuucucgcaugcucaucaaccgguuuaccaugagacacaagaaggcuacauaugaaccugacguugaccuuggcagcgggacccgcaauauuggaaucgaguccgagauucccaaccuggauaucaucggcaaacggauugaaaagaucaaacaggagcaugaaacgucuuggcacuacgaccaggaucacccguauaagaccugggccuaccauggcagcuaugagacaaaacagaccggguccgcgagcucuauggugaauggagucgugagacugcucacaaagccuugggacguucugcccaccgugacacaaauggccaugaccgauacgacaccuuucggccagcagcgcgucuuuaaggaaaaaguggacacccggacccaggagcccaaggaggggaccaagaaacuuaugaaaauuacggcugaauggcuguggaaagagcucggcaaaaagaagaccccuagaauguguacacgcgaagaguucaccagaaaagugcgguccaacgccgcucugggcgccaucuuuacagaugagaauaaguggaaaagcgcucgcgaagccgucgaggacucuagauucugggaacugguugauaaggagcggaaccuccaccuggaagggaaaugcgagaccuguguguacaauaugaugggaaagagagagaagaaacuuggcgaauuuggcaaggcgaaagggucccgggccauuugguacauguggcugggagcucgcuuccucgaguuugaagcccugggcuuccuuaacgaggaccauugguuuagcagagaaaauucucuguccgggguggagggagagggccuccacaagcugggguauauccugcgggaugucagcaaaaaggaaggcggagcuauguacgccgacgacacagccggcugggauacccgcaucacgcucgaggaccugaagaacgaagagauggugaccaaucacauggaaggggagcauagaaaacuugcggaggcuauuuucaagcugacauaucaaaacaaaguugugcggguccagcgccccaccccgagaggaacagugauggauaucauuucccggcgcgaccagagaggcagcgggcaaguuggaaccuacggccucaauacguuuacaaacauggaagcccagcugauccggcagauggagggggaaggcguguucaagaauauucaccaucuuaccgucacagaggagguggccguucagaacuggcuggcucgcgugggaagagaacggcucucucgcauggccaucagcggcgaugacugcgucgugaaaccucuggaugacagauucgcuaacgcccugaccgcgcucaaugauauggggaagauccggaaggacauucaacagugggagcccuccaaaggauggaacgauuggacgcagguccccuuuugcucucaccauuuccacgaacugaucaugaaggacggcagagugcuuguugugccuugucgcaaucaggaugagcugauugggcgggccagaaucagccaaggagcuggcuggucccuccgcgaaaccgccugccuggggaaaucuuaugcucagauguggagccuuauguacuuucaccggagagaccugcgccucgccgcgaacgccauuuguuccgcugucccgucucauugggugcccacaagccggaccacaugguccauccacgccaagcaugaguggaugaccacagaggacaugcugaccguguggaauagaguuuggauucgcgaaaacccuuggauggaggauaaaacgcccguggaaagcugggaggaaaucccuuaucugggcaagcgggaggaccaguggugcggaucucucaucggccugacauccagagcuaccugggccaagaauauucaggcugccaucaaccaaguccgcagccuuauugggaaugaggaauacaccgauuacaugcccucuaugaaacgguucagacgggaggaagaggaagcgggagugcugugguga

SEQ ID NO: 20149 - RNA, 9876 nt, Artificial Sequence
  derived and/or modified CDS sequence (opt5) from DENV-2__EU482468__SS-prME
agcgccggaaugaucauuaugcugauccccaccgucauggcuuuccaccucacaacgagaaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauuaugcggcaucccggguucaccaucauggccgcuauucuggccuacacaaucggaaccacccacuuucagcgcguucucauuuucauccugcuuacagcuguggccccuuccaugacgaugagaugcauuggcaucucuaaccgggauuuugucgaaggggugagcggaggcuccuggguugacaucgugcuggagcacgggagcugugucaccacaauggcgaagaauaagcccacccucgauuucgaacugauuaaaacagaggccaagcagccugcuacccuucgcaaauauugcaucgaagccaagcugacgaacacaaccaccgagucuagauguccgacacaaggagagcccucccucaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucuggaauacacgauuguggugacaccccacucuggggaggagcaugccgucggaaacgacacaggcaaacacggcaaggaaaucaaagugaccccucaguccagcaucacagaggcggaacucaccggguauggaacgguuaccauggaguguucucccagaacaggccuggauuucaaugaaauggugcuucugcaaauggagaacaaggccuggcucguccaccggcagugguuucuggaccuuccgcugccuuggcuccccggggcugauaagcaggaguccaauuggauucagaaagaaacccuggugacauucaagaacccucaugccaaaaagcaagacguugugguccugggaagccaggagggcgcuaugcacaccgcccucacgggggccacagaaauccagauguccucuggcaaucugcuuuuuaccggacaucugaaaugccgccucagaauggacaagcugcaacuuaagggcaugagcuacuccauguguacagggaaauucaagguggucaaagagauugcugagacccagcacggaaccaucgugauucggguucaguaugaaggcgaugggagccccugcaagauccccuucgagaucauggaccuggagaagcgguacgugcucggacgccugauuacagucaacccuaucgugacggagaaggauucuccgguuaacauugaagcggagcccccuuuuggcgacuccuacaucauuaucgggguggagcccggccagcugaagcucaauugguucaaaaagggaagcucuauuggccaaauguuugaaaccacaaugagaggggccaaaagaauggcuauccugggagauaccgccugggacuucggcagccuugggggagucuuuacauccaucggcaaggcccugcaucagguguucggggcuauuuauggcgccgcguuuucuggagugagcuggaccaugaaaauccucauuggcguuaucauuacguggaucgggaugaacucccgcagcacaucucuguccgucagccuggugcuugugggaaucgucacccucuaccugggcgugaugguucaggcugauucuggguguguggucuccuggaagaauaaggagcugaaaugcggaagcggcauuuucaucaccgacaacgugcacacauggaccgaacaguauaaguuucaaccugagucccccucuaaacucgccagcgccauucagaaggcucaggaagaggggaucuguggcauucgguccguuacaagacuggagaaucuuauguggaaacagaucacgccggaacugaaccacauccucgccgagaaugaagugaagcugaccauuaugacaggagauauccgcggcauuaugcaagcugggaaacggucucugagaccucagcccaccgagcuuaaguacagcuggaagacauggggaaaagccaagaugcucuccaccgaaagcuauaaccagacguuccugaucgacggcccugagaccgcggagugccccaauacaaaccgcgccuggaacucucuggaagucgaggauuacggguuuggaguguucaccacaaacauuuggcucaaacugaaggaaaaacaggacgcuuuuugugacuccaaacuuaugagcgccgcuaucaaggauaaucgggccguucaugcggacaugggcuauuggauggagucugcccugaacgauaccuggaaaaucgagaaggcuuccuucauugaagugaaaaauugccacuggccuaagagccauacacucuggucuaacggcguccuggagagcgaaaugaucauucccaaaaaccuggccgggccggugucccaacacaauuacagaccuggauaccacacccagaucgcuggccccuggcaucuugggaagcucgagauggacuucgauuuuugugacggaacgacagugauugucaccgaagauugcggcaaccgcgggcccagccugcggaccacaaccgccucuggaaagcugaucacggaguggugcuguagauccugcacacucccuccgcugcgguaucgcggcgaggacggcuguugguacgggauggaaauuagaccccuuaaagagaaggaagagaaucugguuaacagccucgugaccgccggacacggccagguggauaauuucucccuggggguccugggaauggcucuuuuucucgaagagaugcugcggacaagagugggcaccaaacaugcgauccugcucguugccgugucuuucgucacacugaucaccgggaacaugagcuuuaaggaccuuggacgcgugguugugauggucggcgcuacgauggccgaugacauuggcaugggggugaccuaucuggcccuccuggcugccuucaaaguucggccuacauuugcggcuggacugcuucugagaaagcucaccuccaaggagcugaugaugacaaccaucggcauugugcuccugucucaaagcacgauccccgaaacaguccuugagcugaccgaugcccucgcccuggggaugauggugcugaaaauugugcgcaauauggaaaaguaccagcuugcugucacaaucauggccauccugugcguuccuaacgcggugauucuccagaaugcuuggaaaguguccuguaccauccuggccgucgugucuguuagcccccuccugcuuaccuccagccagcaaaagacagacuggauuccucuggcccucacgaucaaaggacugaaccccaccgcuauuuuccugacaacccuuucuagaacaaauaagaaacgguccuggccgcugaacgaggccaucauggcugugggcauggucagcauccucgccucuucccugcucaagaaugacauuccuaugaccgggccccugguggcgggaggccuucugacgguuugcuaugugcugacaggccgcagcgccgaucucgaacuggagagagcuaccgacgucaagugggaggaucaggccgaaaucucuggguccagcccuauucuuuccaucaccauuagcgaggacggaucuaugagcaucaaaaacgaagaggaggaacagacacugaccauucucauccggacaggccugcucgugaucuccgggcuguuucccauuucuaucccgauuacggcugccgccugguaccuuugggaggucaagaaacagcgcgcuggagugcugugggauguuccuucucccccucccaugggcaaggcggaacuggaggacggggccuauagaaucaaacaaaagggcauucugggcuacucccagaucggcgcugggguguacaaggaaggaaccuuccacacaauguggcaugucacccggggcgccgugcugaugcacaaagggaagcgcaucgagcccuccugggccgauguuaaaaaggaccuuauuagcuauggaggcggguggaaacuggagggagaauggaaggagggcgaagaggugcagguccucgcucuggaaccuggcaagaauccgagagccgugcagacaaaacccgggcucuuuaagaccaacacgggaaccaucggcgcggugucccuggauuucucuccugggacaagcggaucccccauuaucgacaaaaagggcaaaguugucgggcuuuacggaaacggcguggugacccggagcggcgcuuaugucucugccauugcccaaacagagaaguccaucgaggauaauccugaaaucgaggacgauauuuuucgcaagagacggcugaccaucauggaccugcaccccggggcuggaaaaacaaagagauaccucccugccauugugcgcgaagcgaucaaacggggccugagaacgcuuauucuggcuccgacccgcguuguggccgccgagauggaagaggcucuccgggggcugcccaucagauaucagaccccugccauucgcgcugagcauaccggacgggaaaucgucgaccucaugugucacgccaccuucacaaugagacugcuuagccccgugcgcguuccuaacuacaaucugaucauuauggaugaggcgcauuucacggaccccgccucuaucgcugcccggggcuauauuuccaccagaguggaaaugggggaggcugccggcaucuuuaugacagccaccccgccuggaagccgggaucccuucccccaguccaacgcuccuauuaucgacgaggaacgcgagauccccgaaagaucuuggaauagcggccacgagugggucacagauuuuaaggggaaaaccgugugguucguuccuuccauuaaggcgggaaacgacaucgccgcuugccugcggaagaauggcaaaaaggugauucaacucagccgcaaaacguuugauucugaauacgucaagacaagaaccaacgacugggauuucguggugaccacagacaucuccgagaugggggccaauuuuaaagccgagcgggucauugauccgagacgcuguaugaagcccguuauccugaccgacggagaagaacgggugauccuugcuggcccuaugcccgugacacauagcucugccgcgcagagacgcgggcggauuggcagaaacccuaaaaaugaaaacgaccaguacaucuauaugggagagccccuggaaaaugaugaggacugcgcucacuggaaggaggccaagaugcuccuggauaacauuaauaccccggaaggcaucauuccuagcauguucgagcccgaacgcgagaaagucgacgccaucgauggggaauaccggcugagaggagaggcucgcaagacguuuguggaccucaugagacggggcgaucuuccuguuuggcuggccuauaaaguggcggccgaggggauuaacuacgcugaccgcagaugguguuucgauggaaucaagaacaaucagauccuggaagagaacgucgaaguggagauuuggacaaaagagggcgaacggaagaagcucaaaccccgcuggcuggacgccagaaucuauuccgauccucuugcucugaaggaguuuaaagaguucgccgcugggcggaagucucucacccugaaucugauuacagagaugggcagacuccccaccuucaugacgcagaagacccgcgacgcccuugauaaccuggcgguucugcacacagccgaagcuggaggccgggccuacaaucaugcucucagcgagcugccggagacccuugaaacacugcuccugcugacccuccuugccacagugaccgggggaaucuuucuguuccugauguccggcagagggauuggaaagaugacgcucggcaugugcugcaucaucacagccucuacccugcuuugguaugcucagauucagccucacuggaucgcggccagcauuauccuggaguuuuuccucauuguccugcugauccccgaacccgagaagcagcgcaccccucaagacaaccagcucacauacguggucaucgcuauucuuaccgugguugccgccacaauggcuaaugaaaugggcuuucuggagaaaacgaagaaagaccuggggcucggauccaucgccacccagcagccggagagcaacauucuggauaucgaccuucggcccgcgucugccuggacacuguacgcuguggccaccacauucgugaccccuaugcucagacauuccauugaaaauagcuccgucaacguuucucugacggcuaucgccaaucaagcgaccgugcugaugggccucgggaagggauggccccuuagcaaaauggauauuggcgugccucugcuggccaucggguguuauucccaggucaaccccaucacacucaccgcugcccugcuucugcucguggcucacuacgccauuaucggaccuggccugcaggcuaaggccacacgggaggcgcagaagcgcgccgcugccggcauuaugaaaaauccgaccguugacgggaucacggugauugaucuggaccccaucccuuaugaucccaaguuugaaaaacaacucggacaggucaugcuucugauccugugcgugacacagguccucaugaugagaaccacaugggcucugugugaggcccuuacccuggccaccggcccuauuucuacacucugggaagggaaccccggacgguucuggaauacgaccaucgcggugagcauggcuaacauuuuucgcggcuccuaccuggccggggcuggacuccucuucagcaucaugaagaauacaaccaacacaagacggggcaccggcaacauuggggagacgcuuggagagaaauggaagucucgccugaaugcccugggcaaauccgaauuucaaaucuauaaaaagagcgggauccaggagguugacagaacacucgccaaagaaggaauuaagcggggcgagaccgaucaccaugcugugucucgcggguccgccaaacugagaugguucgucgagcggaacauggugaccccggaaggaaagguuguggaccuuggcugcggcagagggggauggagcuacuauuguggcgggcugaaaaauguccgcgaggugaagggacucacaaagggcgggccuggacacgaagaacccauccccaugucuaccuacggcuggaaccuggugcggcugcagagcggcguugaugucuuuuucauuccucccgaaaaaugcgacacacuccuuugugauaucggggaguccucuccuaauccgacgguggaggcgggaagaacccugcgcgugcugaaccucgucgaaaauuggcugaacaauaacacacaguucugcauuaagguucuuaaucccuacaugccuagcgugaucgagaaaauggaagcccugcaacggaaguauggcggggcucucgugagaaacccccugucccgcaauagcacccaugagauguacugggucuccaacgccucuggaaauaucgugagcuccguuaacaugauuucucggaugcugaucaacagauuuacaaugcgccacaaaaaggcuaccuaugaaccugacguggaccucggcagcgggacgcggaauauuggaaucgaguccgagauucccaaccuugauaucauuggcaagagaaucgagaagaucaagcaggagcaugaaaccucuuggcacuacgaccaggaucacccguauaaaacaugggccuaccauggcagcuaugagaccaagcagacaggguccgcgagcucuauggucaauggagugguucgccugcugaccaaaccuugggacgugcuccccacagucacccaaauggccaugacggauacaaccccuuucggccagcagcggguguuuaaggaaaagguggacaccagaacacaggagcccaaagaggggacgaagaaacugaugaagauuaccgcugaauggcuuuggaaagagcugggaaagaaaaagacaccucgcauguguaccagagaagaguucacacggaagguccgcuccaacgccgcucucggcgccaucuuuaccgaugagaauaaauggaaaagcgcuagagaagccguugaggacucucgguucugggaacugguggauaaagagagaaaccugcaccucgaagggaagugcgagacauguguguacaauaugaugggaaaacgggagaagaagcugggcgaauuuggcaaagcgaaggggucccgcgccauuugguacauguggcuuggagcuagauuccuggaguuugaagcccucggcuuccugaacgaggaccauugguuuagccgggaaaauucucuuuccggggucgagggagagggccugcacaaacucggguauauccugcgcgaugugagcaagaaagaaggcggagcuauguacgccgacgacaccgccggcugggauacgagaauuacccuggaggaccucaagaacgaagagaugguuacaaaucacauggaaggggagcauaagaaacuggcggaggcuaucuucaaacuuaccuaucaaaacaaagugguccgggugcagcgccccacaccgagaggaaccguuauggauaucauuucccggcgcgaccagagaggcagcgggcaagugggaacguacggccugaauacauuuaccaacauggaagcccagcucauccggcagauggagggggaaggcgucuucaagaauauucagcaccugacagugaccgaggagguugccgugcauaacuggcuugcucgcgucggaagagaacggcugucucgcauggccaucagcggcgaugacugcguggucaaaccucucgaugacagauucgcuaacgcccugacggcgcugaaugauauggggaagauucggaaggacauccaacagugggagcccuccaaaggauggaacgauuggacccaggugcccuuuugcucucaccauuuccacgaacucaucaugaaggacggcagaguucugguggucccuugucgcaaucaggaugagcuuauugggcgggccagaaucagccaaggagcuggcuggucccugcgcgaaacagccugccucgggaaaucuuaugcucagauguggagccugauguacuuucaccggagagaccuucgccuggccgcgaacgccauuuguuccgcugugccgucucauugggugcccaccagccggacaaccugguccauccacgccaagcaugaguggaugacaaccgaggacaugcucacgguuuggaauagaguguggauucgcgaaaacccuuggauggaggauaaaacacccgucgaaagcugggaggaaaucccuuaucugggcaagcgggaggaccaguggugcggaucucugauuggccucaccuccagagcuaccugggccaagaauauccaggcugccaucaaccaagugcgcagccugauugggaaugaggaauacacagauuacaugcccucuaugaaacgguucagacgggaggaagaggaagcgggaguucuuugguga

SEQ ID NO: 20150 - RNA, 9876 nt, Artificial Sequence
  derived and/or modified CDS sequence (opt5) from DENV-2__EU482469__SS-prME
agcgccggaaugaucauuaugcugauccccacagugauggcuuuccaccugacaacgcggaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgcccacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcaugggagcugugucaccacaauggcgaagaauaagcccacccuggauuucgaacuuauuaaaacagaggccaagcagccugcuacccugcgcaaauacugcaucgaagccaagcucacgaacacaaccaccgagucuagauguccgacacaaggagagcccucccugaaagaagaacaagacaagcgguuugugugcaagcacagcaugguggaucgcggcuggggcaauggguguggacuguucggcaaagggggaauugucacaugcgcuauguuuacaugcaagaaaaacauggaaggcaagaucguucagccugagaaucucgaauauacgauuguggugacaccccauucuggggaggagcacgccgucggaaacgacacaggcaaacacggcauggaaaucaaggugaccccucaguccagcaucacagaggcggaacugaccggguacggaacgguuaccauggaguguucucccagaacaggccuugauuucaaugaaauggugcugcuccaaauggagaacaaagccuggcugguccaucggcagugguuucuugaccugccgcucccuuggcugcccggggcugauaagcaggaguccaauuggauucagaaggaaacccuggugacauucaaaaacccucacgccaagaaacaagacguugugguccucggaagccaggagggcgcuaugcauaccgcccugacgggggccacagaaauccagauguccucuggcaaucuucuguuuaccggacaccucaagugccgccugagaauggacaaacuucaacugaagggcaugagcuauuccauguguacagggaaguucaaaguggucaaggagauugcugagacccagcauggaaccaucgugauucggguucaguacgaaggcgaugggagccccugcaaaauccccuucgagaucauggaccucgaaaagagauaugugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaccagguguucggggcuauuuacggcgccgcguuuucuggagugagcuggaccaugaagauccugauuggcguuaucauuacguggaucgggaugaacucccgcagcacaucucuguccgucagccuugugcucgugggaaucgucacccuguaucugggcgugaugguucaggcugauucuggguguguggucuccuggaaaaauaaggagcucaagugcggaagcggcauuuucaucaccgacaacgugcacacauggaccgaacaguacaaauuucaaccugagucccccucuaagcuggccagcgccauucagaaagcucaggaagaggggaucuguggcauucgguccguuacaagacuugagaaucugauguggaagcagaucacgccggaacucaaccauauccuggccgagaaugaagugaaacugaccauuaugacaggagauauccgcggcauuaugcaagcugggaagcggucucuuagaccucagcccaccgagcucaaauauagcuggaagacauggggaaaggccaaaaugcuguccaccgaaagcuacaaccagacguuccugaucgacggcccugagaccgcggagugccccaauacaaaccgcgccuggaacucucucgaagucgaggauuauggguuuggaguguucaccacaaacauuuggcugaaacuuaaagaaaagcaggacgcuuuuugugacuccaaacugaugagcgccgcuaucaaggauaaucgggccguucacgcggacaugggcuacuggaucgagucugcccucaacgauaccuggaagauugagaaggcuagcuucaucgaagugaagaauugccauuggccuaaaagccacacacuguggucuaacggcguccuggagagcgaaaugauuauccccaagaaccuugccgggccggugucccaacacaauuauagaccuggauaccauacccagauugcuggccccuggcaccucgggaaacuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaccgcggcgaggacggcuguugguaugggauggaaaucagaccccugaaggagaaagaagagaaucucguuaacagccuggugaccgccggacauggccagguggauaauuucucccuggggguccuuggaauggcucucuuucuggaagagaugcugcggacaagagugggcaccaagcacgcgauccuccugguugccgugucuuucgucacacuuauuaccgggaacaugagcuuuaaagaccugggacgcgugguugugauggucggcgcuacgauggccgaugacaucggcaugggggugaccuaccucgcccugcuggcugccuucaagguucggccuacauuugcggcuggacuucugcucagaaaacugaccuccaaggagcucaugaugacaaccauuggcaucgugcugcuuucucaaagcacgauucccgaaacaguccuggagcucaccgaugcccuggcccuggggaugauggugcuuaagaucgugcgcaauauggaaaaauaucagcuggcugucacaaucauggccauucucugcguuccuaacgcggugauccugcagaaugcuuggaagguguccuguaccauucucgccgucgugucuguuagcccccugcuucugaccuccagccagcagaagaccgacuggaucccucucgcccugacgauuaagggacugaaccccaccgcuaucuuccuuacaacccugucuagaacaaauaaaaagcgguccuggccgcucaacgaggccaucauggcugugggcauggucagcauucuggccucuucccuccugaaaaaugacaucccuaugaccgggccccuuguggcgggaggccugcugacgguuugcuacgugcucacaggccgcagcgccgaucuggaacuugagagagcuaccgacgucaagugggaggaucaggccgaaauuucuggguccagcccuauccuguccauuaccaucagcgaggacggaucuaugagcauuaagaacgaagaggaggaacagacacucaccauccugauccggacaggccuccuggugauuuccgggcuuuuucccaucucuauuccgaucacggcugccgccugguaucugugggaggucaaaaagcagcgcgcuggagugcugugggauguuccuucucccccucccaugggcaaagcggaacucgaggacggggccuacagaauuaagcaaaaaggaauccugggcuauucccagaucggcgcugggguguacaaggaaggaaccuuccauacaauguggcacgucacccggggcgccgugcuuaugcacaaggggaaacgcauugagcccuccugggccgauguuaagaaagaccugaucagcuacggaggcggguggaagcucgagggagaauggaaagagggcgaagaggugcagguccuggcucucgaaccuggcaagaauccgagagccgugcagacaaagcccgggcuguuuaaaaccaacacgggaaccauuggcgcggugucccuugauuucucuccugggacaagcggaucccccaucauugacaagaaaggcaagguugucgggcuguauggaaacggcguggugacccggagcggcgcuuacgucucugccaucgcccaaacagagaaaaauaucgaggauaacccugaaauugaggacgauaucuuucgcaagagacggcugaccauuauggaccuccaucccggggcuggaaagacaaaaagauaucugccugccaucgugcgcgaagcgauuaagcggggccuuagaacgcugauccucgcuccgacccgcguuguggccgccgagauggaagaggcucugcgggggcuccccauuagauaccagaccccugccauccgcgcugagcacaccggacgggaaaucgucgaccugaugugucaugccaccuucacaaugagacuucugucccccgugcgcguuccuaauuauaaccugauuaucauggaugaggcgcacuucacggaccccgccagcauugcugcccggggcuacaucucuaccagaguggaaaugggggaggcugccggcauuuuuaugacagccaccccgccuggaucccgggaucccuucccccagagcaaugcuccuaucaucgacgaggaacgcgagauucccgaaagauccuggaacucuggccaugagugggucacagauuuuaaagggaagaccgugugguucguuccuagcaucaaagcgggaaaugacauugccgcuugccuccggaagaacggcaagaaagugauccaacugucccgcaagacguuugauagcgaauaugucaaaacaagaaccaaugacugggauuucguggugaccacagacauuucugagaugggggccaacuuuaaggccgagcgggucaucgauccgagacgcuguaugaaacccguuauccuuaccgacggagaggaacgggugauucuggcuggcccuaugcccgugacacacuccagcgccgcgcagagacgcgggcggaucggcagaaauccuaagaacgaaaaugaccaguacauuuacaugggagagccccucgaaaacgaugaggacugcgcucacuggaaagaggccaagaugcugcuggauaauaucaacaccccggaaggcauuaucccuucuauguucgagcccgaacgcgagaaggucgacgccauugauggggaauaucggcucagaggagaggcucgcaaaacguuuguggaccuuaugagacggggcgaucugccuguuuggcuggccuacaagguggcggccgaggggaucaacuaugcugaccgcagaugguguuucgauggaaucaaaaauaaccagauucucgaagagaaugucgaaguggagaucuggacaaaggagggcgaacggaaaaagcugaagccccgcuggcuugacgccagaauuuacagcgauccucuggcucucaaagaguuuaaggaguucgccgcugggcggaaaucccugacccugaaccucaucacagagaugggcagacuucccaccuucaugacgcaaaagacccgcgacgcccuggauaaucuggcgguucuccauacagccgaagcuggaggccgggccuauaaccacgcucugucugagcuuccggagacccuggaaacacuccugcugcucacccuucuggccacagugaccgggggaauuuuucuguuccucaugagcggcagagggaucggaaaaaugacgcugggcaugugcugcaucauuacagccuccauccuucugugguacgcucagauucagccucauuggaucgcggccucuauuauccucgaguuuuuccugaucguccugcucauucccgaacccgagaagcagcgcaccccucaagacaaucagcuuaccuauguggucaucgcuauucugacagugguugccgccaccauggcuaacgaaaugggcuuucuggagaagaccaagaaggaccucgggcugggaagcaucgccacgcagcagccggaguccaauauucuugauaucgaccugcggcccgcgagcgccuggacccucuacgcuguggccacaaccuucgugacaccuaugcugagacacucuauugaaaacuccagcgucaauguuucccugaccgcuaucgccaaccaagcgacggugcucaugggccuugggaaaggauggccccugucuaagauggauaucggcgugccucugcucgccauuggguguuacagccaggucaaucccaucacccugacagcugcccuucugcuccugguggcucacuaugccauuaucggaccuggccugcaggcuaaagccacccgggaggcgcagaagcgcgccgcugccggcauuaugaagaacccgacaguugacgggaucaccgugaucgaucucgaccccauuccuuacgaucccaaauuugaaaagcaacuuggacaggucaugcugcugauccucugcgugacgcagguccugaugaugagaacaaccugggcucuuugugaggcccugacacucgccaccggcccuauuuccacccugugggaagggaaucccggacgguucuggaacacaacgaucgcggugucuauggcuaauauuuuucgcggcagcuaucuggccggggcuggacuccuuuucuccaucaugaaaaacaccacaaacaccagacggggcacaggcaauaccggggagacgcugggagagaaguggaaaagccgccugaacgcccucggcaagucugaauuucaaaucuacaaaaaguccgggauucaggagguugacagaacacuggccaaggaaggaaucaaacggggcgagaccgaucaucacgcugugagccgcgggucugccaaacuuagaugguucgucgagcggaauauggugaccccggaaggaaaaguuguggaccugggcugcggcagagggggaugguccuauuacuguggcgggcucaagaacguccgcgaggugaaaggacugacaaagggcgggccuggacaugaggaacccauucccaugagcaccuauggcuggaaucuggugcggcuccagucuggcguugaugucuuuuucaucccucccgaaaagugcgacacacuucugugugauauuggggagagcuccccuaacccgacgguggaggcgggaagaacccugcgcgugcucaaucuggucgaaaacuggcuuaauaacaauacacaguucugcaucaaaguucugaaccccuacaugccuucugugaucgagaagauggaagcccuccaacggaaauacggcggggcucuggugagaaauccccugagccgcaacuccacccacgagauguauugggucagcaaugccuccggaaacauugugucuagcguuaacaugaucucccggaugcucauuaauagauuuacaaugcgccauaagaaagcuaccuacgaaccugacguggaccuuggcucugggacgcggaacaucggaauugagagcgagauccccaaucuggauauuaucggcaagagaaucgaaaagauuaaacaggagcacgaaaccuccuggcacuaugaccaggaucauccguacaagacaugggccuaucacggcucuuacgagaccaaacagacagggagcgcguccagcauggucaacggagugguucgccugcucaccaagccuugggacgugcugcccacagucacccaaauggccaugacggauacaaccccuuucggccagcagcggguguuuaaagaaaagguggacaccagaacacaggagcccaaggaggggacgaagaaacuuaugaaaaucaccgcugaauggcuguggaaagagcucggcaagaagaaaacaccucgcauguguaccagagaagaguucacaaagaagguccggucuaaugccgcucugggcgccauuuuuaccgaugagaacaaauggaaguccgcucgcgaagccguugaggacagcagauucugggaacugguggauaaagagcggaaucuccaucuggaagggaagugcgagacauguguguauaacaugaugggaaaaagagagaagaaacuuggcgaauuuggcaaagcgaaggggucucgggccaucugguacauguggcugggagcucgcuuccucgaguuugaagcccugggcuuccuuaaugaggaccacugguuuuccagagaaaacagccugucuggggucgagggagagggccuccacaaacugggguacauucugcgggauguguccaagaaagaaggcggagcuauguaugccgacgacaccgccggcugggauacgcgcaucacccucgaggaccugaagaaugaagagaugguuacaaaccauauggaaggggagcacaagaaacuugcggaggcuaucuucaagcugaccuaccaaaauaaaguggucagagugcagcggcccacaccgcgcggaaccguuauggauauuaucagcagacgggaccagcgcggcuccgggcaagugggaacguauggccucaacacauuuaccaauauggaagcccagcugauuagacagauggagggggaaggcgucuucaagaacauccagcaucuuacagugaccgaggagguugccgugcacaacuggcuggcucgggucggacgcgaaagacucagccggauggccauuucuggcgaugacugcguggucaaaccucuggaugaccgcuucgcuaaugcccugacggcgcucaacgauauggggaagaucagaaaggacauccaacagugggagcccagcaaaggauggaaugauuggacccaggugcccuuuugcucccaucacuuccacgaacugauuaugaaggacggccggauccuuguugugccuuguagaaaccaggaugagcugauugggcgcgcccggaucucucaaggagcuggcuggagccucagagaaacagccugccuggggaaauccuacgcucagauguggucucuuauguauuuucaucgccgggaccugagacucgccgcgaaugccauuuguagcgcugucccgucccacugggugcccaccucucgcacaaccuggagcauccaugccaagcacgaguggaugacaaccgaggacaugcugacgguguggaaccggguuuggauuagagaaaauccuuggauggaggauaaaacacccguggaauccugggaggaaaucccuuaccugggcaagcgcgaggaccaguggugcggaagccucaucggccugaccucucgggcuaccugggccaagaacauucaggcugccaucaaucaagucagaucccuuauugggaacgaggaauauacagauuacaugcccagcaugaaacgcuuccggagagaggaagaggaagcgggagugcugugguga

SEQ ID NO: 20151 - RNA, 9876 nt, Artificial Sequence
  derived and/or modified CDS sequence (opt5) from DENV-2__EU482470__SS-prME
agcgccggaaugaucauuaugcugauccccaccgucauggcuuuccaccugaccacgagaaauggggagccucauaugauugucggaauccaggaaaagggcaagucccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucaugaccauucucugcguuccuaacgccgugauccugcagaaugcguggaagguguccuguaccauucucgcugucgugucuguuagcccccugcuucugacauccagccgccagaaaacggacuggaucccucucgcccugaccauuaagggacugaaccccacagccaucuuccuuaccacacugucuagaaccaauaaaaagcgguccuggccgcucaacgaggcuaucauggccgugggcauggucagcauucuggcuucuucccuccugaagaaugacaucccuaugacggggccccuuguggccggaggccugcugacaguuugcuaugugcucaccggccgcagcgcggaucuggaacuugagagagccaccgacgucaaaugggaggaucaagcugaaauuucuggguccagcccuauccuguccauuacaaucagcgaggacggaucuaugagcauuaagaacgaagaggaggaacagacccucacaauccugauccggacgggccuccuggugauuuccgggcuuuuucccaucucuauuccgaucaccgccgcugccugguaccugugggaggucaaaaagcagcgcgccggagugcugugggauguuccuucucccccucccaugggcaaagcugaacucgaggacggggcguauagaauuaagcagaagggaauccugggcuacucccaaaucggcgccgggguguacaaagaaggaacauuccacaccauguggcaugucacacggggcgcugugcuuaugcacaaggggaaacgcauugagcccuccugggccgauguuaagaaagaccugaucagcuauggaggcggguggaagcucgagggagaauggaaggagggcgaagaggugcagguccuggcccucgaaccuggcaaaaauccgagagcugugcagaccaagcccgggcuguuuaaaacgaacaccggaacaauuggcgccgugucccuugauuucucuccugggaccagcggaucccccaucauugacaagaaaggcaagguugucgggcuguacggaaacggcguggugacacggagcggcgcguaugucucugcuaucgcccagaccgagaaguccaucgaggauaauccugaaauugaggacgauaucuuucgcaaaagacggcugacaauuauggaccuccaccccggggccggaaagacgaaaagauaccugccugcuaucgugcgcgaagccauuaagcggggccuuagaacccugauccucgcgccgacacgcguuguggcugccgagauggaagaggcccugcgggggcuccccauuagauaucaaaccccugcuauccgcgccgagcauaccggacgggaaaucgucgaccugaugugucacgcuacauucacgaugagacuucugagccccgugcgcguuccuaacuacaaucugauuaucauggaugaggcccauuucaccgaccccgcgucuauugccgcucggggcuauaucuccacaagaguggaaaugggggaggccgcuggcauuuuuaugaccgccacaccgccuggaagccgggaucccuucccccaguccaacgccccuaucaucgacgaggaacgcgagauucccgaaagaucuuggaauagcggccacgagugggucaccgauuuuaaagggaagacggugugguucguuccuuccaucaaggcuggaaacgacauugcggccugccuccggaaaaauggcaagaaagugauccagcugagccgcaagacauuugauucugaauacgucaaaaccagaaccaacgacugggauuucguggugacaaccgacauuuccgagaugggggcuaauuuuaaggccgagcgggucaucgauccgagacgcuguaugaaacccguuauccuuacagacggagaggaacgggugauucuggccggcccuaugcccgugacccauagcucugcugcccaaagacgcgggcggaucggcagaaacccuaagaaugaaaacgaccaguacauuuauaugggagagccccucgaaaaugaugaggacugcgcgcacuggaaggaggcuaaaaugcugcuggauaacaucaauacgccggaaggcauuaucccuagcauguucgagcccgaacgcgagaaggucgacgccauugauggggaauaccggcucagaggagaggcccgcaaaacauuuguggaccuuaugagacggggcgaucugccuguuuggcuggcuuauaagguggccgcggaggggaucaacuacgccgaccgcagaugguguuucgauggaaucaaaaacaaucagauucucgaagagaacgucgaaguggagaucuggaccaaggagggcgaacggaagaaacugaagccccgcuggcuugacgcuagaauuuauuccgauccucuggcccucaaagaguuuaaggaguucgcugccgggcggaaaucucugacacugaaucucaucaccgagaugggcagacuucccacguucaugacccagaagacacgcgacgcucuggauaaccuggccguucuccacaccgcggaagccggaggccgggcuuacaaucaugcccugagcgagcuuccggagacacuggaaacccuccugcugcucacacuucuggcuaccgugacagggggaauuuuucuguuccucauguccggcagagggaucggaaagaugacacugggcaugugcugcaucauuaccgccucuauccuucugugguaugcccaaauucagccucacuggaucgcugcgagcauuauccucgaguuuuuccugaucguccugcucauucccgaacccgagaaacagcgcaccccucaggacaaccaacuuacauacguggucaucgccauucugaccgugguugcugccacaauggccaaugaaaugggcuuucuggagaagacgaaaaaggaccucgggcugggauccaucgcuacccagcagccggagagcaacauucuugauaucgaccugcggcccgccucugcguggacacucuacgccguggcuaccacauucgugaccccuaugcugagacauuccauugaaaauagcuccgucaacguuucucugacggccaucgcuaaucaggccaccgugcucaugggccuugggaaaggauggccccugagcaagauggauaucggcgugccucugcucgcgauuggguguuauucccaagucaaccccaucacacugaccgccgcccuucugcuccugguggcccacuacgcuauuaucggaccuggccugcaggccaaggcuacacgggaggcccagaaacgcgcggccgcuggcauuaugaagaauccgaccguugacgggaucacggugaucgaucucgaccccauuccuuaugaucccaaauuugaaaagcagcuuggacaagucaugcugcugauccucugcgugacacagguccugaugaugagaaccacaugggcccuuugugaggcucugacccucgccaccggcccuauuucuacacugugggaagggaaccccggacgguucuggaauacgaccaucgccgugagcauggcgaacauuuuucgcggcuccuaccuggcuggggccggacuccuuuucagcaucaugaaaaauacaaccaacacaagacggggcaccggcaacaugggggagacgcugggagagaaguggaaaucucgccugaaugcucucggcaaguccgaauuucagaucuauaagaaaagcgggauucaagagguugacagaacacuggccaaggaaggaaucaaacggggcgagaccgaucaccaugccgugucucgcggguccgcuaaacuuagaugguucgucgagcggaacauggugaccccggaaggaaaaguuguggaccugggcugcggcagagggggauggagcuacuauuguggcgggcucaagaauguccgcgaggugaagggacugacaaaaggcgggccuggacacgaagaacccauucccaugucuaccuacggcuggaaccuggugcggcuccagagcggcguugaugucuuuuucaucccucccgaaaagugcgacacacuucugugugauauuggggaguccucuccuaauccgacgguggaggccggaagaacccugcgcgugcucaaccuggucgaaaauuggcuuaacaauaacacacaguucugcaucaaaguucugaaucccuacaugccuagcgugaucgagaagauggaagcgcuccagcggaaauauggcggggcccuggugagaaacccccugucccgcaauagcacccaugagauguacugggucuccaacgcuucuggaaauauugugagcuccguuaacaugaucucucggaugcucauuaacagauuuacaaugcgccacaagaaggccaccuaugaaccugacguggaccuuggcagcgggacgcggaauaucggaauugaguccgagauccccaaccuggauauuaucggcaaaagaaucgaaaagauuaaacaagagcaugaaaccucuuggcacuacgaccaggaucacccguauaagacaugggcuuaccauggcagcuaugagaccaaacagacaggguccgccagcucuauggucaauggagugguucgccugcucaccaagccuugggacgugcugcccacagucacccagauggcgaugacggauacaaccccuuucggccaacagcggguguuuaaggaaaaaguggacaccagaacacaggagcccaaggaggggacgaagaaacuuaugaaaaucaccgccgaauggcuguggaaagagcucggcaagaagaagacaccucgcauguguaccagagaagaguucacacggaaaguccgcuccaacgcugcccugggcgcuauuuuuaccgaugagaauaaguggaaaagcgccagagaagcuguugaggacucuggguucugggaacugguggauaaggagcggaaccuccaccuggaaggaaaaugcgagacauguguguacaauaugaugggcaagagagagaagaaacuuggcgaauuugggaaggccaaaggaucccgggcgaucugguacauguggcugggcgcccgcuuccucgaguuugaagcucugggguuccuuaacgaggaccauugguuuagcagagaaaauucucuguccggagucgagggcgaggggcuccacaagcugggcuauauucugcgggaugugagcaaaaaggaaggaggcgccauguacgcugacgacaccgccgggugggauacgcgcaucacccucgaggaccugaagaacgaagagaugguuacaaaucacauggaaggagagcauaagaaacuugccgaggcgaucuucaaacugaccuaucagaacaaaguggucagagugcaacggcccacaccgcgcggcaccguuauggauauuaucuccagacgggaccagcgcgggagcggacaggugggcacguacgggcucaauacauuuaccaacauggaagcucaacugauuagacagauggagggcgaaggagucuucaaaaauauccagcaccuuacagugaccgaggagguugccgugcagaacuggcuggcccgggucggccgcgaaagacucucucggauggcuauuagcggggaugacugcguggucaagccucuggaugaccgcuucgccaacgcucugacggcccucaaugauaugggaaagaucagaaaagacauccaacagugggagcccuccaagggcuggaacgauuggacccaggugcccuuuugcucucaucacuuccaugaacugauuaugaaagacgggcggguucuuguggucccuuguagaaaucaggaugagcugaucggacgcgcgcggauuagccaaggcgccggguggucccucagagaaacagcuugccugggcaagucuuaugcccagauguggagccuuauguacuuucaccgccgggaccugagacucgcugccaacgcgaucuguuccgccgugccgucucacugggugcccaccagccgcacaaccugguccauucaugcuaaacacgaguggaugacaaccgaggacaugcugacgguuuggaaucggguguggaucagagaaaacccuuggauggaggauaagacacccgucgaaagcugggaggaaauuccuuaucugggaaagcgcgaggaccaguggugcggcucucucaucgggcugaccucccgggccaccugggcuaaaaauauccaggccgcuauuaaccaagugagaagccuuaucggaaaugaggaauacacagauuacaugcccucuaugaagcgcuuccggagagaggaagaggaagccggcguucugugguga

SEQ ID NO: 20152 - RNA, 9876 nt, Artificial Sequence
  derived and/or modified CDS sequence (opt5) from DENV-2__EU482471__SS-prME
agcgcuggaaugaucauuaugcugauccccacagugauggcuuuccaccugacaacgagaaauggggagccucauaugauugucggaauccaggaaaagggcaagucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcauuccgucggaaacgacacaggcaaacacggcauggaaaucaaggugaccccucagagcucuaucacagaggccgaacugaccggguauggaacgguuaccauggaguguucccccagaacaggccuugauuucaaugaaauggugcugcuccaaauggagaacaaagcguggcugguccaccggcagugguuucuugaccugccgcucccuuggcugcccggggccgauaagcaggagagcaauuggauucagaaggaaacccuggugacauucaaaaacccucaugcuaagaaacaagacguugugguccucggaucccaggagggcgccaugcacaccgcucugacgggggccacagaaauccagaugucuagcggcaaucuucuguuuaccggacaucucaagugccgccugagaauggacaaacuucaacugaagggcauguccuacagcauguguacagggaaguucaaaguggucaaggagauugccgagacccagcacggaaccaucgugauucggguucaguaugaaggcgaugggucucccugcaaaauccccuucgagaucauggaccucgaaaagagauacgugcugggacgccugauuacagucaacccuaucgugacggagaaagauuccccgguuaacauugaagcugagcccccuuuuggcgacagcuacaucauuaucgggguggagcccggccagcucaagcugaauugguucaagaaaggaucuagcauuggccaaauguuugaaaccacaaugagaggggcgaagagaauggccauccuuggagauaccgcuugggacuucggcucccucgggggagucuuuacaucuaucggcaaagcccuccaucagguguucggggccauuuauggcgcugccuuuagcggaguguccuggaccaugaagauccugauuggcguuaucauuacguggaucgggaugaacagccgcucuacaucccugagcgucucucuugugcucgugggaaucgucacccuguaccugggcgugaugguucaggcggauuccggguguguggucagcuggaaaaauaaggagcucaagugcggauccggcauuuucaucaccgacaacgugcacacauggaccgaacaguauaaauuucaaccugagucucccagcaagcuggcuuccgccauucagaaagcccaggaagaggggaucuguggcauucggucuguuacaagacuugagaaucugauguggaagcagaucacgccggaacucaaccacauccuggcugagaaugaagugaaacugaccauuaugacaggagauauccgcggcauuaugcaagccgggaagcggagccuuagaccucagcccaccgagcucaaauacuccuggaagacauggggaaaggcuaaaaugcugagcaccgaaucuuauaaccagacguuccugaucgacggcccugagaccgccgagugccccaauacaaaccgcgcguggaacucccucgaagucgaggauuacggguuuggaguguucaccacaaacauuuggcugaaacuuaaagaaaagcaggacgccuuuugugacagcaaacugaugucugcugccaucaaggauaaucgggcuguucaugccgacaugggcuauuggaucgaguccgcgcucaacgauaccuggaagauugagaaagccagcuucaucgaagugaagaauugccacuggccuaaaucucauacacuguggagcaacggcguccuggaguccgaaaugauuauccccaagaaccuugcugggccggugagccaacacaauuacagaccuggauaccacacccagauugccggccccuggcaucucgggaaacuggagauggacuucgauuuuugugacggaacgacagugaucgucaccgaagauugcggcaaccgcgggcccucucugcggaccacaaccgcuuccggaaagcucauuacggaguggugcuguagaagcugcacacugccuccgcuucgguaucgcggcgaggacggcuguugguacgggauggaaaucagaccccugaaggagaaagaagagaaucucguuaacucccuggugaccgccggacacggccagguggauaauuucucucuggggguccuuggaauggcccucuuucuggaagagaugcugcggacaagagugggcaccaagcaugcuauccuccugguugcggugagcuucgucacacuuauuaccgggaacauguccuuuaaagaccugggacgcgugguugugauggucggcgccacgauggcugaugacaucggcaugggggugaccuaucucgcccugcuggccgcuuucaagguucggccuacauuugccgcgggacuucugcucagaaaacugaccucuaaggagcucaugaugacaaccauuggcaucgugcugcuuagccaauccacgauucccgaaacaguccuggagcucaccgaugcucuggcccuggggaugauggugcuuaagaucgugcgcaauauggaaaaauaccagcuggccgucacaaucauggcuauucucugcguuccuaacgccgugauccugcagaaugcguggaaggugucuuguaccauucucgcugucgugagcguuagcccccugcuucugaccagcucucagcagaagacggacuggaucccucucgcccugacgauuaagggacugaaccccaccgccaucuuccuuacaacccuguccagaacaaauaaaaagcggagcuggccgcucaacgaggcuaucauggccgugggcauggucucuauucuggcuuccagccuccugaaaaaugacaucccuaugaccgggccccuuguggccggaggccugcugacgguuugcuaugugcucacaggccgcucugcggaucuggaacuugagagagccaccaacgucaagugggaggaccaggcugaaauuuccgggagcuccccuauccugagcauuaccaucucugaggauggaagcauguccauuaagaaugaagaggaggaacagacacucaccauccugauccggacaggccuccuggugauuucugggcuuuuucccaucagcauuccgaucacggccgcugccugguaccugugggaggucaaaaagcagcgcgccggagugcugugggacguuccuucucccccucccaugggcaaagcugaacucgaggauggggcguauagaauuaagcaaaaaggaauccugggcuacagccagaucggcgccgggguguacaaggaaggaaccuuccacacaauguggcaugucacccggggcgcugugcuuaugcacaaggggaaacgcauugagcccagcugggccgacguuaagaaagaucugaucuccuauggaggcggguggaagcucgagggagaauggaaagagggcgaagaggugcagguccuggcccucgaaccuggcaagaacccgagagcugugcagacaaagcccgggcuguuuaaaaccaacacgggaaccauuggcgccgugucucuugacuucagcccugggacauccggaagccccaucauugauaagaaaggcaagguugucgggcuguacggaaauggcguggugacccggucuggcgcguaugucuccgcuaucgcccaaacagagaaaagcaucgaggacaacccugaaauugaggaugacaucuuucgcaagagacggcugaccauuauggaucuccaccccggggccggaaagacaaaaagauaccugccugcuaucgugcgcgaagccauuaagcggggccuuagaacgcugauccucgcgccgacccgcguuguggcugccgagauggaagaggcccugcgggggcuccccauuagauaucagaccccugcuauccgcgccgagcauaccggacgggaaaucgucgaccugaugugucacgcuaccuucacaaugagacuucugucucccgugcgcguuccuaauuacaaccugauuaucauggacgaggcccauuucacggaucccgcguccauugccgcucggggcuauaucagcaccagaguggaaaugggggaggccgcuggcauuuuuaugacagccaccccgccuggaucccgggaccccuucccccagucuaaugccccuaucaucgaugaggaacgcgagauucccgaaagaagcuggaacuccggccacgagugggucacagacuuuaaagggaagaccgugugguucguuccuagcaucaaagcuggaaaugauauugcggccugccuccggaagaacggcaagaaagugauccaacugucucgcaagacguuugacuccgaauacgucaaaacaagaaccaaugauugggacuucguggugaccacagauauuagcgagaugggggcuaacuuuaaggccgagcgggucaucgacccgagacgcuguaugaaacccguuauccuuaccgauggagaggaacgggugauucuggccggcccuaugcccgugacacauucuagcgcugcccagagacgcgggcggaucggcagaaauccuaagaacgaaaaugaccaguacauuuauaugggagagccccucgaaaacgacgaggauugcgcgcacuggaaagaggcuaagaugcugcuggacaauaucaacaccccggaaggcauuaucccuuccauguucgagcccgaacgcgagaaggucgaugccauugacggggaauaccggcucagaggagaggcccgcaaaacguuuguggaucuuaugagacggggcgaccugccuguuuggcuggcuuauaagguggccgcggaggggaucaacuacgccgaucgcagaugguguuucgacggaaucaaaaauaaccagauucucgaagagaaugucgaaguggagaucuggacaaaggagggcgaacggaaaaagcugaagccccgcuggcuugaugcuagaauuuauucugacccucuggcccucaaagaguuuaaggaguucgcugccgggcggaaaagccugacccugaaccucaucacagagaugggcagacuucccaccuucaugacgcaaaagacccgcgaugcucuggacaaucuggccguucuccacacagcggaagccggaggccgggcuuacaaccaugcccuguccgagcuuccggagacccuggaaacacuccugcugcucacccuucuggcuacagugaccgggggaauuuuucuguuccucaugucuggcagagggaucggaaaaaugacgcugggcaugugcugcaucauuacagccagcauccuucugugguaugcccagauucagccucacuggaucgcugcguccauuauccucgaguuuuuccugaucguccugcucauucccgaacccgagaagcagcgcaccccucaagauaaucagcuuaccuacguggucaucgccauucugacagugguugcugccaccauggccaacgaaaugggcuuucuggagaagaccaagaaggaccucgggcugggaagcaucgcuacgcagcagccggagucuaauauucuugacaucgaucugcggcccgccuccgcguggacccucuacgccguggcuacaaccuucgugacaccuaugcugagacauagcauugaaaacuccucugucaauguuagccugaccgccaucgcuaaccaagccacggugcucaugggccuugggaaaggauggccccuguccaagauggacaucggcgugccucugcucgcgauuggguguuauucucaggucaaucccaucacccugacagccgcccuucugcuccugguggcccacuacgcuauuaucggaccuggccugcaggccaaagcuacccgggaggcccagaagcgcgcggccgcuggcauuaugaagaacccgacaguugaugggaucaccgugaucgaccucgaucccauuccuuaugaccccaaauuugaaaagcaacuuggacaggucaugcugcugauccucugcgugacgcagguccugaugaugagaacaaccugggcccuuugugaggcucugacacucgccaccggcccuauuagcacccugugggaagggaaucccggacgguucuggaacacaacgaucgccguguccauggcgaauauuuuucgcggcagcuaccuggcuggggccggacuccuuuucucuaucaugaaaaacaccacaaacaccagacggggcacaggcaauaucggggagacccugggagagaaguggaaaucccgccugaacgcucucggcaagagcgaauuucaaauuuauaaaaagucugggauccaggagguugauagaacgcuggccaaggaaggaauuaaacggggcgagacagaccaccaugccgugucccgcgggagcgcuaaacuuagaugguucgucgagcggaauauggugaccccggaaggaaaaguuguggaucugggcugcggcagagggggauggucuuacuauuguggcgggcucaagaacguccgcgaggugaaaggacugaccaagggcgggccuggacacgaggaacccauccccaugagcacauacggcuggaaucuggugcggcuccaguccggcguugacgucuuuuucauuccucccgaaaagugcgauacccuucugugugacaucggggagucuagcccuaacccgacaguggaggccggaagaacgcugcgcgugcucaaucuggucgaaaacuggcuuaauaacaauacccaguucugcaucaaaguucugaaccccuacaugccuuccgugauugagaagauggaagcgcuccaacggaaauauggcggggcccuggugagaaauccccugagccgcaacuccacacaugagauguacugggucucuaaugcuagcggaaacaucguguccucuguuaacaugauuagccggaugcucaucaauagauuuaccaugcgccacaagaaagccacauaugaaccugauguggaccuuggcuccgggacccggaacauuggaaucgagucugagauucccaaucuggacaucaucggcaagagaauugaaaagaucaaacaggagcaugaaacgagcuggcacuacgaucaggaccacccguauaagaccugggcuuaccauggcuccuaugagacaaaacagaccgggagcgccucuuccauggucaacggagugguucgccugcucacaaagccuugggaugugcugcccaccgucacacaaauggcgaugaccgacacgacaccuuucggccagcagcggguguuuaaagaaaagguggauaccagaacccaggagcccaaggaggggaccaagaaacuuaugaaaauuacggccgaauggcuguggaaggagcucggcaagaagaaaaccccucgcauguguacaagagaagaguucacccggaagguccgcagcaaugcugcccugggcgcuaucuuuacagacgagaacaaguggaaaucugccagagaagcuguugaggauucccgguucugggaacugguggacaaggagagaaaucuccaccuggaagggaaaugcgagaccuguguguacaacaugaugggaaagcgggagaagaaacuuggcgaauuuggcaaagccaaagggagccgcgcgauuugguacauguggcugggagccagauuccucgaguuugaagcucugggcuuccuuaaugaggaucauugguuuucucgggaaaacucccugagcggggucgagggagagggccuccacaagcugggguauauccugcgcgacguguccaaaaaggaaggcggagccauguacgcugaugacacagccggcugggacaccagaaucacgcucgaggaucugaaaaaugaagagaugguuaccaaccacauggaaggggagcauaagaaacuugccgaggcgauuuucaaacugacauaucaaaauaaggugguccgggugcagcgccccaccccgagaggaacaguuauggacaucauuagccggcgcgaucagagaggcucugggcaagugggaaccuacggccucaacacguuuacaaauauggaagcucagcugauccggcagauggagggggaaggcgucuucaaaaacauucagcaccuuaccgugacagaggagguugccgugcauaacuggcuggcccgcgucggaagagaacggcucagccgcauggcuaucuccggcgacgauugcguggucaagccucuggacgauagauucgccaaugcucugaccgcccucaacgacauggggaaaauccggaaggauauucaacagugggagcccucuaagggauggaaugacuggacacaggugcccuuuugcagccaccauuuccacgaacugaucaugaaagauggccggauucuuguugugccuugucgcaaccaggacgagcugaucgggcgggcgagaauuucccaaggagccggcuggucucuccgcgaaaccgcuugccuggggaaguccuaugcccagauguggucccuuauguacuuucaccggagagaucugcgccucgcugccaaugcgaucuguucugccgucccgagccauugggugcccacaucccggaccacauggagcauucacgcuaaacaugaguggaugaccacagaggacaugcugaccguguggaacagaguuuggauccgcgaaaauccuuggauggaggacaagacgcccguggaaucuugggaggaaaucccuuaucugggcaaacgggaggaucaguggugcggaucccucauuggccugacaagcagagccaccugggcuaagaacauccaggccgcuauuaaucaaguccgcucucuuaucgggaacgaggaauacaccgacuacaugcccuccaugaagcgguucagacgggaggaagaggaagccggagugcugugguga

SEQ ID NO: 20153 - RNA, 9876 nt, Artificial Sequence
  derived and/or modified CDS sequence (opt5) from DENV-2__EU482472__SS-prME
agcgccggcaugaucauuaugcugauccccaccgucauggcuuuccaccugaccacgagaaauggggaaccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggauggagucugcccucaacgauaccuggaaaaucgagaaggcuuccuucauugaagugaaaaauugccacuggccuaagagccauacacuguggucuaacggcguccuggagagcgaaaugaucauucccaaaaaccuugccgggccggugucccaacacaauuacagaccuggauaccacacccagaucgcuggccccuggcaucucgggaagcuggagauggacuucgauuuuugugacggaacgacagugauugucaccgaagauugcggcaaccgcgggcccagccugcggaccacaaccgccucuggaaagcucaucacggaguggugcuguagauccugcacacugccuccgcuucgguaucgcggcgaggacggcuguugguacgggauggaaauuagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuaucaccgggaacaugagcuuuaaggaccugggacgcgugguugugauggucggcgcuacgauggccgaugacauuggcaugggggugaccuaucucgcccugcuggcugccuucaaaguucggccuacauuugcggcuggacuucugcucagaaagcugaccuccaaggagcucaugaugacaaccaucggcauugugcugcuuucucaaagcacgauccccgaaacaguccuggagcucaccgaugcccuggcccuggggaugauggugcuuaaaauugugcgcaauauggaaaaguaccagcuggcugucacaaucauggccauccucugcguuccuaacgcggugauucugcagaaugcuuggaaaguguccuguaccauccucgccgucgugucuguuagcccccugcuucugaccuccagccagcaaaagacagacuggauuccucucgcccugacgaucaaaggacugaaccccaccgcuauuuuccuuacaacccugucuagaacaaauaagaaacgguccuggccgcucaacgaggccaucauggcugugggcauggucagcauccuggccucuucccuccugaagaaugacauuccuaugaccgggccccuuguggcgggaggccugcugacgguuugcuaugugcucacaggccgcagcgccgaucuggaacuugagagagcuaccgacgucaagugggaggaucaggccgaaaucucuggguccagcccuauucuguccaucaccauuagcgaggacggaucuaugagcaucaaaaacgaagaggaggaacagacacucaccauucugauccggacaggccuccuggugaucuccgggcuuuuucccauuucuaucccgauuacggcugccgccugguaccugugggaggucaagaaacagcgcgcuggagugcugugggauguuccuucucccccucccaugggcaaggcggaacucgaggacggggccuauagaaucaaacaaaagggcauucugggauacucccagaucggcgcugggguguacaaggaaggaaccuuccacacaauguggcaugucacccggggcgccgugcuuaugcacaaagggaagcgcaucgagcccuccugggccgauguuaaaaaggaccugauuagcuauggaggcggguggaaacucgagggagaauggaaggagggcgaagaggugcagguccuggcucucgaaccuggcaagaauccgagagccgugcagacaaaacccgggcuguuuaagaccaacacgggaaucauuggcgcggugucccuugauuucucuccugggaccagcggaucccccaucauugacaaaaagggcaaaguugucgggcuguacggaaacggcguggugacacggagcggcgcuuaugucucugccaucgcccaaaccgagaaguccaucgaggauaauccugaaauugaggacgauaucuuucgcaagagacggcugacaauuauggaccuccaccccggggcuggaaaaaccaagagauaccugccugccaucgugcgcgaagcgauuaaacggggccuuagaacacugauccucgcuccgacgcgcguuguggccgccgagauggaagaggcucugcgggggcuccccauuagauaucagaccccugccauccgcgcugagcauacaggacgggaaaucgucgaccugaugugucacgccaccuucaccaugagacuucugagccccgugcgcguuccuaacuacaaucugauuaucauggaugaggcgcauuucacagaccccgccucuauugcugcccggggcuauaucuccacgagaguggaaaugggggaggcugccggcauuuuuaugaccgccacaccgccuggaagccgggaucccuucccccaguccaacgcuccuaucaucgacgaggaacgcgagauucccgaaagaucuuggaauagcggccacgagugggucaccgauuuuaaggggaaaacagugugguucguuccuuccaucaaggcgggaaacgacauugccgcuugccuccggaagaauggcaaaaaggugauccaacugagccgcaaaaccuuugauucugaauacgucaagacgagaacaaacgacugggauuucguggugaccaccgacauuuccgagaugggggccaauuuuaaagccgagcgggucaucgauccgagacgcuguaugaagcccguuauccuuacagacggagaggaacgggugauucuggcuggcccuaugcccgugacccauagcucugccgcgcagagacgcgggcggaucggcagaaacccuaaaaaugaaaacgaccaguacauuuauaugggagagccccucgaaaaugaugaggacugcgcucacuggaaggaggccaagaugcugcuggauaacaucaauacaccggaaggcauuaucccuagcauguucgagcccgaacgcgagaaagucgacgccauugauggggaauaccggcucagaggagaggcucgcaagaccuuuguggaccuuaugagacggggcgaucugccuguuuggcuggccuauaaaguggcggccgaggggaucaacuacgcugaccgcagaugguguuucgauggaaucaagaacaaucagauucucgaagagaacgucgaaguggagaucuggacgaaagagggcgaacggaagaagcugaaaccccgcuggcuugacgccagaauuuauuccgauccucuggcucucaaggaguuuaaagaguucgccgcugggcggaagucucugacacugaaucucaucaccgagaugggcagacuucccacauucaugacccagaagacgcgcgacgcccuggauaaccuggcgguucuccacaccgccgaagcuggaggccgggccuacaaucaugcucugagcgagcuuccggagacacuggaaacccuccugcugcucacacuucuggccaccgugacagggggaauuuuucuguuccucauguccggcagagggaucggaaagaugacccugggcaugugcugcaucauuacggccucuauccuucugugguaugcucagauucagccucacuggaucgcggccagcauuauccucgaguuuuuccugaucguccugcucauucccgaacccgagaagcagcgcacaccucaagacaaccagcuuaccuacguggucaucgcuauucugaccgugguugccgccacaauggcuaaugaaaugggcuuucuggagaaaaccaagaaagaccucgggcugggauccaucgccacacagcagccggagagcaacauucuugauaucgaccugcggcccgcgucugccuggacgcucuacgcuguggccaccacauucgugaccccuaugcugagacauuccauugaaaauagcuccgucaacguuucucugacagcuaucgccaaucaagcgaccgugcucaugggccuugggaagggauggccccugagcaaaauggauaucggcgugccucugcucgccauuggguguuauucccaggucaaccccaucacgcugaccgcugcccuucugcuccugguggcucacuacgccauuaucggaccuggccugcaggcuaaggccacacgggaggcgcagaagcgcgccgcugccggcauuaugaaaaauccgaccguugacgggaucacagugaucgaucucgaccccauuccuuaugaucccaaguuugaaaaacaacuuggacaggucaugcugcugauccucugcgugacccagguccugaugaugagaacgacaugggcucuuugugaggcccugacccucgccacaggcccuauuucuacccugugggaagggaaccccggacgguucuggaauaccacaaucgcggugagcauggcuaacauuuuucgcggcuccuaccuggccggggcuggacuccuuuucagcaucaugaagaauacgaccaacacaagacggggcaccggcaacaucggggagacacugggagagaaauggaagucucgccugaaugcccucggcaaauccgaauuucaaauuuauaaaaagagcgggauccaggagguugacagaacccuggccaaagaaggaauuaagcggggcgagacggaucaccaugcugugucucgcggguccgccaaacuuagaugguucgucgagcggaacauggugacaccggaaggaaagguuguggaccugggcugcggcagagggggauggagcuacuauuguggcgggcucaaaaauguccgcgaggugaagggacugaccaagggcgggccuggacacgaagaacccauccccaugucuaccuacggcuggaaccuggugcggcuccagagcggcguugaugucuuuuucauuccucccgaaaaaugcgacacacuucugugugauaucggggaguccucuccuaauccgaccguggaggcgggaagaacacugcgcgugcucaaccuggucgaaaauuggcuuaacaauaacacgcaguucugcaucaagguucugaaucccuacaugccuagcgugauugagaaaauggaagcccuccaacggaaguauggcggggcucuggugagaaacccccugucccgcaauagcacccaugagauguacugggucuccaacgccucuggaaauaucgugagcuccguuaacaugauuucucggaugcucaucaacagauuuacaaugcgccacaaaaaggcuaccuaugaaccugacguggaccuuggcagcgggacacggaauauuggaaucgaguccgagauucccaaccuggauaucaucggcaagagaauugagaagaucaagcaggagcaugaaaccucuuggcacuacgaccaggaucacccguauaaaacgugggccuaccauggcagcuaugagaccaagcagacaggguccgcgagcucuauggucaauggagugguucgccugcucaccaaaccuugggacgugcugcccacagucacccaaauggccaugacagauaccacgccuuucggccagcagcggguguuuaaggaaaagguggacacaagaacccaggagcccaaagaggggaccaagaaacuuaugaagauuacagcugaauggcuguggaaagagcucggaaagaaaaagacgccucgcauguguaccagagaagaguucacacggaagguccgcuccaacgccgcucugggcgccaucuuuaccgaugagaauaaauggaaaagcgcuagagaagccguugaggacucucgguucugggaacugguggauaaagagagaaaccuccaccuggaagggaagugcgagacauguguguacaauaugaugggaaaacgggagaagaaacuuggcgaauuuggcaaagcgaaggggucccgcgccauuugguacauguggcugggagcuagauuccucgaguuugaagcccugggcuuccuuaacgaggaccauugguuuagccgggaaaauucucuguccggggucgagggagagggccuccacaaacugggguauauccugcgcgaugugagcaagaaagaaggcggagcuauguacgccgacgacaccgccggcugggauacaagaaucacccucgaggaccugaagaacgaagagaugguuacgaaucacauggaaggggagcauaagaaacuugcggaggcuauuuucaagcugaccuaucaaaacaaagugguccgggugcagcgccccacaccgagaggaaccguuauggauaucauuucccggcgcgaccagagaggcagcgggcaagugggaacauacggccucaauaccuuuacgaacauggaagcccagcugauccggcagauggagggggaaggcgucuucaagaauauucagcaccuuacagugaccgaggagguugccgugcauaacuggcuggcucgcgucggaagagaacggcucucucgcauggccaucagcggcgaugacugcguggucaaaccucuggaugacagauucgcuaacgcccugacagcgcucaaugauauggggaagauccggaaggacauucaacagugggagcccuccaaaggauggaacgauuggacccaggugcccuuuugcucucaccauuuccacgaacugaucaugaaggacggcagaguucuuguggucccuugucgcaaucaggaugagcugauugggcgggccagaaucagccaaggagcuggcuggucccuccgcgaaacggccugccuggggaaaucuuaugcucagauguggagccuuauguacuuucaccggagagaccugcgccucgccgcgaacgccauuuguuccgcugugccgucucauugggugcccaccagccggacaaccugguccauccacgccaagcaugaguggaugacaaccgaggacaugcugacaguuuggaauagaguguggauucgcgaaaacccuuggauggaggauaaaacccccgucgaaagcugggaggaaaucccuuaucugggcaagcgggaggaccaguggugcggaucucucaucggccugacguccagagcuacaugggccaagaauauucaggcugccaucaaccaagugcgcagccuuauugggaaugaggaauacaccgauuacaugcccucuaugaaacgguucagacgggaggaagaggaagcgggaguucugugguga

SEQ ID NO: 20154 - RNA, 9876 nt, Artificial Sequence
  derived and/or modified CDS sequence (opt5) from DENV-2__EU482473__SS-prME
agcgccggaaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucagagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuucucccccucccaugggcaaggcggaacucgaggacggggccuaucgcauuaaacagaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcaaacaaaacccgggcuguuuaagaccaacacgggaaccauuggcgcggugucccuugauuucucuccugggacaagcggaucccccaucauugacagaaaaggcaagguugucgggcuguacggaaacggcguggugacccggagcggcgcuuaugucucugccaucgcccagacagagaaauccaucgaggauaauccugaaauugaggacgauaucuuucgcaagagacggcugaccauuauggaccuccaccccggggcuggaaagacaaaaagauaccugccugccaucgugcgcgaagcgauuaagcggggccuuagaacgcugauccucgcuccgacccgcguuguggccgccgagauggaagaggcucugcgggggcuccccauuagauaucagaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaauccaacgcuccuaucaucgacgaggaacgcgagauucccgaaagaucuuggaauagcggccacgagugggucacagauuuuaaagggaagaccgugugguucguuccuuccaucaaagcgggaaacgacauugccgcuugccuccggaagaauggcaagaaagugauccagcugagccgcaagacguuugauucugaauacgucaaaacaagaaccaacgacugggauuucguggugaccacagacauuuccgagaugggggccaauuuuaaggccgagcgggucaucgauccgagacgcuguaugaaacccguuauccuuaccgacggagaggaacgggugauucuggcuggcccuaugcccgugacacauagcucugccgcgcagagacgcgggcggaucggcagaaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgcgagaaggucgacgccauugauggggaauaccggcucagaggagaggcucgcaaaacguuuguggaccuuaugagacggggcgaucugccuguuuggcuggccuauaagguggcggccgaggggaucaacuacgcugaccgcagaugguguuucgauggaaucaaaaacaaucaaauucucgaagagaacgucgaaguggagaucuggacaaaggagggcgaacggaaaaagcugaagccccgcuggcuugacgccagaauuuauuccgauccucuggcucucaaagaguuuaaggaguucgccgcugggcggaaaucucugacccugaaucucaucacagagaugggcagacuucccaccuucaugacgcagaagacccgcgacgcccuggauaaccuggcgguucuccacacagccgaagcuggaggccgggccuacaaucaugcucugagcgagcuuccggagacccuggaaacacuccugcugcucacccuucuggccacagugaccgggggaauuuuucuguuccucauguccggcagagggaucggaaaaaugacgcugggcaugugcugcaucauuacagccucuauccuucugugguaugcucagauucagccucacuggaucgcggccagcauuauccucgaguuuuuccugaucguccugcucauucccgaacccgagaagcaacgcaccccucaggacaaccagcuuaccuacguggucaucgcuauucugacagugguugccgccaccauggcuaaugaaaugggcuuucuggagaagaccaagaaggaccucgggcugggauccaucgccacgcagcaaccggagagcaacauucuugauaucgaccugcggcccgcgucugccuggacccucuacgcuguggccacaaccuucgugacaccuaugcugagacauuccauugaaaauagcuccgucaacguuucucugaccgcuaucgccaaucaggcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaagccacccgggaggcgcaaaagcgcgccgcugccggcauuaugaagaauccgacaguugacgggaucaccgugaucgaucucgaccccauuccuuaugaucccaaauuugaaaagcagcuuggacaggucaugcugcugauccucugcgugacgcaaguccugaugaugagaacaaccugggcucuuugugaggcccugacacucgccaccggcccuauuucuacccugugggaagggaaccccggacgguucuggaauacaacgaucgcggugagcauggcuaacauuuuucgcggcuccuaccuggccggggcuggacuccuuuucagcaucaugaaaaauaccacaaacaccagacggggcacaggcaacaugggggagacccugggagagaaguggaaaucucgccugaaugcccucggcaaguccgaauuucagaucuauaaaaagagcgggauucaggagguugacagaacgcuggccaaggaaggaaucaaacggggcgagacagaucaccaugcugugucucgcggguccgccaaacuuagaugguucgucgagcggaacauggugaccccggaaggaaaaguuguggaccugggcugcggcagagggggauggagcuacuauuguggcgggcucaagaauguccgcgaggugaaaggacugaccaagggcgggccuggacacgaggaacccauucccaugucuacauacggcuggaaccuggugcggcuccagagcggcguugaugucuuuuucaucccucccgaaaagugcgacacccuucugugugauauuggggaguccucuccuaauccgacaguggaggcgggaagaacgcugcgcgugcucaaccuggucgaaaauuggcuuaacaauaacacccaauucugcaucaaaguucugaaucccuacaugccuagcgugaucgagaagauggaagcccuccagcggaaauauggcggggcucuggugagaaacccccugucccgcaauagcacacaugagauguacugggucuccaacgccucuggaaauauugugagcuccguuaacaugaucucucggaugcucauuaacagauuuaccaugcgccacaagaaagcuacauaugaaccugacguggaccuuggcagcgggacccggaauaucggaauugaguccgagacgcccaaccuggauaucauuggcaagagaaucgaaaagaucaaacaggagcaugaaaccucuuggcacuacgaccaggaucacccguauaagacaugggccuaccauggcagcuaugagaccaaacaaacaggguccgcgagcucuauggucaauggagugguucgccugcucaccaagccuugggacgugcugcccacagucacccagauggccaugacggauacaaccccuuucggccagcagcggguguuuaaagaaaagguggacaccagaacacaagagcccaaggaggggacgaagaaacuuaugaaaauuaccgcugaauggcuguggaaagagcucggcaagaagaaaacaccucgcauguguaccagagaagaguucacacggaagguccgcuccaacgccgcucugggcgccaucuuuaccgaugagaauaaguggaaaagcgcuagagaagccguugaggacucucgguucugggaacugguggauaaggagagaaaccuccaccuggaagggaaaugcgagacauguguguacaauaugaugggaaagcgggagaagaaacuuggcgaauuuggcaaagcgaaagggucccgcgccauuugguacauguggcugggagcuagauuccucgaguuugaagcccugggcuuccuuaacgaggaccauugguuuagccgggaaaauucucuguccggggucgagggagagggccuccacaagcugggguauauccugcgcgaugugagcaaaaaggaaggcggagcuauguacgccgacgacaccgccggcugggauacgagaauuacccucgaggaccugaaaaacgaagagaugguuacaaaucacauggaaggggagcauaagaaacuugcggaggcuaucuucaaacugaccuaucagaacaaggugguccgggugcagcgccccacaccgagaggaaccguuauggauaucauuucccggcgcgaccaaagaggcagcggacaggugggaacguacggccucaauacauuuaccaacauggaagcccagcugauccggcagauggagggggaaggcgucuucaaaaauauucaacaccuuacagugaccgaggagguugccgugcagaacuggcuggcucgcgucggaagagaacggcucucucgcauggccaucagcggcgaugacugcguggucaagccucuggaugacagauucgcuaacgcccugacggcgcucaaugauauggggaaaauucggaaggacauccagcagugggagcccuccaagggauggaacgauuggacccaagugcccuuuugcucucaucacuuccaugaacugaucaugaaagacggcagaguucuuguggucccuugucgcaaucaggaugagcugauugggcgggccagaaucagccagggagcuggcuggucccuccgcgaaacagccugccuggggaagucuuaugcucagauguggagccuuauguacuuucaccggagagaccugcgccucgccgcgaacgccauuuguuccgcugugccgucucacugggugcccaccagccggacaaccugguccauccaugccaaacacgaguggaugacaaccgaggacaugcugacgguuuggaauagaguguggauucgcgaaaacccuuggauggaggauaagacacccgucgaaagcugggaggaaaucccuuaucugggcaaacgggaggaccaauggugcggaucucucauuggccugaccuccagagcuaccugggccaagaauauccagguggcuaucaaccagguucgcagccuuauugggaaugaggaauacacagauuacaugcccucuaugaagcgguucagacgggaggaagaggaagccggagugcugugguga

SEQ ID NO: 20155 - RNA, 9876 nt, Artificial Sequence
  derived and/or modified CDS sequence (opt5) from DENV-2__EU482474__SS-prME
agcgccggcaugaucauuaugcugauccccaccgugauggcuuuccaccugacaacgagaaauggggaaccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgauuaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagccauaaccagacguuccugauugacggcccugagaccgcggagugccccaauacaaacagagccuggaacucucucgaaguggaggauuauggguuuggagucuucaccacaaacaucuggcugcgccuuaaggaaaaacaggacgcuuuuugugacuccaagcugaugagcgccgcuaucaaggauaaucgggccgugcacgcggacaugggcuacuggauugagucugcccucaacgauaccuggaaaaucgagaaggcuuccuucauugaaguuaaaaauugccauuggccuaagagccacacacuguggucuaacggcgugcuggagagcgaaaugaucauucccaaaaaccuugccgggccggucucccaacacaauuauagaccuggauaccauacccagaucgcuggccccuggcaccucgggaagcuggagauggacuucgauuuuugugacggaacgacagugauugugaccgaagauugcggcaaccgcgggcccagccugcggaccacaaccgccucuggaaagcucaucacggaguggugcuguagauccugcacacugccuccgcuucgguaccgcggcgaggacggcuguugguaugggauggaaaucagaccccugaaagagaaggaagagaaucucgucaacagccugguuaccgccggacauggccagguggauaauuucucccugggggugcuuggaauggcucucuuucuggaagagaugcugcggacaagagucggcaccaaacacgcgauucuccugguggccguuucuuucgugacacuuaucaccgggaacaugagcuuuaaggaccugggacgcgucgugguuauggugggcgcuacgauggccgaugacauuggcaugggggucaccuaccucgcccugcuggcugccuucaaagugcggccuacauuugcggcuggacuucugcucagaaagcugaccuccaaggagcucaugaugacaaccaucggcauuguucugcuuucucaaagcacgauccccgaaacagugcuggagcucaccgaugcccuggcccuggggaugaugguccuuaaaaucgugcgcaauauggaaaaguaucagcuggcugugacaauuauggccauccucugcgucccuaacgcgguuauucugcagaaugcuuggaaaguguccuguaccauccucgccguggucucugugagcccccugcuucugaccuccagccagcaaaagacagacuggauuccucucgcccugacgaucaaaggacugaaccccaccgcuaucuuccuuacaacccugucuagaacaaauaagaaacgguccuggccgcucaacgaggccauuauggcuguuggcauggugagcauccuggccucuucccuccugaagaaugacauuccuaugaccgggccccuugucgcgggaggccugcugacggugugcuacguucucacaggccgcagcgccgaucuggaacuugagagagcuaccgacgugaagugggaggaucaggccgaaaucucuggguccagcccuauucuguccaucaccauuagcgaggacggaucuaugagcaucaaaaacgaagaggaggaacagacacucaccauccugauucggacaggccuccuggucaucuccgggcuuuuucccauuucuaucccgauuacggcugccgccugguaucugugggaggugaagaaacagcgcgcuggaguccugugggaugugccuucucccccucccaugggcaaggcggaacucgaggacggggccuacagaaucaaacaaaagggaauccugggcuauucccagauuggcgcugggguuuacaaggaaggaaccuuccauacaauguggcacgugacccggggcgccguccuuaugcacaaagggaagcgcaucgagcccuccugggccgaugugaaaaaggaccugauuagcuacggaggcggguggaaacucgagggagaauggaaggagggcgaagagguucaggugcuggcucucgaaccuggcaagaauccgagagccguccagacaaaacccgggcuguuuaagaccaacacgggaaccaucggcgcggugucccuugauuucucuccugggacaagcggaucccccauuaucgacaaaaagggcaaagugguugggcuguauggaaacggcgucgugacccggagcggcgcuuacgugucugccaucgcccaaacagagaaguccauugaggauaauccugaaaucgaggacgauauuuuucgcaagagacggcugaccaucauggaccuccaucccggggcuggaaaaacaaagagauaucugccugccauuguccgcgaagcgaucaaacggggccuuagaacgcugauucucgcuccgacccgcgugguugccgccgagauggaagaggcucugcgggggcuccccaucagauaccagaccccugccauccgcgcugagcacaccggacgggaaauuguggaccugaugugucaugccaccuucacaaugagacuucugagccccguccgcgugccuaacuauaaucugaucauuauggaugaggcgcacuucacggaccccgccucuaucgcugcccggggcuacauuuccaccagaguugaaaugggggaggcugccggcaucuuuaugacagccaccccgccuggaagccgggaucccuucccccaguccaacgcuccuaucauugacgaggaacgcgagauccccgaaagaucuuggaauagcggccaugagugggugacagauuuuaaggggaaaaccgucugguucgugccuuccauuaaggcgggaaacgacaucgccgcuugccuccggaagaauggcaaaaagguuauucaacugagccgcaaaacguuugauucugaauaugugaagacaagaaccaacgacugggauuucgucgugaccacagacaucuccgagaugggggccaauuuuaaagccgagcgggugaucgauccgagacgcuguaugaagcccgucauucuuaccgacggagaggaacggguuauccuggcuggcccuaugcccgugacacacagcucugccgcgcagagacgcgggcggauuggcagaaacccuaaaaaugaaaacgaccaguacaucuacaugggagagccccucgaaaaugaugaggacugcgcucacuggaaggaggccaagaugcugcuggauaacauuaauaccccggaaggcaucauuccuagcauguucgagcccgaacgcgagaaaguggacgccgucgauggggaauaucggcucagaggagaggcucgcaagacguuuguggaccuuaugagacggggcgaucugccuguuuggcuggccuacaaaguggcggccgaggggaucaacuaugcugaccgcagaugguguuucgauggaaucaagaacaaucagauucucgaagagaacgucgaaguggagaucuggacaaaagagggcgaacggaagaagcugaaaccccgcuggcuugacgccagaauuuacuccgauccucuggcucucaaggaguuuaaagaguucgccgcugggcggaagucucugacccugaaucucaucacagagaugggcagacuucccaccuucaugacgcagaagacccgcgacgcccuggauaaccuggcgguucuccauacagccgaagcuggaggccgggccuauaaucacgcucugagcgagcuuccggagacccuggaaacacuccugcugcucacccuucuggccacagugaccgggggaauuuuucuguuccucauguccggcagagggaucggaaagaugacgcugggcaugugcugcaucgucacagccucuauucuucugugguacgcucagauccagccucauuggauugcggccagcaucauucucgaguuuuuccugaucgugcugcucauccccgaacccgagaagcagcgcaccccucaagacaaccagcuuaccuaugucgugauugcuauccugacaguuguggccgccaccauggcuaaugaaaugggcuuucuggagaaaacaaagaaagaccucgggcugggauccauugccacgcagcagccggagagcaacauccuugauauugaccugcggcccgcgucugccuggacccucuacgcuguggccacaaccuucgucacaccuaugcugagacacuccaucgaaaauagcuccguuaacgugucucugaccgcuauugccaaucaagcgacggugcucaugggccuugggaagggauggccccugagcaaaauggauaucggcgucccucugcucgccaucggguguuacucccaggugaaccccauuacccugacagcugcccuucugcuccugguugcucacuaugccaucauuggaccuggccugcaggcuaaggccacccgggaggcgcagaagcgcgccgcugccggcaucaugaaaaauccgacaguggacgggauuaccgucaucgaucucgaccccaucccuuacgaucccaaguuugaaaaacaacuuggacaggugaugcugcugauucucugcgucacgcagguccugaugaugagaacaaccugggcucuuugugaggcccugacacucgccaccggcccuaucucuacccugugggaagggaaccccggacgguucuggaauacaacgauugcgguuagcauggcuaacaucuuucgcggcuccuaucuggccggggcuggacuccuuuucagcauuaugaagaauaccacaaacaccagacggggcacaggcaacaugggggagacccugggagagaaauggaagucucgccugaaugcccucggcaaauccgaauuucaaaucuacaaaaagagcgggauccaggagguggacagaacgcuggccaaagaaggaauuaagcggggcgagacagaucaucacgcugucucucgcggguccgccaaacuuagaugguucguggagcggaacaugguuaccccggaaggaaagguggucgaccugggcugcggcagagggggauggagcuauuacuguggcgggcucaaaaaugugcgcgaggugaagggacugaccaagggcgggccuggacaugaagaacccauccccaugucuacauauggcuggaaccugguucggcuccagagcggcgucgauguguuuuucauuccucccgaaaaaugcgacacccuucugugugauaucggggaguccucuccuaauccgacaguggaggcgggaagaacgcugcgcguccucaaccugguugaaaauuggcuuaacaauaacacccaguucugcauuaaggugcugaaucccuacaugccuagcgugaucgagaaaauggaagcccuccaacggaaguacggcggggcucuggucagaaacccccugucccgcaauagcacacacgagauguauuggguguccaacgccucuggaaauaucguuagcuccgugaacaugauuucucggaugcucaucaacagauuuaccaugcgccauaaaaaggcuacauacgaaccugacgucgaccuuggcagcgggacccggaauauuggaaucgaguccgagauucccaaccuggauaucauuggcaagagaaucgagaagaucaagcaggagcacgaaacgucuuggcacuaugaccaggaucauccguacaaaaccugggccuaucacggcagcuacgagacaaagcagaccggguccgcgagcucuauggugaauggaguugugcgccugcucacaaaaccuugggacguccugcccaccgugacacaaauggccaugaccgauacgacaccuuucggccagcagcggguguuuaaggaaaaggucgacaccagaacccaggagcccaaagaggggacaaagaaacuuaugaagauuacggcugaauggcuguggaaagagcucggaaagaaaaagaccccucgcauguguacaagagaagaguucacccggaagguucgcuccaacgccgcucugggcgccaucuuuacagaugagaauaaauggaaaagcgcuagagaagccguggaggacucucgguucugggaacugguggauaaagagagaaaccuccaucuggaagggaagugcgagaccugugucuauaauaugaugggaaaacgggagaagaaacuuggcgaauuuggcaaagcgaaggggucccgcgccauuugguacauguggcugggagcuagauuccucgaguuugaagcccugggcuuccuuaacgaggaccacugguuuagccgggaaaauucucuguccgggguggagggagagggccuccacaaacugggguacauccugcgcgauguuagcaagaaagaaggcggagcuauguaugccgacgacacagccggcugggauaccagaauuacgcucgaggaccugaagaacgaagagauggugaccaaucauauggaaggggagcacaagaaacuugcggaggcuaucuucaagcugacauaccaaaacaaagucgugcggguucagcgccccaccccgagaggaacagugauggauaucauuucccggcgcgaccagagaggcagcgggcaagucggaaccuauggccucaauacguuuacaaacauggaagcccagcugauccggcagauggagggggaaggcguguucaagaauauucagcaucuuaccguuacagaggagguggccguccaaaacuggcuggcucgcgugggaagagaacggcucucucgcauggccaucagcggcgaugacugcgucgugaaaccucuggaugacagauucgcuaacgcccugaccgcgcucaaugauauggggaagauucggaaggacauccagcagugggagcccuccaaaggauggaacgauuggacgcagguucccuuuugcucucaccauuuccacgaacugaucaugaaggacggcagagugcuugucgugccuugucgcaaucaagaugagcugauugggcgggccagaaucagccagggagcuggcuggucccuccgcgaaaccgccugccuggggaaaucuuacgcucagauguggagccuuauguauuuucaccggagagaccugcgccucgccgcgaacgccauuuguuccgcugugccgucucauuggguucccacaagccggaccacaugguccauccacgccaagcaugaguggaugaccacagaggacaugcugaccguguggaauagagucuggauucgcgaaaacccuuggauggaggauaaaacgcccguggaaagcugggaggaaaucccuuaccugggcaagcgggaggaccaguggugcggaucucucauuggccugacauccagagcuaccugggccaagaauauccaagcugccaucaaccagguucgcagccuuauugggaaugaggaauauaccgauuacaugcccucuaugaaacgguucagacgggaggaagaggaagcgggagugcugugguga

SEQ ID NO: 20156 - RNA, 9876 nt, Artificial Sequence
  derived and/or modified CDS sequence (opt5) from DENV-2__EU482475__SS-prME
agcgccggcaugaucauuaugcugauccccacagugauggcuuuccaccugacgacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagaccgacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgucgaccggcgcugguguuucgauggaaucaaaaacaaucagauucucgaagagaacguggaaguugagaucuggacaaaggagggcgaaagaaagaaacugaagccccgguggcuugacgcucgcauuuauuccgauccucuggcccucaaagaguuuaaggaguucgcugccgggagaaaaucucugacccugaaucucaucacagagaugggccggcuucccaccuucaugacgcaaaagaccagagacgcucuggauaaccuggccgugcuccacacagcggaagccggaggccgcgcuuacaaucaugcccugagcgagcuuccggagacccuggaaacacuccugcugcucacccuucuggcuacagucaccgggggaauuuuucuguuccucauguccggccgggggaucggaaagaugacgcugggcaugugcugcaucauuacagccucuauccuucugugguaugcccagauucagccucacuggaucgcugcgagcauuauccucgaguuuuuccugaucgugcugcucauucccgaacccgagaaacagagaaccccucaagacaaccagcuuaccuacgucgugaucgccauucugacaguuguggcugccaccauggccaaugaaaugggcuuucuggagaagaccaagaaggaccucgggcugggauccaucgcuacgcagcagccggagagcaacauucuugauaucgaccugcgccccgccucugcguggacccucuacgccguggcuacaaccuucgucacaccuaugcugcggcauuccauugaaaauagcuccguuaacgugucucugaccgccaucgcuaaucaagccacggugcucaugggccuugggaaaggauggccccugagcaagauggauaucggcgucccucugcucgcgauuggguguuauucccaggugaaccccaucacccugacagccgcccuucugcuccugguugcccacuacgcuauuaucggaccuggccugcaggccaaggcuaccagagaggcccagaaacgggcggccgcuggcauuaugaagaauccgacaguggacgggaucaccgucaucgaucucgaccccauuccuuaugaucccaaauuugaaaagcaacuuggacaggugaugcugcugauccucugcgucacacaggugcugaugaugcgcacaaccugggcccuuugugaggcucugacacucgccaccggcccuauuucuacccugugggaagggaaccccggaagauucuggaauacaacgaucgccguuagcauggcgaacauuuuucggggcuccuaccuggcuggggccggacuccuuuucagcaucaugaaaaauaccacaaacacccgcagaggcacaggcaacaugggggagacccugggagagaaguggaaaucucggcugaaugcucucggcaaguccgaauuucaaaucuauaagcgcagcgggauucaggagguggacagaacgcuggccaaagaaggaaucaagcggggcgagacagaucaccaugccgucucucgcggguccgcuaaacuuagaugguucguggagcggaacaugguuaccccggaaggaaagguggucgaccugggcugcggcagagggggauggagcuacuauuguggcgggcucaaaaaugugcgcgaggugaagggacugaccaagggcgggccuggacacgaagaacccauucccaugucuacauacggcuggaaccugguucggcuccagagcggcgucgauguguuuuucaucccucccgaaaaaugcgacacccuucugugugauauuggggaguccucuccuaauccgacaguggaggccggaagaacgcugcgcguccucaaccugguugaaaauuggcuuaacaauaacacccaguucugcaucaaggugcugaaucccuacaugccuagcgugaucgagaaaauggaagcgcuccaacggaaguauggcggggcccuggucagaaacccccugucccgcaauagcacacaugagauguacuggguguccaacgcuucuggaaauauuguuagcuccgugaacaugaucucucggaugcucauuaacagauuuaccaugcgccacaaaaaggccacauaugaaccugacgucgaccuuggcagcgggacccggaauaucggaauugaguccgagauccccaaccuggauauuaucggcaagagaaucgagaagauuaagcaggagcaugaaacgucuuggcacuacgaccaggaucacccguauaaaaccugggcuuaccauggcagcuaugagacaaagcagaccggguccgccagcucuauggugaauggaguugugcgccugcucacaaaaccuugggacguccugcccaccgugacacaaauggcgaugaccgauacgacaccuuucggccagcagcggguguuuaaggaaaaggucgacaccagaacccaggagcccaaagaggggacaaagaaacuuaugaagaucacggccgaauggcuguggaaagagcucggaaagaaaaagaccccucgcauguguacaagagaagaguucacccggaagguucgcuccaacgcugcccugggcgcuauuuuuacagaugagaauaaauggaaaagcgccagagaagcuguggaggacucucgguucugggaacugguggauaaagagagaaaccuccaccuggaagggaagugcgagaccugugucuacaauaugaugggaaaacgggagaagaaacuuggcgaauuuggcaaagccaaggggucccgcgcgaucugguacauguggcugggagccagauuccucgaguuugaagcucugggcuuccuuaacgaggaccauugguuuagccgggaaaauucucuguccgggguggagggagagggccuccacaaacugggguauauucugcgcgauguuagcaagaaagaaggcggagccauguacgcugacgacacagccggcugggauaccagaaucacgcucgaggaccugaagaacgaagagauggugaccaaucacaugaagggggaacauaagaaacuugccgaggcgaucuucaaacugacauaucaaaacaaagucgugcggguucagcgccccaccccgagaggaacagugauggauauuaucucccggcgcgaccagagaggcagcgggcaagucggaaccuacggccucaauacguuuacaaacauggaggcucagcugauucggcagauggaaggggagggcguguucaaaaauauccagcaccuuaccguuacagaagagguggccguccaaaacuggcuggcccgcgugggaagagagcggcucucucgcauggcuauuagcggcgaugacugcgucgugaagccucuggaugacagauucgccaacgcucugaccgcccucaaugauauggggaagauccggaaagacauccagcagugggaacccuccaagggauggaacgauuggacgcagguucccuuuugcucucaucacuuccaugagcugauuaugaaagacggcagagugcuugucgugccuugucgcaaucaagaugaacugaucgggcgggcgagaauuagccagggagccggcuggucccuccgcgagaccgcuugccuggggaagucuuaugcccagauguggagccuuauguacuuucaccggagagaccugcgccucgcugccaacgcgaucuguuccgccgugccgucucacuggguucccacaagccggaccacaugguccauucaugcuaaacacgaauggaugaccacagaggacaugcugaccguguggaauagagucuggauccgcgagaacccuuggauggaagauaagacgcccguggagagcugggaagagauuccuuaucugggcaagcgggaagaccaguggugcggaucucucaucggccugacauccagagccaccugggcuaaaaauauccaagccgcuauuaaccagguucgcagccuuaucgggaaugaggaguacaccgauuacaugcccucuaugaagcgguucagacgggaagaggaagaggccggagugcugugguga

SEQ ID NO: 20157 - RNA, 9876 nt, Artificial Sequence
  derived and/or modified CDS sequence (opt5) from DENV-2__EU482541__SS-prME
agcgccggaaugaucauuaugcugauccccaccgucauggcuuuccaccugaccacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauauccgcggcauuaugcaagcugggaagcggucucuuagaccucagcccgccgagcucaaauacagcuggaagaccuggggaaaggcgaaaaugcuguccacagaaagcuauaaccagaccuuccugaucgacggcccugagacggccgagugccccaauaccaaccgcgcuuggaacucucucgaagucgaggauuacggguuuggaguguucacaaccaacauuuggcugaaacuuaaagaaaagcaggacgccuuuugugacuccaaacugaugagcgcugccaucaaggauaaucgggcgguucaugccgacaugggcuauuggaucgagucugcucucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuacagaccuggauaccacacacagauugccggccccuggcaucucgggaaacuggagauggacuucgauuuuugugacggaaccacggugaucgucacagaagauugcggcaaccgcgggcccagccugcggaccaccacagccucuggaaagcucauuaccgaguggugcuguagauccugcacgcugccuccgcuucgguaucgcggcgaggacggcuguugguacgggauggaaaucagaccccugaaggagaaagaagagaaucucguuaacagccuggugacagcuggacacggccagguggauaauuucucccuggggguccuuggaauggcgcucuuucuggaagagaugcugcggaccagagugggcacaaagcaugccauccuccugguugcugugucuuucgucacccuuauuacagggaacaugagcuuuaaagaccugggacgcgugguugugauggucggcgccaccauggccgaugacaucggcaugggggugacguaucucgcucugcuggccgcguucaagguucggccuaccuuugcugccggacuucugcucagaaaacugacauccaaggagcucaugaugaccacaauuggcaucgugcugcuuucucaaagcaccauucccgaaacgguccuggagcucacagaugcccuggcucuggggaugauggugcuuaagaucgugcgcaauauggaaaaauaccagcuggccgucaccaucauggcgauucucugcguuccuaacgcugugauccugcagaaugccuggaagguguccuguacaauucucgccgucgugucuguuagcccccugcuucugaccuccagccagcagaagaccgacuggaucccucucgcucugacaauuaagggacugaaccccacggccaucuuccuuaccacacugucuagaaccaauaaaaagcgguccuggccgcucaacgaggcuaucauggccgugggcauggucagcauucuggcgucuucccuccugaaaaaugacaucccuaugacagggccccuuguggccggaggccugcugaccguuugcuaugugcucacgggccgcagcgcugaucuggaacuugagagagccacagacgucaagugggaggaucaggcugaaauuucuggguccagcccuauccuguccauuaccaucagcgaggacggaucuaugagcauuaagaacgaagaggaggaacagacccucacaauccugauccggaccggccuccuggugauuuccgggcuuuuucccaucucuauuccgaucacagccgccgcuugguaccugugggaggucaaaaagcagcgcgcgggagugcugugggauguuccuucucccccucccaugggcaaagccgaacucgaggacggggcuuauagaauuaagcaaaaaggaauccugggcuacucccagaucggcgccgggguguacaaggaaggaacguuccacaccauguggcaugucacacggggcgccgugcuuaugcacaaggggaaacgcauugagcccuccugggcugauguuaagaaagaccugaucagcuauggaggcggguggaagcucgagggagaauggaaagagggcgaagaggugcagguccuggcccucgaaccuggcaagaauccgagagcggugcagaccaagcccgggcuguuuaaaacaaacaccggaacgauuggcgcugugucccuugauuucucuccugggaccagcggaucccccaucauugacaagaaaggcaagguugucgggcuguacggaaacggcguggugacacggagcggcgccuaugucucugccaucgcucaaaccgagaaauccaucgaggauaauccugaaauugaggacgauaucuuucgcaagagacggcugacaauuauggaccuccaccccggggccggaaagaccaaaagauaccugccugcgaucgugcgcgaagcuauuaagcggggccuuagaacacugauccucgccccgacgcgcguuguggccgcugagauggaagaggcccugcgggggcuccccauuagauaucagaccccugcuauccgcgccgagcauacaggacgggaaaucgucgaccugaugugucacgcgaccuucaccaugagacuucugagccccgugcgcguuccuaacuacaaucugauuaucauggaugaggcccauuucacagaccccgcuucuauugccgcucggggcuauaucuccacgagaguggaaaugggggaggccgccggcauuuuuaugaccgcuacaccgccuggaagccgggaucccuucccccaguccaacgcgccuaucaucgacgaggaacgcgagauucccgaaagaucuuggaauagcggccacgagugggucaccgauuuuaaagggaagacagugugguucguuccuuccaucaaagccggaaacgacauugcugccugccuccggaagaauggcaagaaagugauccaacugagccgcaagaccuuugauucugaauacgucaaaacgagaacaaacgacugggauuucguggugaccaccgacauuuccgagaugggggccaauuuuaaggcugagcgggucaucgauccgagacgcuguaugaaacccguuauccuuacagacggagaggaacgggugauucuggccggcccuaugcccgugacccauagcucugcggcucagagacgcgggcggaucggcagaaacccuaagaaugaaaacgaccaguacauuuauaugggagagccccucgaaaaugaugaggacugcgcccacuggaaagaggccaagaugcugcuggauaacaucaauacaccggaaggcauuaucccuagcauguucgagcccgaacgcgagaaggucgacgcuauugauggggaauaccggcucagaggagaggcccgcaaaaccuuuguggaccuuaugagacggggcgaucugccuguuuggcuggcguauaagguggccgcugaggggaucaacuacgccgaccgcagaugguguuucgauggaaucaaaaacaaucagauucucgaagagaacgucgaaguggagaucuggacgaaggagggcgaacggaaaaagcugaagccccgcuggcuugacgcuagaauuuauuccgauccucuggcccucaaagaguuuaaggaguucgcugccgggcggaaaucucugacacugaaucucaucaccgagaugggcagacuucccacauucaugacccaaaagacgcgcgacgcgcuggauaaccuggccguucuccacaccgcugaagccggaggccgggcuuacaaucaugcccugagcgagcuuccggagacacuggaaacccuccugcugcucacacuucuggccaccgugacagggggaauuuuucuguuccucauguccggcagagggaucggaaaaaugacccugggcaugugcugcaucauuacggcuucuauccuucugugguaugcgcagauucagccucacuggaucgccgcuagcauuauccucgaguuuuuccugaucguccugcucauucccgaacccgagaagcagcgcacaccucaagacaaccagcuuaccuacguggucaucgccauucugaccgugguugccgcuacaauggccaaugaaaugggcuuucuggagaagaccaaaaaggaccucgggcugggauccaucgcgacacagcagccggagagcaacauucuugauaucgaccugcggcccgccucugcuuggacgcucuacgccguggcuaccacauucgugaccccuaugcugagacauuccauugaaaauagcuccgucaacguuucucugacagccaucgcgaaucaagccaccgugcucaugggccuugggaaaggauggccccugagcaagauggauaucggcgugccucugcucgcuauuggguguuauucccaggucaaccccaucacgcugaccgccgcccuucugcuccugguggcccacuacgcuauuaucggaccuggccugcaggccaaagcgacacgggaggcccagaagcgcgcugccgcuggcauuaugaagaauccgaccguugacgggaucacagugaucgaucucgaccccauuccuuaugaucccaaauuugaaaagcaacuuggacaggucaugcugcugauccucugcgugacccagguccugaugaugagaacgacaugggcccuuugugaggcccugacccucgcgacaggcccuauuucuacccugugggaagggaaccccggacgguucuggaauaccacaaucgcugugagcauggccaacauuuuucgcggcuccuaccuggcuggggccggacuccuuuucagcaucaugaaaaauacgaccaacacaagacggggcaccggcaacaucggggagacacugggagagaaguggaaaucucgccugaaugcccucggcaaguccgaauuucaaauuuauaaaaagagcgggauccaggagguugacagaacccuggcuaaggaaggaauuaaacggggcgagacggaucaccaugccgugucucgcggguccgcgaaacuuagaugguucgucgagcggaacauggugacaccggaaggaaaaguuguggaccugggcugcggcagagggggauggagcuacuauuguggcgggcucaagaauguccgcgaggugaaaggacugaccaagggcgggccuggacacgaggaacccauccccaugucuaccuacggcuggaaccuggugcggcuccagagcggcguugaugucuuuuucauuccucccgaaaagugcgacacacuucugugugauaucggggaguccucuccuaauccgaccguggaggccggaagaacacugcgcgugcucaaccuggucgaaaauuggcuuaacaauaacacgcaguucugcaucaaaguucugaaucccuacaugccuagcgugauugagaagauggaagcucuccaacggaaauauggcggggcccuggugagaaacccccugucccgcaauagcacccaugagauguacugggucuccaacgcuucuggaaauaucgugagcuccguuaacaugauuucucggaugcucaucaacagauuuacaaugcgccacaagaaagccaccuaugaaccugacguggaccuuggcagcgggacacggaauauuggaaucgaguccgagauucccaaccuggauaucaucggcaagagaauugaaaagaucaaacaggagcaugaaaccucuuggcacuacgaccaggaucacccguauaagacgugggcguaccauggcagcuaugagaccaaacagacaggguccgccagcucuauggucaauggagugguucgccugcucaccaagccuugggacgugcugcccacagucacccaaauggcuaugacagauaccacgccuuucggccagcagcggguguuuaaagaaaagguggacacaagaacccaggagcccaaggaggggaccaagaaacuuaugaaaauuacagccgaauggcuguggaaagagcucggcaagaagaaaacgccucgcauguguaccagagaagaguucacacggaagguccgcuccaacgcugcccugggcgcuaucuuuaccgaugagaauaaguggaaaagcgccagagaagcgguugaggacucucgguucugggaacugguggauaaggagagaaaccuccaccuggaagggaaaugcgagacauguguguacaauaugaugggaaagcgggagaagaaacuuggcgaauuuggcaaagccaaagggucccgcgcuauuugguacauguggcugggagccagauuccucgaguuugaagcucugggcuuccuuaacgaggaccauugguuuagccgggaaaauucucuguccggggucgagggagagggccuccacaagcugggguauauccugcgcgaugugagcaaaaaggaaggcggagccauguacgccgacgacaccgcgggcugggauacaagaaucacccucgaggaccugaaaaacgaagagaugguuacgaaucacauggaaggggagcauaagaaacuugcugaggccauuuucaaacugaccuaucaaaacaaggugguccgggugcagcgccccacaccgagaggaaccguuauggauaucauuucccggcgcgaccagagaggcagcgggcaagugggaacauacggccucaauaccuuuacgaacauggaagcccagcugauccggcagauggagggggaaggcgucuucaaaaauauucagcgccuuacagugaccgaggagguugcugugcacaacuggcuggccagagucggacgggaacgccucucuagaauggcuaucagcggcgaugacugcguggucaagccucuggaugaccgguucgccaacgcgcugacagcccucaaugauauggggaaaaucagaaaggacauucaacagugggagcccuccaagggauggaacgauuggacccaggugcccuuuugcucucaucacuuccaugaacugaucaugaaagacggccgcauucuuguugugccuugucggaaucaggaugagcugaucgggagagcucgcauuagccaaggagccggcuggucccuccgggaaacggcuugccuggggaagucuuaugcccagauguggagccuuauguacuuucacagacgcgaccugcggcucgcggccaacgcuaucuguuccgccgucccgucucacugggugcccaccagcagaacaaccugguccauucaugcuaaacacgaguggaugacaaccgaggacaugcugacaguguggaaucgcguuuggauccgggaaaacccuuggauggaggauaagacccccguggaaagcugggaggaaaucccuuaucugggcaaaagagaggaccaguggugcggaucucucauuggccugacgucccgcgccacaugggcuaagaauauccaggccgcgauuaaccaaguccggagccuuaucgggaaugaggaauacaccgauuacaugcccucuaugaagagauuccggagagaggaagaggaagccggagugcugugguga

SEQ ID NO: 20158 - RNA, 9876 nt, Artificial Sequence
  derived and/or modified CDS sequence (opt5) from DENV-2__EU482542__SS-prME
agcgccggcaugaucauuaugcugauccccaccgucauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaagugcccuucgagaucauggaccucgaaaagagauacguccugggacgccugaucacagugaacccuauuguuacggagaaagauucuccggugaacaucgaagcggagcccccuuuuggcgacuccuacauuaucauuggggucgagcccggccaacucaagcugaauugguucaagaaaggaagcucuaucggccagauguuugaaaccacaaugagaggggccaagagaauggcuauucuuggagauaccgccugggacuucggcagccucgggggaguguuuacauccaucggcaaagcccuccaucagguguucggggcuaucuauggcgccgcguuuucuggaguuagcuggaccaugaagauucugaucggcgucauuaucacguggauugggaugaacucccgcagcacaucucuguccgugagccuugugcucgucggaaucgugacccuguaccugggcguuauggugcaggcugauucugggugugucguguccuggaaaaauaaggagcucaagugcggaagcggcaucuucauuaccgacaacguucacacauggaccgaacaauauaaauuucagccugagucccccucuaagcuggccagcgccauccagaaagcucaggaagaggggacauguggcauucgguccgugacgagacuugagaaucugauguggaagcaaaucaccccggaacucaaccacauucuggccgagaaugaagucaaacugacaaucaugaccggagauaucaagggcauuaugcaggcugggaaacgcucucuucggccucagcccacagagcucaaguacagcuggaagaccuggggaaaagccaagaugcuguccacggaaagcuauaaccagaccuuccugaucgacggcccugagacagcggagugccccaauaccaacagagccuggaacucucucgaaguggaggauuacggguuuggaguuuucacaaccaacauuuggcugaaacuuaaggaaaaacaagacgcuuuuugugacuccaagcugaugagcgccgcuaucaaggauaaucgcgccgugcaugcggacaugggcuauuggauugagucugcccucaacgauacauggaaaaucgagaaggcuuccuucaucgaagucaaaaauugccacuggccuaagagccauacccuguggucuaacggcgugcuggagagcgaaaugauuauccccaaaaaccuugccgggccggugucccagcacaauuaccggccuggauaccacacgcagauugcuggccccuggcaucucgggaagcuggagauggacuucgauuuuugugacggaacaaccgucaucguuaccgaagauugcggcaacagagggcccagccugcgcacaaccacggccucuggaaagcucauuacagaguggugcugucgguccugcacccugccuccgcuuagauaucggggcgaggacggcuguugguacgggauggaaauccgcccccugaaagagaaggaagagaaucucgugaacagccuggugacagccggacacggccaagucgauaauuucucccugggggugcuuggaauggcucucuuucuggaagagaugcugaaaaccagaguuggcacaaagcaugcgauucuccugguggccgucucuuucgugacccuuaucacggggaacaugagcuuuaaagaccugggacggguuguggucauggugggcgcuaccauggccgaugacaucggcauggggguuacauaucucgcccugcuggcugccuucaaggugagaccuaccuuugcggcuggacuucugcuccgcaagcugacauccaaagagcucaugaugaccacgauuggcaucguccugcuuucucagagcacaauucccgaaaccgugcuggagcucacagaugcccuggcccuggggaugauggugcuuaagaucguccggaauauggaaaaauaccagcuggcuguuaccauuauggccauccucugcgugccuaacgcggugauccugcagaaugcuuggaaggucuccuguaccauucucgccgugguuucugugagcccccugcuucugacauccagccaacagaaaacggacuggaucccucucgcccugaccauuaagggacugaaccccacagcuaucuuccuuaccacacugucuagaaccaauaaaaagcgcuccuggccgcucaacgaggccauuauggcugucggcauggugagcauccuggccucuucccuccugaagaaugacaucccuaugacggggccccuuguugcgggaggccugcugacagugugcuauguccucaccggcagaagcgccgaucuggaacuugagcgggcuaccgacgugaaaugggaggaucaggccgaaauuucuggguccagcccuauccuguccauuacaaucagcgaggacggaucuaugagcauuaagaacgaagaggaggaacagacccucacaauccugauucgcacgggccuccuggucaucuccgggcuuuuucccaucucuauuccgaucaccgcugccgccugguaccugugggaggugaaaaagcaaagagcuggaguucugugggaugugccuucucccccucccaugggcaaagcggaacucgaggacggggccuaucggauuaagcagaagggaauccugggcuacucccagauuggcgcuggggucuacaaagaaggaacauuccacaccauguggcaugugacacgcggcgccguucuuaugcacaaggggaaaagaaucgagcccuccugggccgaugugaagaaagaccugaucagcuauggaggcggguggaagcucgagggagaauggaaggagggcgaagagguccaggugcuggcucucgaaccuggcaaaaauccgcgggccgugcaaaccaagcccgggcuguuuaaaacgaacaccggaacaauuggcgcgguuucccuugauuucucuccugggaccagcggaucccccaucauugacaagaaaggcaaggucguggggcuguacggaaacggcguggucacacgcagcggcgcuuaugugucugccaucgcccagaccgagaaguccauugaggauaauccugaaaucgaggacgauaucuuuagaaaacggcgccugacaauuauggaccuccaccccggggcuggaaagacgaaaagauaccugccugccaucguucgggaagcgauuaagagaggccuucgcacccugauccucgcuccgacacggguggucgccgccgagauggaagaggcucugagagggcuccccauucgcuaucagaccccugccauccgggcugagcauaccggaagagaaauuguggaccugaugugucacgccacauucacgaugcgccuucugagccccguucgggugccuaacuacaaucugaucaucauggaugaggcgcauuucaccgaccccgccucuauugcugccagaggcuauaucuccacacgcgucgaaaugggggaggcugccggcauuuuuaugaccgccacaccgccuggaagccgggaucccuucccccaauccaacgcuccuaucauugacgaggaaagagagauccccgaacggucuuggaauagcggccacgagugggugaccgauuuuaaagggaagacgguuugguucgugccuuccaucaaggcgggaaacgacauugccgcuugccuccgcaaaaauggcaagaaagucauccagcugagcagaaagacauuugauucugaauacgugaaaacccggaccaacgacugggauuucguggucacaaccgacauuuccgagaugggggccaauuuuaaggccgagcgcguuaucgauccgagacgguguaugaaacccgugauucuuacagacggagaagagagagugauccuggcuggcccuaugcccgucacccauagcucugccgcgcagcgccgggggagaaucggccgcaacccuaagaaugaaaacgaccaguacauuuauaugggagagccccucgaaaaugaugaggacugcgcucacuggaaggaggccaaaaugcugcuggauaacaucaauacgccggaaggcauuaucccuagcauguucgagcccgaacgggagaagguggacgccauugauggggaauacagacuccgcggagaggcucggaaaacauuuguugaccuuaugagacgcggcgaucugccuguguggcuggccuauaaggucgcggccgaggggaucaacuacgcugacagacggugguguuucgauggaauuaaaaacaaucaaauccucgaagagaacguggaaguugagaucuggaccaaggagggcgaacgcaagaaacugaagcccagauggcuugacgcccggauuuauuccgauccucuggcucucaaagaguuuaaggaguucgccgcugggcgcaaaucucugacacugaaucucaucaccgagaugggcagacuucccacguucaugacccagaagacacgggacgcccuggauaaccuggcggugcuccacaccgccgaagcuggaggcagagccuacaaucaugcucugagcgagcuuccggagacacuggaaacccuccugcugcucacacuucuggccaccgucacagggggaauuuuucuguuccucauguccggcaaggggaucggaaaaaugacacugggcaugugcugcauuaucaccgccucuauccuucugugguaugcucagauucagccucacuggaucgcggccagcauuauccucgaguuuuuccugauugugcugcucauccccgaacccgagaagcaacgcaccccucaggacaaccagcuuacauacgucgugaucgcuauucugaccguuguggccgccacaauggcuaaugaaaugggcuuucuggagaaaacgaagaaagaccucgggcugggauccaucgccacccagcaaccggagagcaacauucuugauaucgaccugcggcccgcgucugccuggacacucuacgcuguggccaccacauucgucaccccuaugcugagacauuccauugaaaauagcuccguuaacgugucucugacggcuaucgccaaucaggcgaccgugcucaugggccuugggaagggauggccccugagcaagauggauauuggcgucccucugcucgccaucggguguuauucccaggugaaccccaucacacugaccgcugcccuucugcuccugguugcucacuacgccauuaucggaccuggccugcaggcuaaagccacacgcgaggcgcaaaagcgggccgcugccggcauuaugaaaaauccgaccguggacgggaucacggucauugaucucgaccccaucccuuaugaucccaaguuugaaaaacagcuuggacaggugaugcugcugauccucugcgucacacaagugcugaugaugagaaccacaugggcucuuugugaggcccugacccucgccaccggcccuauuucuacacugugggaagggaaccccggacgguucuggaauacgaccaucgcgguuagcauggcuaacauuuuucgcggcuccuaccuggccggggcuggacuccuuuucagcaucaugaagaauacaaccaacacaagacggggcaccggcaacaugggggagacgcugggagagaaauggaagucucgccugaaugcccucggcaaguccgaauuucagauuuauaaaaagagcgggauccaggagguggacagaacacuggccaaagaaggaaucaagcggggcgagaccgaucaccaugcugucucucgcggguccgccaaacuuagaugguucguggagcggaacaugguuaccccggaaggaaagguggucgaccugggcugcggccgcgggggauggagcuacuauuguggcgggcucaagaaugugagagaggugaaaggacugacaaagggcgggccuggacacgaagaacccauucccaugucuaccuacggcuggaaccugguucggcuccagagcggcgucgauguguuuuucaucccucccgaaaaaugcgacacacuucugugugauauuggggaguccucuccuaauccgacgguggaggcgggaagaacccugcgcguccucaaccugguugaaaauuggcuuaacaauaacacacaauucugcaucaaggugcugaaucccuacaugccuagcgugauugagaaaauggaagcccuccagcggaaguauggcggggcucuggucagaaacccccugucccgcaauagcacccaugagauguacuggguguccaacgccucuggaaauaucguuagcuccgugaacaugaucucucggaugcucauuaacagauuuacaaugcgccacaagaaagcuaccuaugaaccugacgucgaccuuggcagcgggacgcggaauaucggaauugaguccgagauccccaaccuggauauuaucggcaagagaauugagaagaucaagcaggagcaugaaaccucuuggcacuacgaccaggaucacccguauaaaacaugggccuaccauggcagcuaugagaccaagcaaacaggguccgcgagcucuauggugaauggaguugugcgccugcucaccaagccuugggacguccugcccacagugacccagauggccaugacggauacaaccccuuucggccagcagcggguguuuaaagaaaaggucgacaccagaacacaagagcccaaagaggggacgaagaaacuuaugaagaucaccgcugaauggcuguggaaagagcucggaaagaagaaaacaccucgcauguguacccgggaagaguucacaagaaagguucgcuccaacgccgcucugggcgccauuuuuaccgaugagaauaaauggaaaagcgcuagagaagccguggaggacucucgguucugggaacugguggauaaagagcgcaaccuccaccuggaagggaagugcgagacaugugucuacaauaugaugggaaagagagagaagaaacuuggcgaauuuggcaaagcgaaagggucccgggccaucugguacauguggcugggagcuagauuccucgaguuugaagcccugggcuuccuuaacgaggaccauugguuuagccgggaaaauucucuguccgggguggagggagagggccuccacaaacugggguauauucugcgcgauguuagcaagaaggaaggcggagcuauguacgccgacgacaccgccggcugggauacgagaaucacccucgaggaccugaaaaacgaagagauggugacaaaucacauggaaggggagcauaagaaacuugcggaggcuauuuucaagcugaccuaucagaacaaagucgugcggguucagcgccccacaccgagaggaaccgugauggauaucaucucccggcgcgaccaaagaggcagcgggcaggucggaacguacggccucaauacauuuaccaacauggaagcccagcugauucggcagauggagggggaaggcguguucaagaauauccaacaccuuacaguuaccgaggagguggccguccagaacuggcuggcucgcgugggaagagaacggcucucucgcauggccauuagcggcgaugacugcgucgugaagccucuggaugacagauucgcuaacgcccugacggcgcucaaugauauggggaaaauccggaaggacauucagcagugggagcccuccaaaggauggaacgauuggacccaaguucccuuuugcucucaucacuuccaugaacugaucaugaaggacggccgcauccuuguggucccuuguagaaaucaggaugagcugauugggcgggccagaaucagccagggagcuggcuggucccuccgcgaaacagccugccuggggaaaucuuaugcucagauguggagccuuauguacuuucaccggagagaccugcgccucgccgcgaacgccauuuguuccgcugugccgucucacugggugcccaccagccggacaaccugguccauccaugccaagcacgaguggaugacaaccgaggacaugcugacgguuuggaauagaguguggauucgcgaaaacccuuggauggaggauaagacacccgucgaaagcugggaggaaaucccuuaucugggcaaacgggaggaccaauggugcggaucucucauuggccugaccuccagagcuaccugggccaagaauauccaggcugccaucaaccaggugcgcagccuuauugggaaugaggaauacacagauuacaugcccucuaugaaacgguucagacgcgaggaagaggaagcgggaguucugugguga

SEQ ID NO: 20159 - RNA, 9876 nt, Artificial Sequence
  derived and/or modified CDS sequence (opt5) from DENV-2__JX966380__SS-prME
accgccggcaugaucauuaugcugauccccacagugauggcuuuccaccucacgaccagaaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagagaagcgguccguggcgcuggugccucaugucgggaugggacucgaaacgcgcacagagaccuggaugucuagcgaaggcgcuuggaagcacgcccagagaaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaaugaaggauaaagccuggcucguucaccggcagugguuccuggaccuuccgcugccuuggcuccccggcgcugacacgcaggggucuaauuggauucagaaggagacacuggugaccuuuaaaaacccucaugccaagaaacaagaugucgugguucugggaucccaggaaggcgcuaugcacacagcccucaccggggccaccgagauccagaugagcuccggcaaucugcuuuucacaggacaucugaagugccgccucagaauggacaagcugcaacuuaaaggcaugucuuacagcauguguacggggaaguucaaaauugugaaggagaucgcugaaacccagcacggaacaauugucauccgggugcaguaugagggcgaugggucccccugcaaaauccccuuugaaauuauggaccuggagaagagacauguccucggacgccugaucaccgugaacccuauuguuacagagaaggauagcccggugaacaucgaagcggagcccccuuucggcgacucuuacauuaucauuggggucgaacccggccagcugaaacucgauugguuuaagaaaggauccagcaucggccaaauguucgagaccacgaugcggggggccaagagaauggcuauccugggagacacagccugggauuuuggcucucuugggggaguguucaccagcauuggcaaagcccugcaccagguuuuuggggcuaucuacggcgccgcguucuccggagugucuuggaccaugaagauucucaucggcgucauuaucacauggaucgggaugaauagccgcuccaccagccugucugugucccuggugcuuguuggaauugucacacucuaucugggcgugauggugcaggcugacagcgggugugucgugucuuggaagaacaaagaacugaagugcggauccggcaucuuuguuacggauaaugugcacaccuggacagagcaguacaaauuccaaccugagagccccuccaagcucgccucugccauucagaaagcucaugaagaggggaucuguggcauucggagcgucaccagacuggaaaaccuuauguggaagcagaucacauccgagcugaaucacauccucucugaaaacgaggugaaacugaccauuaugacgggagacaucaagggcauuaugcagguugggaagcgcagccugcggccgcaaccuaccgagcuuagauauuccuggaaaacauggggaaaggccaaaacccucagcacagaacugcauaaucagaccuuucugaucgacggccccgagacagcugaaugcccuaacaccaaucgcgccuggaacucucucgagguggaagauuacggguucggagucuuuacgacaaauauuuggcugcggcuuagagagaagcaggacguguucugugauuccaaacugaugagcgcggccaucaaggacaaccgcgcuguucacgccgauaugggcuauuggaucgagucugcucucaaugacaccuggaagauugaaaaagccuccuucaucgaggugaagagcugccacuggcccaaaucucauacccuguggagcaacggcguccuggaauccgagauggugauuccuaagaauuuugcggggcccgugagccagcacaacaaccggccgggauaccauacacaaaccgccggcccuuggcaccuugggaaacucgagauggauuucgacuuuugugaaggaacgacagucguugugaccgaggauugcggcaauagagggcccucucugcggacaaccacagcuuccggaaagcugaucaccgaauggugcugucgcagcugcacgcuccccccucugagauaucggggcgaggacggcuguugguacgggauggaaauuagaccgcuuaaggagaaagaggaaaaccugguguccucucucgucaccgccggacauggccagaucgauaauuucagccuggggauucugggaauggcucuuuuucucgaggaaaugcugcgcacacgggugggcaccaagcacgccauccugcucguugccguguccuucgucacacugaucaccgggaacaugucuuuuagagaccuuggacgcgugaugguuauggugggcgcuacgaugacagaugacauuggcaugggggucaccuaccuggcgcuccuggccgcuuucaaagugagacccacauuuaccgccggacugcuucugcggaagcucaccagcaaagagcugaugaugacaacgaucggcauuguucuccugucccagucuagcaucccugaaaccauucuugagcugacagacgcccucgcucuggggaugauggugcugaagaugguccgcaauauggagaaguaucaacuugccgugaccaucauggcgauccugugcgugcccaacgcugucauucuccagaaugccuggaaaguuuccuguacaauccuggccguggugagcgucucuccucuccugcuuaccuccagccagcagaaggcugauuggauuccccuggcccucacgaucaaaggacugaacccuacagcgauuuuccugaccacccuuucuagaacauccaagaaacggagcuggccccugaaugaagcuaucauggccgugggcaugguuucuauccucgccuccagccugcucaagaacgacauuccgaugaccgggccucugguggcuggaggccuucugacagucugcuacgugcugacgggccgcuccgccgaucucgagcuggaaagagcuaccgacguuaaaugggaugaccaagccgagaucagcgggucuagccccauucuuuccaucacaauuucugaagauggaagcauguccaucaagaaugaggaggaagagcagacccugacaauucucauccggaccggccugcucgugaucucugggcuguuuccugucagcauucccaucacggcggccgcuugguaucuuugggaagugaagaaacagcgcgccggaguccugugggacgugccguccccucccccuguuggcaaggcugagcuggaggauggggccuacagaauuaaacagaagggaauccucggcuauucucaaauuggcgccgggguguacaaagaaggaaccuuccacacaauguggcaugucacccggggcgcugugcugaugcacaaggggaagcgcaucgagcccagcugggcggacguuaaaaaggaucuuaucuccuauggaggcggguggaaacuggaaggagaguggaaggaaggcgaggaggugcagguccucgcccuggaacccggcaaaaacccuagagcugugcagacaaagccggggcucuuucggaccaauacaggaacgauuggcgccgugagccuggacuucucucccgggaccuccggaagcccuaucguugauaagaaaggcaaggucguggggcuuuacggaaacggcguggucacaagaucuggcgccuacguguccgcuauugcccagaccgagaaaagcaucgaagacaaucccgagauugaagacgauaucuuccgcaagcggagacugaccaucauggaccugcauccuggggcgggaaaaacaaagcgcuaucuccccgcuauuguucgggaggccaucaagagaggccugcgcacgcuuauucuggccccuacccggguggucgcugccgagauggaagaggcgcucagagggcugccgauccgcuaccaaacacccgcuauucgggccgaacacaccggaagagagaucguggaucucaugugucaugccacauuuaccaugcggcugcuuuccccuauucgcguucccaacuauaaccugaucaucauggacgaagcucacuucacggauccugccucuauugcugccagaggcuacaucagcacacggguggagaugggggaggcggccggcauuuuuaugaccgcuacccccccgggaucccgcgacccuuucccccagagcaaugcccccaucauggaugaagagagagaaauuccugagcggucuuggaacuccggccacgagugggucacagacuuuaaagggaagaccgugugguucguucccagcaucaaaacaggaaaugauaucgcugccugccugagaaagaacggcaaacgcgugauucagcucucucggaagaccuuugacagcgaauaugucaagacgagaacaaaugauugggacuucguggugaccacagacaucuccgagaugggggccaacuuuaaagcugaacgcgucauugauccucggagauguaugaagccgguuauccugaccgacggagaggaacgcgugauucuugcgggccccaugccugugacgcauucuagcgccgcucaacggagagggcgcaucggcagaaauccccggaacgagaaugaucaguacaucuauaugggagagccucuggaaaacgacgaggauugcgcccacuggaaagaagccaagaugcuccuggacaauauuaacacccccgagggcaucauuccguccauguucgaaccugagcgcgagaaagucgaugcuaucgacggggaauacagacugcggggagaggcccgcaagacauuuguggaucucaugagacggggcgaccuucccguuuggcuggcguacaaaguggcugccgaagggauuaauuaugccgauagacgcugguguuucgacggaacccggaacaaucagauccuggaggaaaacgucgagguggagauuuggacaaaggaaggcgagagaaagaaacucaagccucgcuggcuggaugcucggaucuacucugacccccuugcccugaaagaauucaaggaguuugcggccgggagaaaaagccucacccugaaccugaucacagagaugggccggcucccuaccuucaugacgcagaaggcucgcgacgcccuugauaaucuggcuguucugcauacagccgaagcuggaggcaaggccuauaaccacgcgcucuccgagcugcccgaaacccuugagacccugcuccugcugacacuccuugccaccgugacagggggaauuuuucuguuccugaugagcggcagagggaucggaaaaaugacgcucggcaugugcugcauuaucaccgcuucuauucugcuuugguacgcccaaauccagccgcacuggaucgcugccuccauuauccuggaauuuuuccucauuguccugcugaucccugagcccgagaagcagcggacaccccaggacaaucaacucaccuaugugauuaucgccauccuuacagucguggcugcgaccauggccaacgaaaugggcuuucuggagaaaacgaagaaagaucuggggcucggaaauauugcuacccagcagccugaaagcaacauccuggacauugaucuucgcccggccuccgccuggacacuguacgcuguugccaccacauucaucacccccaugcucagacauucuauugagaauagcuccgugaacgugucucugacggcgaucgccaaucaggcuacaguccugaugggccucgggaagggauggccucuuagcaagauggacauuggcguuccccugcuggccaucggguguuauucccaagugaacccuaucacccucacagcugcccugcuucugcucguggcgcacuacgccauuaucggacccggccugcaggcuaaagccacccgggaagcucagaagcgcgccgcugccggcauuaugaaaaauccuaccgucgaugggaucacagugauugaccuggauccgauccccuacgacccuaaguuugagaaacagcucggacaaguuaugcuucuggugcugugcgucacgcaggugcucaugaugagaaccacaugggcgcugugugaggcccuuacccuggcuacaggccccgucagcacccucugggaagggaacccuggacgguucuggaauacgacaaucgccgugucuauggcuaacauuuuucgcggcuccuaucuggccggggccggacugcucuucagcaucaugaagaauaccaccucuacaagacggggcaccggcaacauuggggagacacuuggagaaaaguggaaauccagacugaaugcgcugggcaagagcgaguuucagaucuacaaaaagucugggauucaagaaguugaucgcacgcucgcuaaagagggaaucaagcggggcgagaccgaccaucacgccgugagcagaggguccgcuaaacugcgcugguucgucgaacggaaccuugugacacccgagggaaagguuguggaucugggcugcggcagagggggauggucuuauuacuguggcgggcucaagaacguccgcgaagugaaaggacugaccaagggcgggccgggacaugaggagccuauccccaugagcacauauggcuggaaucuggugcggcuccaguccggcguugacgucuucuuugugcccccugaaaaaugcgacacccuucugugugauauuggggagagcucccccaacccuacgguggaagccggaagaacccugcgcguccucaaucugguugagaacuggcuuaauaacaauacacaguucugcgugaaggugcugaacccguacaugcccucugucaucgaacggauggagacccuccagagaaaauauggcggggcccuggugcgcaauccucugagccggaacuccacacacgagauguacuggguuucuaaugcuagcggaaacauuguguccucugucaauaugaucagcagaaugcucauuaaccgcuuuaccaugagacacaagaaggccacauacgaacccgacguggaucuuggcuccgggacccggaauaucggaaucgagagcgaaacgccuaaccuggacauuaucggcaaacgcauugagaagaucaaacaagaacaugagacaucuuggcacuaugaucaggaccaucccuacaagaccugggcguaucacggcuccuacgagaccaaacagacagggagcgccucuuccaugguuaacggaguggucagacugcucacgaagccgugggauguggugccuauggucacccagauggcuaugacagacaccacacccuucggccaacagcggguuuuuaaggaaaaaguggauaccagaacacaggagccuaaggaagggaccaaaaagcugaugaaaauuacggccgaguggcuuuggaaggaacugggaaagaaaaagaccccccggauguguacacgcgaggaguucaccaaaaaggugagaagcaaugcugcccucggcgcgaucuuuacagacgaaaacaaauggaagucugcccgggaggcugucgaagauucccgcuucugggagcugguggacaaagagagaaaucugcaccucgaagggaagugcgagaccuguguuuauaacaugaugggaaagcgggaaaaaaagcugggcgaguuuggcaaagccaaggggagccgcgcuauuugguacauguggcuuggagccagauuccuggaauuugaggcucucggcuuccugaaugaggaccauugguuuucccgggaaaacagccuuucugggguggagggagaaggccugcacaaacucggguauauccugcgcgaggucagcaagaaggaaggcggagccauguacgcggaugacacggccggcugggauacaagaaucaccauugaggaccugaaaaaugaggaaaugaucacaaaccauauggcuggggagcacaagaaacucgccgaagcuauuuucaagcugaccuaccagaauaaagugguucgggugcaacgcccuacgcccagaggaaccgucauggauaucauuucccggcgcgaccagagaggcucugggcaggugggaacauauggccuuaacaccuucacaaauauggaggcccaacugauccggcagauggaaggggagggcaucuuuaagaacauucagcaucucaccgccagcgaggaaaucgcgguucaggauuggcuggugagagucggacgcgagcggcuuuccagaauggcuauuucuggcgacgauugcguggucaagccgcuggacgaucgcuucgcccgggcccucacagcucugaaugacauggggaaagugagaaaggauauccaacagugggaaccuagccgcggauggaacgacuggacccagguucccuuuugcucccaccacuuccaugagcugauuaugaaagacggccggacgcucgugguccccuguagaaaucaggaugagcugaucgggcgcgcccggaucucucaaggagcuggcuggagccuuagagaaacagccugccuggggaaguccuacgcgcagauguggagccucauguauuuucaccgccgggaccugagacuugccgcuaacgccauuuguucugcugugccuucccauugggugccgaccagccggaccacauggucuauccacgccucccacgaguggaugaccacagaagauaugcugacgguuuggaacaaaguguggauucucgagaaucccuggauggaagacaagaccccugucgagagcugggaggaaauccccuaccugggcaagagagaggaucaguggugcggaucccugauuggccucacaucucgcgcgaccugggccaaaaacauccagacagcuauuaaucaagugcggagccugaucgggaacgaagaguauaccgacuacaugccuuccaugaagagauuccgcagagaagaggaggaagccggaguucuuugguga

SEQ ID NO: 20160 - RNA, 9876 nt, Artificial Sequence
  derived and/or modified CDS sequence (opt5) from DENV-2__JX966379__SS-prME
accgccggcaugaucauuaugcugauccccacagugauggcuuuccaccucacgaccagaaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagggaagcgguccguggcgcuggugccucaugucggaaugggccucgagacgcgcacagaaaccuggaugucuagcgagggcgcuuggaagcacgcccagagaaucgaaacauggauccugcggcaucccggguuuaccauuauggccgcuauccuggccuacaccauuggaacaacgcacuuccagcgcgugcucaucuuuauucugcuuaccgcuaucgccccuuccaugacaaugagaugcauuggcaucucuaaccgggauuucguugagggggugagcggaggcuccugggucgacaucgugcuggagcacgggagcuguguuaccacaauggcgaaaaauaagcccacccucgauuuugaacugauuaaaacggaggccaagcagccugcuucucuucgcaaauauugcaucgaagccaagcugacaaacaccaccacagacuccagauguccgacccaaggagagcccacacucaaugaagagcaggauaagcgguucgugugcaaacauagcauggucgaccgcggcuggggcaacggguguggacuguuuggcaaggggggaauugugacgugcgcuauguucaccugcaaaaagaauauggagggcaaaaucgugcagccugaaaaccuggaguacacagucguuauuaccccccacucuggggaagagcaugccgugggaaaugauacaggcaagcacggcaaagaagugaagaucaccccucaguccagcaucacggaggcggagcucaccggguauggaacagucaccauggaauguucucccagaacaggccuggacuuuaacgagauggugcuucugcaaauggaagauaaggccuggcucguucaccggcagugguuccuggaccuuccgcugccuuggcuccccggggcugacacccagggauccaauuggauucagaaagagacgcuggugacauuuaagaacccucaugccaaaaagcaagaugucgugguucugggcagccaggaaggggcuaugcacaccgcccucacaggcgccaccgagauccagauguccucuggaaaucugcuuuucaccggccaucugaaaugccgccucagaauggacaagcugcaacuuaaggggaugagcuacuccauguguacaggaaaauucaagauugugaaagagaucgcugaaacgcagcacggcaccauugucauccgggugcaguaugagggggauggaagccccugcaagauccccuuugaaauuauggaccuggagaaaagacauguccucggccgccugaucacagugaacccuauuguuaccgagaaggauucuccggugaacaucgaagcggagcccccuuucggggacuccuacauuaucauuggcgucgaacccggacagcugaagcucgauugguuuaaaaagggcagcucuaucgggcaaauguucgagacaaccaugcggggagccaaaagaauggcuauccugggcgacacggccugggauuuugggagccuuggaggcguguucacauccauugggaaggcccugcaccagguuuuuggcgcuaucuacggagccgcguucucuggcgugagcuggaccaugaaaauucucaucggggucauuaucaccuggaucggaaugaauucccgcagcacaucucuguccgugagccuggugcuuguuggcauugucacccucuaucugggggugauggugcaggcugacucuggaugugucguguccuggaagaacaaggaacugaaaugcggcagcgggaucuuuguuacagauaaugugcacacguggaccgagcaguacaaguuccaaccugagucccccucuaaacucgccagcgccauucagaaggcucaugaagagggcaucuguggaauucgguccgucacaagacuggaaaaccuuauguggaaacagaucaccccggagcugaaucacauccucucugaaaacgaggugaagcugacaauuaugaccggcgacaucaaagggauuaugcagguuggaaagcgcagccugcggccucaacccacggagcuuagauauuccuggaagaccuggggcaaagccaagaugcucagcacagaacugcauaaucagaccuuucugaucgacgggccugagacagcugaaugccccaacaccaaucgcgccuggaacucucucgagguggaagauuacggauucggcgucuuuacaaccaauauuuggcugcggcuuagagagaaacaggacguguucugugauuccaagcugaugagcgcggccaucaaagacaaccgcgcuguucacgccgauaugggcuauuggaucgagucugcucucaaugacacguggaagauugaaaaggccuccuucaucgaggugaaaagcugccacuggccuaagucucauacacuguggagcaacgggguccuggaauccgagauggugauucccaaaaauuacgcgggaccggugagccagcacaacaaccggccuggcuaucauacccaaaccgccgggcccuggcaccuuggaaagcucgagauggauuuugacuucugugaaggcacaaccgucguugugacggaggaaugcgggaauagaggacccucucugcggacaaccacagcuuccggcaaacugaucaccgaguggugcugucgcagcugcacacucccuccgcugagauaccggggcgaagauggguguugguacggaauggagauuagaccccuuaaggagaaggaagagaaccugguguccucucucgucaccgccggccaugggcagaucgacaauuuuagccugggaauucugggcauggcucuuuuccucgaagagaugcugcgcucccggguggggacgaaacacgccauccugcucguugccgugucuuuugucacccugaucacaggaaacaugagcuucagagaucuuggccgcgugaugguuauggugggcgcuaccaugacagacgauauugggaugggagucaccuaucuggcgcuccuggccgcuuacaaggugagaccuacguuugccgccggccugcuucugcggaaacucacauccaaggaacugaugaugaccacaaucgggauuguucuccugucucagagcuccauccccgagaccauucuugagcugaccgacgcucucgcccugggaaugauggugcugaaaaugguccgcaauauggaaaaguaucaacuugcggugacaaucauggcuauccugugcgugccuaacgccgucauucuccagaaugccuggaagguuagcuguacgacccuggcuguggugucugucuccccccuccugcuuacaagcucucagcagaaagccgacuggaucccucuggcgcucaccauuaagggccugaaccccacagcuaucuuccugaccacgcuuuccagaacaagcaaaaagcggucuuggccgcugaaugaggccauuauggccguggggaugguuuccauccucgcuagcucccugcucaaaaacgauaucccuaugaccggaccccugguggccggcggccuucugaccgucugcuacgugcugacagggcgcagcgcugaccucgaacuggagagagccaccgauguuaagugggacgaucaagcggaaauuucuggaagcuccccuauccuuucuauuacaaucagcgaggacggcuccaugucuauuaaaaaugaggaagaggaacagacgcugaccauccucauucggacagggcugcucgugaucagcggacuguuucccgucuccaccccgaucacagccgcugccugguaucuuugggaggugaagaagcagcgcgcuggcguccugugggaugugccuucucccccucccguugggaaagccgagcuggaagacggagccuacagaauuaagcagaaaggcauccucggcuauagccaaauuggggcuggaguguacaaggagggcaccuuccacacgauguggcaugucacccggggggcggugcugaugcacaaaggaaagcgcaucgaacccuccugggccgauguuaagaaagaccuuauuagcuacggcgggggauggaagcuggagggcgaauggaaagagggcgaggaagugcagguccucgcucuggagccugggaagaacccgagagccgugcagacaaaacccggacucuuucggaccaauacaggcaccaucggggccgugucucuggauuucuccccuggaacaagcggcucucccaucguugacaagaaggggaaagucgugggacuuuauggcaacggcguggucacgagauccggggcuuacgugagcgccauugcgcagaccgaaaaguccaucgaggauaauccugaaauugaggacgacaucuuucgcaaacggagacugacaauuauggaucugcaucccggagcuggcaagaccaaacgcuaucucccugccaucguucgggaggccaucaagagagggcugcgcacccuuauucuggcuccgacacggguggucgccgcggaaauggaggaagcucucagaggacugcccauccgcuaccaaacgccugccauucgggccgagcacaccggcagagaaaucguggaccucaugugucaugcuacauucaccaugcggcugcuuucucccauucgcguuccuaacuauaaccugaucauuauggaugaggcccacuucacagaccccgcuagcaucgccgcgagaggguacaucuccacccggguggagaugggcgaagccgcuggaauuuuuaugacggccacaccgccuggcagccgcgaucccuucccccagucuaaugcuccuaucauggacgaggaaagagagauucccgagcgguccuggaacagcgggcacgaaugggucaccgauuuuaagggaaaaaccgugugguucguuccuucuaucaaggccggcaaugacauugccacaugccugagaaaaaacgggaagcgcgugauccagcucagccggaaaaccuuugauuccgaguaugucaagacaagaaccaaugacugggauuucguggugacgacagacaucucugaaaugggagcuaacuuuaaggcggagcgcgucauugacccgcggagauguaugaaacccguuauccugaccgauggcgaagagcgcgugauucuugccgggccuaugcccgugacacauagcuccgcugcccaacggagaggccgcaucggaagaaauccucggaacgagaaugaccaguacauuuacaugggcgaaccccuggagaacgaugaagacugcgcccacuggaaggaggcuaaaaugcuccuggauaauaucaacaccccggaagggaucauuccuucuauguucgagcccgagcgcgaaaaggucgacgccaucgauggagaguauagacugcggggcgaagcgcgcaaaacguuuguggaccucaugagacggggggaucuuccuguuuggcuggcuuacaagguggccagcgagggaauuaauuaugccgacagacgcugguguuucgauggcacccggaacaaucagauccuggaagagaacgucgagguggaaauuuggacaaaagagggggaaagaaagaagcucaaaccccgcuggcuggacgcucggaucuacuccgauccucuugcccugaaggaguuuaaagaguucgcggccggcagaaagagccucacccugaaccugauuacagaaaugggacggcuccccaccuucaugacacagaaagcucgcgacgcccuugacaaucuggcuguucugcauaccgccgaggcuggcgggaaggccuauaaccacgcgcucucugaacugccggagacgcuugaaacacugcuccugcugacccuccuugccaccgugacaggaggcaucuuucuguuccugauguccgggagaggaaucggcaagaugacccucggcaugugcugcauuaucacagcuagcauucugcuuugguacgcccaaauccagccucacuggauugcugccuccaucauccuggaguuuuuccucauuguccugcugauccccgagcccgaaaaacagcggacgccucaggauaaucaacucaccuaugugauuaucgccauucuuacagucguggcugcgaccauggccaacgagaugggguuucuggaaaagacaaaaaaggaccugggacucggccauaucgcuacccagcagccggagucuaauauccuggauauugaccuucgccccgccagcgccuggacgcuguacgcuguugccaccacauucaucaccccuaugcucagacacuccauugaaaacucuagcgugaaugugucccugacagcgaucgccaaccaggcuaccguccugauggggcucggaaaaggcuggccccuuagcaagauggauauugggguuccucugcuggccaucggauguuacucucaagugaaucccauuacgcucacagcugcccugcuucugcucguggcgcauuaugccaucaucggcccuggccugcaggcuaaggccacccgggaggcucagaaacgcgccgcugccgggauuaugaagaacccgacagucgacggaaucaccgugauugaucuggaccccaucccuuacgaucccaaauuugagaagcagcucggccaaguuaugcuucuggugcugugcgucacccaggugcucaugaugagaacaacgugggcgcugugugaagcccuuacccuggcuacagggccugucuccacccucugggagggaaaucccggccgguucuggaacacaaccauugccgugagcauggcuaauaucuuucgcgggucuuaucuggccggagccggccugcucuucuccaucaugaaaaacacgacaagcaccagacggggcaccgggaauauuggagaaacacuuggcgagaaguggaagucuagacugaacgcgcuggggaaaagcgaauuucagaucuacaagaaauccggaauucaagagguugaccgcacccucgcuaaggagggcaucaaacggggggaaacagaucaccaugccgugucuagaggaagcgcuaagcugcgcugguucgucgagcggaaucuugugacgccggaaggcaaaguuguggaccugggcugcgggagaggaggcugguccuauuacugugggggacucaagaacguccgcgaggugaagggccugaccaaagggggaccuggccacgaggaacccauucccaugagcacauauggcuggaaccuggugcggcuccaguccgggguugaugucuuuuucgugccucccgagaagugcgacacccuucugugugacaucggagaaucuagcccuaauccgacaguggaggccggcagaacccugcgcguccucaaccugguugaaaauuggcuuaacgauaauacgcaguucugcgugaaagugcugaaccccuacaugccuuccgucaucgagcggauggagacccuccagagaaaguacgggggagcccuggugcgcaauccccugucucggaacagcacacacgaaauguauuggguuuccaaugcuucuggcaacguggucagcuccgugaauaugauuagcagaaugcucaucaaccgcuuuaccaugagacauaaaaaggccacauacgagccugacguugaucuugggucuggaacccggaauauuggcaucgaauccgagacacccaaccuggacauuaucggcaagcgcaucgaaaaaauuaagcaagagcacgaggcgagcuggcauuaugaucaggaccacccguacaaaaccugggccuaucacgggucuuacgaaacgaagcagacaggauccgcuagcucuauggugaauggcgucgugagacugcucaccaaaccuugggaugugguccccaugguuacccagauggccaugacagacacgaccccuuucgggcaacagcggguguuuaaggagaagguggauacaagaacccaggaacccaaagagggaacaaagaaacugaugaagaucaccgcugaauggcuuuggaaagagcugggcaagaagaaaacaccucggauguguacccgcgaggaauucacgaagaaagucagauccaacgccgcgcucggggccauuuuuaccgacgagaacaaguggaaaagcgcucgggaagccguggaggauaaucgcuucugggagcugguugacaaggaaagaaaccugcaucucgagggaaaaugcgaaacauguguguauaauaugaugggcaagcgggagaagaaacugggcgaauuugggaaggcucgcggauccagagccaucugguacauguggcuuggcgcucgguuccuggaguuugaggcccucggguuccugaacgaagaccacugguuuagccgcgagaauucucuuagcggagucgaaggcgaggggcugcauaaacucggcuacauucugagagaaguguccaagaaagagggaggcgcgauguaugccgaugacaccgcugggugggauacacggaucaccauugaggaccugaagaacgaagagaugaucacgaaucacauggccggagaacauaagaaacucgcugaggccaucuucaagcugacauaccagaacaaaguugugcgcguccaaagacccaccccgcggggcacagugauggauauuaucucucgcagagaccagcgggggagcggacagguugugaccuauggccuuaauacguuuaccaacauggaagcccaacugauuagacagauggagggggagggcaucuucaaguccauucagcaccucacagcgucugaagagaucgcuguccaggauuggcuggcccgcgugggacgggaaagacuuagccgcauggccaucuccggcgacgauugcgucgugaaaccucuggacgaucgguucgcuagagcccucaccgcucugaaugacauggggaagguucgcaaggauauucaacagugggagcccucucggggauggaacgacuggacacaggugcccuuuugcagccaccauuuccacgagcugaucaugaaagacggcagaacccucgucgugccuugucgcaaucaggaugaacugauugggcgggccagaaucucccaaggagcgggcuggagccuucgcgagacagccugccuggggaagucuuacgcucagauguggucccucauguauuuucaucggagagaccugcggcuugccgcuaacgccauuuguagcgcggugccgucucacuggguucccaccuccagaacgacauggagcauccacgccucccaugaauggaugaccaccgaggauaugcugacaguguggaaucgcgucuggauccucgaaaacccuuggauggaggacaaaacccccguggagucuugggaagagauuccuuaccugggcaagcgggaagaucaguggugcggaagccugaucggccucacauccagagcuacgugggccaaaaacauucagaccgcuaucaaucaaguucgcagccugauugggaacgaggaauauacagacuacaugcccucuaugaagagauuccggcgcgaggaggaagaggccggagugcuuugguga

SEQ ID NO: 20161 - RNA, 9876 nt, Artificial Sequence
  derived and/or modified CDS sequence (opt5) from DENV-2__KP012546__SS-prME
accgccggaaucauuaucaugaugauucccacagugauggcuuuccaccugacgaccagaaacggggagccucauaugaucgucagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugccacuggccuaaaagccauacccugugguccaauggcguccuggagagcgaaaugauuauccccaagaacuucgccgggccgguuucucagcacaauuaucgcccuggauaccauacgcagacagcuggccccuggcaccuugggcggcucgagauggauuuugacuucugugaaggaaccaccgugguggucacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggugaacucucucguuaccgccggacauggccagauugauaauuuuagccugggggugcugggaauggcucuuuuccucgaggaaaugcugcgcacacgggucggcaccaagcacgcgauccugcucguggccguuuccuuugugacgcugauuaccgggaacaugucuuucagagaccuuggacgcgucauggugaugguuggcgcugccaugacagaugacaucggcaugggggugaccuaccuggcccuccuggcugccuuuaaggucagaccuacauucgcggcuggacugcuucugcggaaacucaccagcaaggagcugaugaugacgacaaucggcauugugcuccugucccaaucuaccaugcccgagacaauccuugaacugaccgaugcccucgcccuggggaugauggugcugaaaauuguccgcaauauggagaaguaucagcuugcuguuaccaucauggccauucugugcgugccuaacgcggugauccuccagaaugcuuggaaagucagcuguacaacgcuggccgugguuuccgugagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgucggcauggugagcauccucgcgucuucccugcucaaaaacgauauuccuaugacagggccccugguugccggaggccuucugaccgugugcuacguccugaccggccgcagcgcugaccucgagcuggaaagagccgcugacgugcggugggaggagcaggccgaaaucuccgggagcucuccuauccuuagcauuacaaucuccgaggauggaucuaugagcauuaagaaugaagaggaggaacagacccugacaauccucauucgcacgggccugcucgucaucuccgggcuguuccccgugucuauuccgaucaccgccgcugcgugguaucuuugggagguuaaaaagcaaagagccggagugcugugggacgucccuucucccccucccgugggcaaagcugaacuggaggauggggccuaccggaucaagcagaagggcauucucggcuauucccagaucggcgccgggguuuacaaagaaggaacauuucacaccauguggcaugugacacgcggcgcuguccugaugcacaaggggaaaagaauugagcccuccugggccgacgugaagaaagaucuuaucagcuacggaggcggguggaagcuggagggagaauggaaggagggcgaagaggugcagguucucgcgcuggaaccuggcaaaaacccgcgggcuguccaaaccaagcccggacucuucaaaacgaacaccggaacaauuggcgccgugucccuggacuuuagcccugggaccucuggaucccccaucguggauaagaaaggcaaggucguggggcuuuauggaaauggcguugugacaagaagcggcaccuacgucucugccaucgcucagacagagaaguccauugaggacaacccugaaaucgaggaugacauuuuccgcaaaaagcggcugacgaucauggaucugcaucccggggccggaaaaaccaagagauaucucccugcgauugugcgcgaagcuaucaaacggggccugagaacacuuauccuggccccgacccgcguuguggccgcugagauggaagaggcccuccgggggcugcccauuagauaccagaccccugcuauccgcgccgagcacacaggacgggaaauugucgaccucaugugucaugcgacguucaccaugagacugcuuagccccauccgggugccuaauuauaaccugauuaucauggaugaggcccacuuuacagaccccgcuuccauugccgcucgcggcuacaucucuaccagaguugaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggugacggacuucaaggggaagacagucugguuugugccuuccauuaaagccggaaaugauaucgcugccugccugcggaagaacggcaaaaaggugauucaacucagcagaaaaaccuucgacucugaauauaucaagacccgcacaaaugauugggacuuugucguuaccacagauaucagcgagaugggggccaacuucaaggcugagcgggugauugacccgagacgcuguaugaaacccgugauccugaccgauggagaagaacgggucauucuugccggcccuaugcccgugacgcauuccucugcggcucagagacgcgggcggguuggcagaaauccuaagaacgaaaaugaccaguacaucuacaugggagagccccuggaaaacgaugaggacugcgcccacuggaaagaggccaagaugcuccuggacaauauuagcacaccggaaggcaucaucccuuccauguuugagcccgaacgcgagaaaguggaugcuauugacggggaauauagacugcggggagaggcccgcaagaccuucgucgaucucaugagacggggcgaccuuccuguguggcuggcguaccgcguugccgcugaggggaucaacuaugccgauagacggugguguuuugacggagugaaaaacaaucaaauucuggaagagaacgucgaaguggagaucuggacaaaggagggcgaaagaaagaaacucaagccccgcuggcuggaugcucggauuuacucugacccucuugcccugaaagaguucaaggaguucgcugccgggagaaaaagccucacccugaaucugaucacggagaugggccgccuccccaccuuuaugacacagaaggcgcggaacgcccuugauaaucuggcuguccugcauaccgccgaagcuggaggcagagccuauaaccacgcccucuccgagcugccggagacacuugaaacccugcuccugcugacacuccuugcugcggugaccgggggaauuuuccuguuucugaugagcggcaaggggaucggaaaaaugacgcucggcaugugcugcaucauuacagccucuauccugcuuugguacgcucagauucagccucacuggaucgccgccuccauuauccuggaguucuuucucaucguucugcugauucccgaacccgagaagcaacggaccccucaggacaaucagcucaccuauguggugaucgcuauucuuacagucguugccgcgaccauggccaacgaaaugggcuuccuggagaaaacaaagaaagauuuugggcugggaagcacgaccacacagcaaccggaguccaauauccucgacauugaucugcgccccgcuucugccuggacccuuuacgcuguggccacaaccuucaucacgccuaugcugagacauagcaucgaaaacuccucugugaaugucagccucaccgcgauugccaaccaggcuacagugcugaugggccuggggaagggauggccccucuccaagauggacaucggcguuccucuucuggccauuggguguuacagccaggugaaucccaucacccugacagcugcccuccugcuucuggucgcucacuaugccauuaucggaccuggccuccaggcgaaagccacccgggaggcucaaaagcgcgccgcugccggcauuaugaaaaacccgacgguggacgggaucacagucaucgaucuggaccccauuccuuacgaucccaaguuugaaaaacagcugggacaggugaugcuccuuguucugugcgugacccagguccugaugaugagaacaaccugggcccucugugaggcgcugacccuugcuacaggcccuaucucuacgcugugggaagggaaucccggacgguucuggaacaccacaauugccguguccauggcuaauaucuuucgcggcagcuaucucgccggggccggacugcuguucucuauuaugaagaacaccgcuaacacaagacggggcaccggcaauacgggggagacacucggagagaaguggaaaaaccgccuuaaugcccugggcaaguccgaauuucaaaucuacaaaaagagcgggauccaggagguugacagaacccuggcgaaagaaggaauuaagcggggcgagaccgaucaucacgccgugucuagagggagcgcuaaacuccgcugguucgucgagcggaaccuggugacaccggaaggaaaggugguugaccuuggcugcggcagagggggaugguccuauuacuguggcgggcugaagaaugucaaagaggugaagggacucaccaaaggcgggccuggacaugaggaacccauccccaugucuacauauggcuggaaccuggugcgccugcagagcggcgucgauguuuucuuuacgccucccgaaaagugcgacacccuccuuugugauauuggggaguccagcccuaauccgacaguggaggccggacggacccugagagugcugaaccucgucgaaaauuggcugaacaauaacacacaauucugcaucaaagugcuuaaucccuacaugccuuccguuauugagaagauggaagcucugcagcgcaaguacggcggggcccucgugcggaacccccugucuagaaauagcacccacgagauguauugggucuccaacgcgucuggaaacaucgugagcuccguuaauaugaucucucgcaugcugauuaaccgguuuacgaugagacacaaaaaggccaccuacgaaccugacguggaucucggcagcgggacacgcaauaucggaauugaguccgagacccccaaccuugacaucauuggcaaacggaucgaaaagaucaaacaggagcaugaaacaagcuggcacuaugaucaggaccauccguacaagaccugggcuuaucacggcucuuacgagacaaagcaaaccggguccgccagcucuauggucaauggaguggugagacugcugacgaaaccuugggacgucauucccaugguuacacagauggcuaugaccgauaccacaccuuucggccagcagcgcguguuuaaggaaaaaguggacacgagaacccaagagcccaaggaggggaccaaaaagcucaugaagaucaccgccgaauggcuguggaaagagcuuggaaagaaaaagacaccucggauguguacccgcgaagaguucacaagaaaaguccgguccaacgcugcccugggcgcgauuuuuaccgaugagaauaaguggaaaagcgccagagaagcuguggaggacucuggguucugggaacucguugauaaggagcggaaccugcaccuggaaggaaagugcgagacguguguguauaauaugaugggcaaacgcgagaagaaacucggcgaauuugggaaggccaaaggauccagagcuaucugguacauguggcugggcgcccgguuccuugaguuugaagcccugggguuccucaacgaggaccauugguuuagccgcgaaaauucccugagcggagucgagggcgaggggcuucacaagcugggcuacauucucagagaugugucuaagaaagaaggaggcgcgauguaugcugacgauaccgccgggugggacacacggaucacccuggaggaucugaagaacgaagagaugguuacaaaucauauggaaggagagcacaaaaagcucgccgaggcuauuuucaaacugaccuaccagaacaaggugguccgcgugcagagacccacgccgcggggcacaguuauggacaucaucagccgcagagaccagcggggguccggacaaguggucaccuauggccuuaauacauucaccaacauggaagcccagcugauucgccagauggagggggaaggcguguuuaagucuauccaacagcucacggucaccgaggagauugcugugaaaaacuggcugguuagagugggacgggaacgccuuagcagaauggccaucuccggcgaugacugcgucgugaagccucuggaugaccgguucgcgucugcccucacagcucugaaugauauggggaaagugagaaaggacauucagcagugggagcccagccgcggauggaacgauuggacccaaguucccuuuugcucccaucacuuccacgaacugaucaugaaagacggccgggugcucgucgugccuuguagaaaucaggaugagcugaucgggcgcgcccggauuucucagggagcuggcuggagccuuagagaaacagccugccuggggaaguccuacgcgcagauguggaaccucauguauuuucaucgccgggaccugagacuugccgcuaaugccaucuguagcgcuguuccgucucacugggugcccaccucccgcacaaccuggagcauucaugccacgcacgaguggaugacaaccgaggauaugcugaccgucuggaaccggguguggauccaagaaaauccuuggauggaggacaagacacccgucgaaucuugggaggaaauuccuuaccucggcaaaagagaggaucaguggugcggaucccugaucggccugaccagccgcgcuacaugggccaagaacauccagacggcgauuaaucaggugcggucccucaucgggaacgaggaauauaccgacuacaugcccucuaugaaaagauuccggagagaggaagaggaagccggaguucugugguga

SEQ ID NO: 20162 - RNA, 9876 nt, Artificial Sequence
  derived and/or modified CDS sequence (opt5) from DENV-2__KP723478__SS-prME
accgccggcaucauuaucaugaugauucccacggugauggcuuuccaccugacgaccagaaacggggagccucauaugaucgugagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugccacuggccuaaaagccauacccugugguccaauggcguccuggagagcgaaaugauuauccccaagaacuucgccgggccgaugucucagcacaauuaucgcccuggauaccauacgcagacagcuggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgccggacauggccagauugauaauuuuagccuggggguucugggaauggcucuuuuccucgaggaaaugcugcgcacacgggugggcaccaagcacgcgauccugcucgucgccguguccuuuguuacgcugauuaccgggaacaugucuuucagagaccuuggacgcgugauggucauggugggcgcugccaugacagaugacaucggcauggggguuaccuaccuggcccuccuggcugccuuuaaggugagaccuacauucgcggcuggacugcuucugcggaaacucaccagcaaggagcugaugaugacgacaaucggcauuguccuccugucccaaucuaccaugcccgagacaauccuugaacugaccgaugcccucgcccuggggaugauggugcugaaaauugugcgcaauauggagaaguaucagcuugcugucaccaucauggccauucugugcguuccuaacgcggugauccuccagaaugcuuggaaagugagcuguacaacgcuggccgucguguccguuagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcauggucagcauccucgcgucuucccugcucaaaaacgauauuccuaugacagggccccugguggccggaggccuucugaccguuugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccgucucuaccccgauuacagccgcugcgugguaucuuugggaggugaaaaagcaaagagccggaguucugugggacgugccuucucccccucccgucggcaaagcugaacuggaggauggggccuaccggaucaagcagaagggaauccucggcuauucccagauuggcgccgggguguacaaagaaggaaccuuucacacaauguggcauguuacccgcggcgcugugcugaugcacaaggggaaaagaaucgagcccuccugggccgacgucaagaaagaucuuauuagcuacggaggcggguggaagcuggagggagaauggaaggagggcgaagagguccaggugcucgcgcuggaaccuggcaaaaacccgcgggcuguucaaacgaagcccggacucuucaaaaccaacacaggaaccaucggcgccgucucccuggacuuuagcccugggacaucuggaucccccauuguggauaagaaaggcaagguggucgggcuuuauggaaauggcgugguuaccagaagcggcacauacgugucugccaucgcucagacggagaaguccaucgaggacaacccugaaauugaggaugacaucuuccgcaaaaagcggcugaccauuauggaucugcaucccggggccggaaaaacaaagagauaucucccugcgaucguccgcgaagcuauuaaacggggccugagaacccuuauccuggccccgacccgcgugguugccgcugagauggaagaggcccuccgggggcugcccaucagauaccagaccccugcuauucgcgccgagcacacgggacgggaaaucguggaccucaugugucaugcgaccuucacaaugagacugcuuagccccauucgggucccuaauuauaaccugaucauuauggaugaggcccacuuuaccgaccccgcuuccaucgccgcucgcggcuacauuucuacaagaguggaaaugggggaggccgccggcaucuucaugaccgcuacgccgccuggaagccgggaccccuuuccccaguccaaugcgccuaucauggaugaggaacgcgagauucccgaaagaagcuggaacucuggccacgaguggguuacagacuucaaggggaagaccgugugguuugucccuuccaucaaagccggaaaugauauugcugccugccugcggaagaacggcaaaaaggugauccaacucagcagaaaaaccuucgacucugaauauauuaagacacgcaccaaugauugggacuuuguggucacaaccgauaucagcgagaugggggccaacuucaaggcugagcggguuaucgacccgagacgcuguaugaaacccgugauucugacggauggagaagaacgggugauccuugccggcccuaugcccgucacacauuccucugcggcucagagacgcgggcgggugggcagaaauccuaagaacgaaaaugaccaguacauuuacaugggagagccccuggaaaacgaugaggacugcgcccacuggaaagaggccaagaugcuccuggacaauaucagcaccccggaaggcauuaucccuuccauguuugagcccgaacgcgagaaaguugaugcuaucgacggggaauauagacugcggggagaggcccgcaagacauucguggaucucaugagacggggcgaccuuccugucuggcuggcguaccgcguggccgcugaggggauuaacuaugccgauagacggugguguuuugacggaguuaaaaacaaucaaauccuggaagagaacguggaagucgagauuuggaccaaggagggcgaaagaaagaaacucaagccccgcuggcuggaugcucggaucuacucugacccucuugcccugaaagaguucaaggaguucgcugccgggagaaaaagccucacgcugaaucugauuaccgagaugggccgccuccccacauuuaugacccagaaggcgcggaacgcccuugauaaucuggcugugcugcauacagccgaagcuggaggcagagccuauaaccacgcccucuccgagcugccggagacccuugaaacacugcuccugcugacccuccuugcugcggucacaggcgggaucuuccuguuucugaugagcgggaaggggauuggaaaaaugacacucggcaugugcugcaucaucaccgccucuauucugcuuugguacgcucagauccagccucacuggauugccgccuccaucauucuggaguucuuucucaucgugcugcugauccccgaacccgagaagcaacggaccccucaggacaaucagcucacauauguugugauugcuauccuuaccguggucgccgcgacaauggccaacgaaaugggcuuccuggagaaaacgaagaaagauuuugggcugggaagcaccacaacccagcaaccggaguccaauauucucgacaucgaucugcgccccgcuucugccuggacacuuuacgcuguugccaccacguucauuaccccuaugcugagacauagcaucgaaaacuccucugugaaugugagccucacagcgaucgccaaccaggcuaccguccugaugggccuggggaagggauggccccucuccaagauggacauuggcgugccucuucuggccaucggguguuacagccagguuaaucccauuacacugaccgcugcccuccugcuucugguggcucacuaugccaucauuggaccuggccuccaggcgaaagccacgcgggaggcucaaaagcgcgccgcugccggcaucaugaaaaacccgacagucgacgggauuaccgugaucgaucuggaccccaucccuuacgaucccaaguuugaaaaacagcugggacaggucaugcuccuugugcugugcguuacacaggugcugaugaugagaaccaccugggcccucugugaggcgcugacacuugcuacgggcccuauuucuacccugugggaagggaaucccggacgguucuggaacacaaccaucgccgucuccauggcuaauauuuuucgcggcagcuaucucgccggggccggacugcuguucucuaucaugaagaacacagcuaacaccagacggggcacgggcaauacaggggagacccucggagagaaguggaaaaaccgccuuaaugcccugggcaaguccgaauuucaaauuuacaaaaagagcgggauccaggagguggacagaacccuggcgaaagaaggaaucaagcggggcgagacagaucaucacgccguuucuagagggagcgcuaaacuccgcugguucguggagcggaaccuggucaccccggaaggaaaggugguggaccuuggcugcggcagagggggaugguccuauuacuguggcgggcugaagaauguuaaagaggucaagggacucacaaaaggcgggccuggacaugaggaacccauucccaugucuacguauggcuggaaccuggugcgccugcagagcggcguggaugucuucuuuaccccucccgaaaagugcgacacacuccuuugugauaucggggaguccagcccuaauccgaccguugaggccggacggacacugagagugcugaaccucguggaaaauuggcugaacaauaacacccaauucugcauuaaaguccuuaaucccuacaugccuuccgugaucgagaagauggaagcucugcagcgcaaguacggcggggcccucguucggaacccccugucuagaaauagcacgcacgagauguauuggguguccaacgcgucuggaaacauugucagcuccgugaauaugaucucucgcaugcugaucaaccgguuuaccaugagacacaaaaaggccacauacgaaccugacguugaucucggcagcgggacccgcaauauuggaaucgaguccgagacacccaaccuugacauuaucggcaaacggauugaaaagaucaaacaggagcaugaaaccagcuggcacuaugaucaggaccauccguacaagacaugggcuuaucacggcucuuacgagaccaagcaaacgggguccgccagcucuauggugaauggagucgugagacugcugacaaaaccuugggacgugauccccauggucacccagauggcuaugaccgauacaacgccuuucggccagcagcgcguuuuuaaggaaaaaguggacaccagaacacaagagcccaaggaggggaccaaaaagcucaugaagauuacagccgaauggcuguggaaagagcuuggaaagaaaaagaccccucggauguguacacgcgaagaguucaccagaaaagugcgguccaacgcugcccugggcgcgaucuuuacggaugagaauaaguggaaaagcgccagagaagcugucgaggacucuggguucugggaacucguggauaaggagcggaaccugcaccuggaaggaaagugcgagaccuguguuuauaauaugaugggcaaacgcgagaagaaacucggcgaauuugggaaggccaaaggauccagagcuauuugguacauguggcugggcgcccgguuccuugaguuugaagcccugggguuccucaacgaggaccauugguuuagccgcgaaaauucccugagcggaguggagggcgaggggcuucacaagcugggcuacauccucagagaugucucuaagaaagaaggaggcgcgauguaugcugacgauacagccgggugggacacccggauuacacuggaggaucugaagaacgaagagauggugaccaaucauauggaaggagagcacaaaaagcucgccgaggcuaucuucaaacugacguaccagaacaagguugugcgcguccagagacccacaccgcggggcaccgugauggacauuaucagccgcagagaccagcggggguccggacaaguugugacauauggccuuaauaccuucacgaacauggaagcccagcugauccgccagauggagggggaaggcgucuuuaagucuauucaacagcucaccgugacagaggagaucgcugucaaaaacuggcuggugagaguuggacgggaacgccuuagcagaauggccauuuccggcgaugacugcguggucaagccucuggaugaccgguucgcgucugcccucaccgcucugaaugauauggggaaagugagaaaggacauccagcagugggagcccagccgcggauggaacgauuggacacaagugcccuuuugcucccaucacuuccacgaacugauuaugaaagacggccggguucucguggucccuuguagaaaucaggaugagcugaucgggcgcgcccggaucucucagggagcuggcuggagccuuagagaaaccgccugccuggggaaguccuacgcgcagauguggaaccucauguauuuucaucgccgggaccugagacuugccgcuaaugccauuuguagcgcugugccgucucacuggguucccacaucccgcaccacguggagcauccaugccacacacgaguggaugaccaccgaggauaugcugacaguguggaaccgggucuggauucaagaaaauccuuggauggaggacaagacccccguggaaucuugggaggaaaucccuuaccucggcaaaagagaggaucaguggugcggaucccugauuggccugacaagccgcgcuacgugggccaagaacauccagaccgcgaucaaucagguccggucccucauugggaacgaggaauauacagacuacaugcccucuaugaaaagauuccggagagaggaagaggaagccggagugcugugguga

SEQ ID NO: 20163 - RNA, 9876 nt, Artificial Sequence
  derived and/or modified CDS sequence (opt5) from DENV-2__KP723479__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuaccccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaagcguggggaaaggccaagaugcucucuaccgaacugcacaaucauacguuccugaucgauggcccugagaccgcugaaugccccaacacaaaucgcgccuggaacucccucgagguugaggacuauggguuuggaguguucaccacaaauauuuggcugaaaaugaaggaacggcaagaugucuuuugugacagcaaacuuaugucugcugccaucaaggacuccagagcggugcacgccgauaugggcuacuggauugagagcgcucugaacgacaccuggaaaaucgaaaaggccucuuucaucgaggugaagagcugccacuggccuaaaucccauacacucuggagcaacggcguccuggagucugaaaugauuauccccaagaauuucgcugggccgguuucccagcacaacuaucgcccuggauaccauacccagacggccggccccuggcaccuggggcggcuugagauggauuuugacuucugugaaggaacaaccgugguggucaccgaggauugcggcaauagagggcccagccuccggacaaccacggccuccggaaaacugauuacagaauggugcugucgcucuugcacccugccuccgcucagauaccggggcgaggacggcuguugguaugggauggagaucagaccccugaaggaaaaagaggaaaaccuugugaauagccugguuacagcuggacauggccagauugauaacuuuucccucggggugcugggaauggcgcuguuccuugaggaaaugcuccgcacccgggucggcacaaagcacgccauccugcugguggcuguuucuuuugugacccucauuacggggaauaugagcuucagagaccugggacgcgucauggugaugguuggcgccaccaugacagaugacaucggcaugggggugaccuaccuugcccugcucgcugccuuuaaggucagaccuacauucgcggcuggacugcugcuucggaaacugaccuccaaggagcucaugaugacgacaaucggcauugugcugcucucucaagccaccauccccgagacaauucuggaacuuaccgaugcccuggcucucgggaugauggugcugaaaaucguccgcaacauggagaaguaucagcuggccguuaccauuauggcgauccuuugcgugccuaaugcugugauccugcagaacgccuggaaagucagcuguacaacgcucgccgugguuuccgugagcccccugcuccugaccucuucccaacagaaggcugacuggauuccucuugcccugacaaucaagggacucaaucccaccgcuauuuuucugacaacccugagcagaacgaacaaaaagcggucuuggccgcuuaaugaagccaucauggcggucggcaugguguccauucuggccagcucucuccugaaaaacgauaucccuaugacagggccccucguugcuggaggccugcuuaccgugugcuacguccugaccggccgcuccgccgaccuggagcucgaaagagcugccgacgugcggugggaggagcaggccgaaaucagcggguccagcccuauucugucuaucacaauuagcgaggauggauccaugucuaucaagaaugaagaggaggaacagacccuuacaauucugauccgcacgggccuccuggucgugagcgggcucuuccccguuuccaccccgauuacagcugcggccugguaucugugggaggugaaaaagcaaagagcuggaguccuuugggacgugccuucucccccucccguuggcaaagccgaacuggaggauggggccuaccggaucaagcagaagggaauccugggcuauagccagauuggcgcugggguguacaaagaaggaaccuuucacacaauguggcaugucacccgcggcgccgugcucaugcacaaggggaaaagaaucgagcccuccugggcggacgugaagaaagaucugauuucuuacggaggcggguggaagcuugagggagaauggaaggagggcgaagagguucagguccuggcucucgaaccuggcaaaaacccgcgggccgugcaaacgaagcccgggcuguucaaaaccaacacaggaaccaucggcgccgugagccucgacuuuuccccugggacaagcggaucucccauugucgauaagaaaggcaaggugguugggcuguauggaaauggcguggucaccagauccggcacauacgugagcgcuaucgcccagacggagaagucuaucgaggacaacccugaaauugaggaugacaucuuccgcaaaaagcggcuuaccauuauggaucugcaucccggggcgggaaaaacaaagagauaucugccugcuaucguucgcgaagccauuaaacggggccucagaacccugauccuugccccgacccgcguggucgcugccgagauggaagaggcucugcgggggcuccccaucagauaccagacaccugccauucgcgcggagcacacgggacgggaaaucguggaccugaugugucaugccaccuucacaaugagacuccugucccccauucggguuccuaauuauaaccuuaucauuauggaugaggcucacuuuaccgaccccgccagcaucgcugcccgcggcuacauuuccacaagaguggaaaugggggaggccgcuggcaucuucaugaccgcgacgccgccuggaucucgggaccccuuuccccagagcaaugccccuaucauggaugaggaacgcgagauucccgaaagauccuggaacagcggccacgagugggucacagacuucaaggggaagaccgugugguuugugccuucuaucaaagcuggaaaugauauugccgccugccugcggaagaacggcaaaaaggucauccaacuguccagaaaaaccuucgacagcgaauauauuaagacacgcaccaaugauugggacuuuguugugacaaccgauaucucugagaugggggcuaacuucaaggccgagcgggugaucgacccgagacgcuguaugaaacccgucauucucacggauggagaagagcgggugauccuggcgggcccuaugcccguuacacauagcuccgcugcccagagacgcgggcgggugggcagaaauccuaagaacgaaaaugaccaguacauuuacaugggagagccccuugaaaacgaugaggacugcgcccacuggaaagaggcuaagaugcugcucgacaauaucaacaccccggaaggcauuaucccuucuauguuugagcccgaacgcgagaaagucgaugccaucgacggggaauauagacugcggggagaggcgcgcaagacauucguggaucugaugagacggggcgaccucccuguuuggcuugccuaccgcguggcugccgaggggauuaacuaugcugauagacggugguguuuugacggagucaaaaauaaccaaauccuggaagagaauguggaagucgagauuuggaccaaggagggcgaaagaaagaaacugaagccccgcuggcucgaugcccggaucuacagcgacccucuggcucuuaaagaguucaaggaauucgccgcggggagaaaaucccugacgcucaaccugauuaccgagaugggccgccugcccacauuuaugacccagaaggcccggaaugcucucgauaaccuugccgugcugcauacagcugaagccggaggcagagccuauaaucacgcucugucugagcucccggagacccuggaaacacuucugcuccugacccugcucgcgacgguuacagggggaaucuuccuuuuucugaugagcggcaaggggauuggaaaaaugacccugggcaugugcugcaucaucaccgccuccauucuccugugguacgcucagauccagccucacuggauugccgccagcaucauucuugaguucuuucugaucgugcuccugauccccgaacccgagaagcaacggacaccucaggacaaccagcugaccuauguggucauugcuauccucacaguuguggccgcgacgauggccaaugaaaugggcuuccuugagaaaaccaagaaagauuuugggcugggaucuauuacaacccagcaaccggagaacaauauccuggacauugaucuccgccccgcuuccgccuggacacuguacgcuguggccaccacguucaucaccccuaugcuuagacauagcaucgaaaacuccucugucaaugugagccugacagcgauugccaaccaggcuaccguucucaugggccuggggaagggauggccccuguccaagauggacaucggcgugccucuccuugccauuggguguuacucucaggucaaucccaucacacugaccgcugcccugcuccugcuuguggcucacuaugccauuaucggaccuggccugcaggcgaaagccacgcgggaggcucaaaagcgcgccgcugccggcauuaugaaaaacccgacagucgacgggaucaccgugaucgaucucgaccccauuccuuacgaucccaaguuugaaaaacagcugggacagguuaugcugcucgugcuuugcgucacacaggugcugaugaugagaaccaccugggcccugugugaggcgcucacacuggcuacgggcccuaucagcacccuuugggaagggaaucccggacgguucuggaacacaaccauugccguuuccauggcuaacaucuuucgcggcagcuaucuggccggggccggacuccuguucucuauuaugaagaauacagcuaacaccagacggggcacgggcaauacaggggagacccugggagagaaguggaaaaaccgccucaaugcccuuggcaaguccgaauuucaaaucuacaaaaagagcgggauccaggagguggacagaacccuggcgaaagaaggaauuaagcggggcgagacagaucaucacgccgucucuagaggguccgcuaaacugcgcugguucguggagcggaaccucgugaccccggaaggaaagguugucgaccugggcugcggcagagggggauggagcuauuacuguggcgggcuuaagaaugugaaagaggugaagggacugacaaaaggcgggccuggacaugaagagcccauccccaugucuacguauggcuggaaccucguccgccugcagagcggcguugauguguucuuuaccccucccgaaaagugcgacacacugcucugugauauuggggaguccucuccuaauccgaccguggaggccggacggacacuuagaguccugaaccugguggaaaauuggcucaacaauaacacccaauucugcaucaaaguucugaaucccuacaugccuagcgugauugagaagauggaagcucuucagcgcaaguacggcggggcccugguccggaacccccucuccagaaacagcacgcacgagauguauuggguguccaaugcgucuggaaacaucguuagcuccgugaauaugaucucucgcaugcugauuaaccgguuuaccaugagacacaaaaaggccacauacgaaccugacgucgaucugggcagcgggacccgcaauaucggaauugaguccgagacacccaaccucgacaucauuggcaaacggaucgaaaagaucaaacaggagcaugaaaccucuuggcacuaugaucaggaccauccguacaagacaugggcuuaucacggcagcuacgagaccaagcaaacgggguccgccagcucuauggugaauggaguggucagacuucugacaaaaccuugggacguuauucccauggugacccagauggcuaugaccgauacaacgccuuucggccagcagcgcguguuuaaggaaaaagucgacaccagaacacaagagcccaaggaggggaccaaaaagcugaugaagaucacagccgaauggcucuggaaagagcugggaaagaaaaagaccccucggauguguacacgcgaagaguucaccagaaaagugcgguccaacgcugcccuuggcgcgauuuuuacggaugagaauaaguggaaaagcgccagagaagcuguugaggacucuggguucugggaacugguggauaaggagcggaaccuccaccuggaaggaaagugcgagaccugugucuauaauaugaugggcaaacgcgagaagaaacugggcgaauuugggaaggccaaaggauccagagcuaucugguacauguggcucggcgcccgguuccuggaguuugaagcccuuggguuccugaacgaggaccauugguuuagccgcgaaaauucucucuccggaguggagggcgaggggcugcacaagcuuggcuacauucugagagauguuagcaagaaagaaggaggcgcgauguaugcugacgauacagccgggugggacacccggaucacacucgaggaucugaagaacgaagagauggugaccaaucauauggaaggagagcacaaaaagcuggccgaggcuauuuucaaacucacguaccagaacaaggucgugcgcguucagagacccacaccgcggggcaccgugauggacaucaucucccgcagagaccagcgggggagcggacaagucgugacauauggccugaacaccuucacgaauauggaagcccagcuuauucgccagauggagggggaaggcgucuuuaagucuauccaacagcugaccgugacagaggagauugcuguuaaaaacuggcucgugagagucggacgggaacgccugagcagaauggccaucuccggcgaugacugcguggugaagccucuugaugaccgguucgcgucugcccugaccgcucucaaugauauggggaaaguuagaaaggacauucagcagugggagcccagccgcggauggaacgauuggacacaagugcccuuuugcucccaucacuuccacgaacugaucaugaaagacggccggguccuggugguuccuuguagaaaucaggaugagcucaucgggcgcgcccggauuucucagggagcuggcuggagccugagagaaaccgccugccuugggaaguccuacgcgcagauguggucucugauguauuuucaucgccgggaccucagacuggccgcuaacgccaucuguagcgcugugccgucccacuggguccccacaagccgcaccacguggucuauucaugccacacacgaguggaugaccaccgaggauaugcuuacaguguggaaucgggucuggauccaagaaaacccuuggauggaggacaagacccccguggaauccugggaggaaauuccuuaccugggcaaaagagaggaucaguggugcggaagccucaucggccugacaucucgcgcuacgugggccaagaauauccagaccgcgauuaaccagguucggucccugaucgggaaugaggaauauacagacuacaugcccagcaugaaaagauuccggagagaggaagaggaagccggagugcucugguga

SEQ ID NO: 20164 - RNA, 9876 nt, Artificial Sequence
  derived and/or modified CDS sequence (opt5) from DENV-2__KT187554__SS-prME
accgcuggaaucauuaucaugaugauucccacagugauggcuuuccaccugacgaccagaaacggggagccucauaugaucgucagccggcaggaaaagggaaagagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugccacuggccuaaaagccauacccugugguccaauggcguccuggagagcgaaaugauuauccccaagaacuucgccgggccgguuucucagcacaauuaucgcccuggauaccauacgcagacagcuggccccuggcaccuugggcggcucgagauggauuuugacuucugugaaggaaccaccgugguggucacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggugaacucucucguuaccgccggacauggccagauugauaauuuuagccugggggugcugggaauggcucuuuuccucgaggaaaugcugcgcacacgggucggcaccaagcacgcgauccugcucguggccguuuccuuugugacgcugauuaccgggaacaugucuuucagagaccuuggacgcgucauggugaugguuggcgcugccaugacagaugacaucggcaugggggugaccuaccuggcccuccuggcugccuuuaaggucagaccuacauucgcggcuggacugcuucugcggaaacucaccagcaaggagcugaugaugacgacaaucggcauugugcuccugucccaaucuaccaugcccgagacaauccuugaacugaccgaugcccucgcccuggggaugauggugcugaaaauuguccgcaauauggagaaguaucagcuugcuguuaccaucauggccauucugugcgugccuaacgcggugauccuccagaaugcuuggaaagucagcuguacaacgcuggccgugguuuccgugagcccccucuuucugaccucuucccaacagaaggccgacuggaucccucuugcucugacaauuaagggacucaaccccaccgccaucuuccugacaacccugagcagaacgucuaaaaagcgguccuggccgcuuaaugaagcuauuauggccgucggcauggugagcauccuggcgucuucccuccugaaaaacgauauuccuaugacagggccccucguugccggaggccugcuuaccgugugcuacguccugaccggccgcagcgcugaccuggagcucgaaagagccgcugacgugcggugggaggagcaggccgaaaucuccgggagcucuccuauccugagcauuacaaucuccgaggauggaucuaugagcauuaagaaugaagaggaggaacagacccuuacaauccugauucgcacgggccuccuggucaucuccgggcucuuucccgugucuauuccgaucaccgccgcugcgugguaucugugggagguuaaaaagcaaagagccggagugcuuugggacgucccuucucccccucccgugggcaaagcugaacuggaggauggggccuaccggaucaagcagaagggcauucugggcuauucccagaucggcgccgggguuuacaaagaaggaacauuccacaccauguggcaugugacacgcggcgcuguccucaugcacaaggggaaaagaauugagcccuccugggccgacgugaagaaagaucugaucagcuacggaggcggguggaaacuugagggagaauggaaggagggcgaagaggugcagguucuggcgcucgaaccuggcaaaaacccgcgggcuguccaaaccaagcccgggcuguuuaaaacgaacaccggaacaauuggcgccgugucccucgacuucagcccugggaccucuggaucccccaucguggauaagaaaggcaaggucguggggcuguauggaaauggcguugugacaagaagcggcaccuacgucucugccaucgcucagacagagaaguccauugaggacaacccugaaaucgaggaugacauuuuccgcaaaaagcggcuuacgaucauggaucugcaucccggggccggaaaaaccaagagauaucugccugcgauugugcgcgaagcuaucaaacggggccucagaacacugauccuugccccgacccgcguuguggccgcugagauggaagaggcccugcgggggcuccccauuagauaccagaccccugcuauccgcgccgagcacacaggacgggaaauugucgaccugaugugucaugcgacguuuaccaugagacuccugagccccauccgggugccuaauuauaaccuuauuaucauggaugaggcccacuucacagaccccgcuuccauugccgcucgcggcuacaucucuaccagaguugaaaugggggaggccgccggcaucuuuaugacagcuaccccgccuggaagccgggaccccuucccccaguccaaugcgccuauuauggaugaggaacgcgagauccccgaaagaagcuggaacucuggccacgagugggugacggacuuuaaggggaagacagucugguucgugccuuccauuaaagccggaaaugauaucgcugccugccugcggaagaacggcaaaaaggugauucaacugagcagaaaaaccuuugacucugaauauaucaagacccgcacaaaugauugggacuucgucguuaccacagauaucagcgagaugggggccaacuuuaaggcugagcgggugauugacccgagacgcuguaugaaacccgugauccucaccgauggagaagaacgggucauucuggccggcccuaugcccgugacgcauuccucugcggcucagagacgcgggcggguuggcagaaauccuaagaacgaaaaugaccaguacaucuacaugggagagccccuugaaaacgaugaggacugcgcccacuggaaagaggccaagaugcugcucgacaauauuagcacaccggaaggcaucaucccuuccauguucgagcccgaacgcgagaaaguggaugcuauugacggggaauauagacugcggggagaggcccgcaagaccuuugucgaucugaugagacggggcgaccucccuguguggcuugcguaccgcguugccgcugaggggaucaacuaugccgauagacggugguguuucgacggagugaaaaacaaucaaauucuggaagagaacgucgaaguggagaucuggacaaaggagggcgaaagaaagaaacugaagccccgcuggcucgaugcucggauuuacucugacccucuggcccuuaaagaguucaaggaauuugcugccgggagaaaaagccugacccucaaucugaucacggagaugggccgccugcccaccuucaugacacagaaggcgcggaacgcccucgauaaucuugcuguccugcauaccgccgaagcuggaggcagagccuauaaccacgcccuguccgagcucccggagacacuggaaacccuucugcuccugacacugcucgcugcggugaccgggggaauuuuucuuuuccugaugagcggcaaggggaucggaaaaaugacgcugggcaugugcugcaucauuacagccucuauccuccugugguacgcucagauucagccucacuggaucgccgccuccauuauccuugaguuuuuccugaucguucuccugauucccgaacccgagaagcaacggaccccucaggacaaucagcugaccuauguggugaucgcuauucucacagucguugccgcgaccauggccaacgaaaugggcuuucuugagaaaacaaagaaagauuucgggcugggaagcacgaccacacagcaaccggaguccaauauccuggacauugaucuccgccccgcuucugccuggacccuguacgcuguggccacaaccuuuaucacgccuaugcuuagacauagcaucgaaaacuccucugugaaugucagccugaccgcgauugccaaccaggcuacagugcucaugggccuggggaagggauggccccuguccaagauggacaucggcguuccucuccuugccauuggguguuacagccaggugaaucccaucacccugacagcugcccugcuccugcuugucgcucacuaugccauuaucggaccuggccugcaggcgaaagccacccgggaggcucaaaagcgcgccgcugccggcauuaugaaaaacccgacgguggacgggaucacagucaucgaucucgaccccauuccuuacgaucccaaguucgaaaaacagcugggacaggugaugcugcucguucuuugcgugacccagguccugaugaugagaacaaccugggcccugugugaggcgcucacccuggcuacaggcccuaucucuacgcuuugggaagggaaucccggacgguuuuggaacaccacaauugccguguccauggcuaauaucuuccgcggcagcuaucuggccggggccggacuccuguuuucuauuaugaagaacaccgcuaacacaagacggggcaccggcaauacgggggagacacugggagagaaguggaaaaaccgccucaaugcccuuggcaaguccgaguuccaaaucuacaaaaagagcgggauccaggagguugacagaacccuggcgaaagaaggaauuaagcggggcgagaccgaucaucacgccgugucuagagggagcgcuaaacugcgcugguucgucgagcggaaccucgugacaccggaaggaaaggugguugaccugggcugcggcagagggggaugguccuauuacuguggcgggcuuaagaaugucaaagaggugaagggacugaccaaaggcgggccuggacaugaagaacccauccccaugucuacauauggcuggaaccucgugcgccugcagagcggcgucgaugucuuuuucacgccucccgaaaagugcgacacccugcucugugauauuggggaguccagcccuaauccgacaguggaggccggacggacccuuagagugcugaaccuggucgaaaauuggcucaacaauaacacacaauuuugcaucaaagugcugaaucccuacaugccuuccguuauugagaagauggaagcccuucagcgcaaguacggcggggcccuggugcggaacccccucucuagaaauagcacccacgagauguauugggucuccaacgcgucuggaaacaucgugagcuccguuaauaugaucucucgcaugcugauuaaccgguucacgaugagacacaaaaaggccaccuacgaaccugacguggaucugggcagcgggacacgcaauaucggaauugaguccgagacccccaaccucgacaucauuggcaaacggaucgaaaagaucaaacaggagcaugaaacaagcuggcacuaugaucaggaccauccguacaagaccugggcuuaucacggcucuuacgagacaaagcaaaccggguccgccagcucuauggucaauggaguggugagacuucugacgaaaccuugggacgucauucccaugguuacacagauggcuaugaccgauaccacaccuuuuggccagcagcgcguguucaaggaaaaaguggacacgagaacccaagagcccaaggaggggaccaagaagcugaugaagaucaccgccgaauggcucuggaaagagcugggaaagaaaaagacaccucggauguguacccgcgaagaguuuacaagaaaaguccgguccaacgcugcccuuggcgcgauuuucaccgaugagaauaaguggaaaagcgccagagaagcuguggaggacucuggguuuugggaacugguugauaaggagcggaaccuccaccuggaaggaaagugcgagacguguguguauaauaugaugggcaaacgcgagaagaaacugggcgaguucgggaaggccaaaggauccagagcuaucugguacauguggcucggcgcccgguuucuggaguucgaagcccuuggguuucugaacgaggaccauugguucagccgcgaaaauucccucagcggagucgagggcgaggggcugcacaaacuuggcuacauucugagagaugugucuaagcgggaaggaggcgcgauguaugcugacgauaccgccgggugggacacacgcaucacccucgaggaucugaaaaacgaagagaugguuacaaaucauauggaaggagagcacaagaaacuggccgaggcuauuuucaagcucaccuaccagaacaaaguggucagagugcagcggcccacgccgcgcggcacaguuauggacaucaucagcagacgggaccagcgcggguccggacaaguggucaccuauggccugaauacauuuaccaacauggaagcccagcuuauuagacagauggagggggaaggcguguucaagucuauccaacagcugacggucaccgaggagauugcugugaagaacuggcucguucgggugggacgcgaaagacugagccggauggccaucuccggcgaugacugcgucgugaaaccucuugaugacagauuugcgucugcccugacagcucucaaugauauggggaaggugcgcaaagacauucagcagugggagcccagccggggauggaacgauuggacccaaguucccuucugcucccaucacuuucacgaacugaucaugaaggacggcagagugcuggucgugccuugucgcaaucaggaugagcucaucgggcgggccagaauuucucagggagcuggcuggagccugcgcgaaacagccugccuugggaaauccuacgcgcagauguggaaccugauguauuuccaucggagagaccuccgccuggccgcuaaugccaucuguagcgcuguuccgucucacugggugcccaccucccggacaaccuggagcauucaugccacgcacgaguggaugacaaccgaggauaugcuuaccgucuggaacagaguguggauccaagaaaauccuuggauggaggacaagacacccgucgaaucuugggaggaaauuccuuaccugggcaagcgcgaggaucaguggugcggaucccucaucggccugaccagccgggcuacaugggccaaaaacauccagacggcgauuaaucaggugagaucccugaucgggaacgaggaauauaccgacuacaugcccucuaugaagcgguuuagacgcgaggaagaggaagccggaguucucugguga

SEQ ID NO: 20165 - RNA, 9876 nt, Artificial Sequence
  derived and/or modified CDS sequence (opt5) from DENV-2__KT187557__SS-prME
accgccggaaucauuaucaugaugauucccacagugauggcuuuccaccugacgaccagaaacggggagccucauaugaucgugagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugccacuggccuaaaagccauacccugugguccaauggcguccuggagagcgaaaugauuauccccaagaacuucgccgggccgaugucucagcacaauuaucgcccuggauaccauacgcagacagcuggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgccggacauggccagauugauaauuuuagccuggggguucugggaauggcucuuuuccucgaggaaaugcugcgcacacgggugggcaccaagcacgcgauccugcucgucgccguguccuuuguuacgcugauuaccgggaacaugucuuucagagaccuuggacgcgugauggucauggugggcgcugccaugacagaugacaucggcauggggguuaccuaccuggcccuccuggcugccuuuaaggugagaccuacauucgcggcuggacugcuucugcggaaacucaccagcaaggagcugaugaugacgacaaucggcauuguccuccugucccaaucuaccaugcccgagacaauccuugaacugaccgaugcccucgcccuggggaugauggugcugaaaauugugcgcaauauggagaaguaucagcuugcugucaccaucauggccauucugugcguuccuaacgcggugauccuccagaaugcuuggaaagugagcuguacaacgcuggccgucguguccguuagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcauggucagcauccucgcgucuucccugcucaaaaacgauauuccuaugacagggccccugguggccggaggccuucugaccguuugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccgucucuauuccgaucaccgccgcugcgugguaucuuugggaggugaaaaagcaaagagccggaguucugugggacgugccuucucccccucccgucggcaaagcugaacuggaggauggggccuaccggaucaagcagaagggcauucucggcuauucccagaucggcgccgggguguacaaagaaggaacauuucacaccauguggcauguuacacgcggcgcugugcugaugcacaaggggaaaagaauugagcccuccugggccgacgucaagaaagaucuuaucagcuacggaggcggguggaagcuggagggagaauggaaggagggcgaagagguccaggugcucgcgcuggaaccuggcaaaaacccgcgggcuguucaaaccaagcccggacucuucaaaacgaacaccggaacaauuggcgccgucucccuggacuuuagcccugggaccucuggaucccccaucguggauaagaaaggcaagguggucgggcuuuauggaaauggcgugguuacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguccgcgaagcuaucaaacggggccugagaacacuuauccuggccccgacccgcgugguugccgcugagauggaagaggcccuccgggggcugcccauuagauaccagaccccugcuauccgcgccgagcacacaggacgggaaauuguggaccucaugugucaugcgacguucaccaugagacugcuuagccccauccgggucccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgaguggguuacggacuucaaggggaagacagugugguuugucccuuccauuaaagccggaaaugauaucgcugccugccugcggaagaacggcaaaaaggugauucaacucagcagaaaaaccuucgacucugaauauaucaagacccgcacaaaugauugggacuuuguggucaccacagauaucagcgagaugggggccaacuucaaggcugagcggguuauugacccgagacgcuguaugaaacccgugauccugaccgauggagaagaacgggugauucuugccggcccuaugcccgucacgcauuccucugcggcucagagacgcgggcgggugggcagaaauccuaagaacgaaaaugaccaguacaucuacaugggagagccccuggaaaacgaugaggacugcgcccacuggaaagaggccaagaugcuccuggacaauauuagcacaccggaaggcaucaucccuuccauguuugagcccgaacgcgagaaaguugaugcuauugacggggaauauagacugcggggagaggcccgcaagaccuucguggaucucaugagacggggcgaccuuccugucuggcuggcguaccgcguggccgcugaggggaucaacuaugccgauagacggugguguuuugacggaguuaaaaacaaucaaauucuggaagagaacguggaagucgagaucuggacaaaggagggcgaaagaaagaaacucaagccccgcuggcuggaugcucggauuuacucugacccucuugcccugaaagaguucaaggaguucgcugccgggagaaaaagccucacccugaaucugaucacggagaugggccgccuccccaccuuuaugacacagaaggcgcggaacgcccuugauaaucuggcugugcugcauaccgccgaagcuggaggcagagccuauaaccacgcccucuccgagcugccggagacacuugaaacccugcuccugcugacacuccuugcugcggucaccgggggaauuuuccuguuucugaugagcggcaaggggaucggaaaaaugacgcucggcaugugcugcaucauuacagccucuauccugcuuugguacgcucagauucagccucacuggaucgccgccuccauuauccuggaguucuuucucaucgugcugcugauucccgaacccgagaagcaacggaccccucaggacaaucagcucaccuauguugugaucgcuauucuuacaguggucgccgcgaccauggccaacgaaaugggcuuccuggagaaaacaaagaaagauuuugggcugggaagcacgaccacacagcaaccggaguccaauauccucgacauugaucugcgccccgcuucugccuggacccuuuacgcuguugccacaaccuucaucacgccuaugcugagacauagcaucgaaaacuccucugugaaugugagccucaccgcgauugccaaccaggcuacaguccugaugggccuggggaagggauggccccucuccaagauggacaucggcgugccucuucuggccauuggguguuacagccagguuaaucccaucacccugacagcugcccuccugcuucugguggcucacuaugccauuaucggaccuggccuccaggcgaaagccacccgggaggcucaaaagcgcgccgcugccggcauuaugaaaaacccgacggucgacgggaucacagugaucgaucuggaccccauuccuuacgaucccaaguuugaaaaacagcugggacaggucaugcuccuugugcugugcguuacccaggugcugaugaugagaacaaccugggcccucugugaggcgcugacccuugcuacaggcccuaucucuacgcugugggaagggaaucccggacgguucuggaacaccacaauugccgucuccauggcuaauaucuuucgcggcagcuaucucgccggggccggacugcuguucucuauuaugaagaacaccgcuaacacaagacggggcaccggcaauacgggggagacacucggagagaaguggaaaaaccgccuuaaugcccugggcaaguccgaauuucaaaucuacaaaaagagcgggauccaggagguggacagaacccuggcgaaagaaggaauuaagcggggcgagaccgaucaucacgccguuucuagagggagcgcuaaacuccgcugguucguggagcggaaccuggucacaccggaaggaaaggugguggaccuuggcugcggcagagggggaugguccuauuacuguggcgggcugaagaauguuaaagaggucaagggacucaccaaaggcgggccuggacaugaggaacccauccccaugucuacauauggcuggaaccuggugcgccugcagagcggcguggaugucuucuuuacgccucccgaaaagugcgacacccuccuuugugauauuggggaguccagcccuaauccgacaguugaggccggacggacccugagagugcugaaccucguggaaaauuggcugaacaauaacacacaauucugcaucaaaguccuuaaucccuacaugccuuccgugauugagaagauggaagcucugcagcgcaaguacggcggggcccucguucggaacccccugucuagaaauagcacccacgagauguauuggguguccaacgcgucuggaaacaucgucagcuccgugaauaugaucucucgcaugcugauuaaccgguuuacgaugagacacaaaaaggccaccuacgaaccugacguugaucucggcagcgggacacgcaauaucggaauugaguccgagacccccaaccuugacaucauuggcaaacggaucgaaaagaucaaacaggagcaugaaacaagcuggcacuaugaucaggaccauccguacaagaccugggcuuaucacggcucuuacgagacaaagcaaaccggguccgccagcucuauggugaauggagucgugagacugcugacgaaaccuugggacgugauucccauggucacacagauggcuaugaccgauaccacaccuuucggccagcagcgcguuuuuaaggaaaaaguggacacgagaacccaagagcccaaggaggggaccaaaaagcucaugaagaucaccgccgaauggcuguggaaagagcuuggaaagaaaaagacaccucggauguguacccgcgaagaguucacaagaaaagugcgguccaacgcugcccugggcgcgauuuuuaccgaugagaauaaguggaaaagcgccagagaagcugucgaggacucuggguucugggaacucguggauaaggagcggaaccugcaccuggaaggaaagugcgagacguguguuuauaauaugaugggcaaacgcgagaagaaacucggcgaauuugggaaggccaaaggauccagagcuaucugguacauguggcugggcgcccgguuccuugaguuugaagcccugggguuccucaacgaggaccauugguuuagccgcgaaaauucccugagcggaguggagggcgaggggcuucacaagcugggcuacauucucagagaugucucuaagaaagaaggaggcgcgauguaugcugacgauaccgccgggugggacacacggaucacccuggaggaucugaagaacgaagagauggugacaaaucauauggaaggagagcacaaaaagcucgccgaggcuauuuucaaacugaccuaccagaacaagguugugcgcguccagagacccacgccgcggggcacagugauggacaucaucagccgcagagaccagcggggguccggacaaguugugaccuauggccuuaauacauucaccaacauggaagcccagcugauucgccagauggagggggaaggcgucuuuaagucuauccaacagcucacggugaccgaggagauugcugucaaaaacuggcuggugagaguuggacgggaacgccuuagcagaauggccaucuccggcgaugacugcguggucaagccucuggaugaccgguucgcgucugcccucacagcucugaaugauauggggaaagugagaaaggacauucagcagugggagcccagccgcggauggaacgauuggacccaagugcccuuuugcucccaucacuuccacgaacugaucaugaaagacggccggguucucguggucccuuguagaaaucaggaugagcugaucgggcgcgcccggauuucucagggagcuggcuggagccuuagagaaacagccugccuggggaaguccuacgcgcagauguggaaccucauguauuuucaucgccgggaccugagacuugccgcuaaugccaucuguagcgcugugccgucucacuggguucccaccucccgcacaaccuggagcauucaugccacgcacgaguggaugacaaccgaggauaugcugaccguguggaaccgggucuggauccaagaaaauccuuggauggaggacaagacacccguggaaucuugggaggaaauuccuuaccucggcaaaagagaggaucaguggugcggaucccugaucggccugaccagccgcgcuacaugggccaagaacauccagacggcgauuaaucagguccggucccucaucgggaacgaggaauauaccgacuacaugcccucuaugaaaagauuccggagagaggaagaggaagccggagugcugugguga

SEQ ID NO: 20166 - RNA, 9876 nt, Artificial Sequence
  derived and/or modified CDS sequence (opt5) from DENV-2__JQ045670__SS-prME
agcgccggaaugaucauuaugcugauccccaccgugauggcuuuccaccugaccacgagaaauggggaaccucauaugauugucggaauccaggaaaagggcaaaucccugcuuuuuaagaccgaagacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcugccauggccgaugacaucggcaugggggugacguaucucgcucugcuggccgcguucaagguucgcccuaccuuugcugccggacuucugcuccggaagcugacauccaaagagcucaugaugaccacaauuggcaucgugcugcuuucucaaagcaccauucccgaaacgguccuggagcucacagaugcccuggcucuggggaugauggugcuuaagaucgugagaaauauggaaaaauaccagcuggccgucaccaucauggcgauucucugcguuccuaacgcugugauccugcagaaugccuggaagguguccuguacaauucucgccgucgugucuguuagcccccugcuucugaccuccagccagcagaagaccgacuggaucccucucgcucugacaauuaagggacugaaccccacggccaucuuccuuaccacacugucucgcaccaauaaaaagagauccuggccgcucaacgaggcuaucauggccgugggcauggucagcauucuggcgucuucccuccugaagaaugacaucccuaugacagggccccuuguggccggaggccugcugaccguuugcuaugugcucacgggccggagcgcugaucuggaacuugagcgcgccacagacgucaaaugggaggaucaggcugaaauuucuggguccagcccuauccuguccauuaccaucagcgaggacggaucuaugagcauuaagaacgaagaggaggaacagacccucacaauccugaucagaaccggccuccuggugauuuccgggcuuuuucccaucucuauuccgaucacagccgccgcuugguaccugugggaggucaaaaagcagcgggcgggagugcugugggauguuccuucucccccucccaugggcaaagccgaacucgaggacggggcuuaucgcauuaagcaaaagggaauccugggcuacucccagaucggcgccgggguguacaaagaaggaacguuccacaccauguggcaugucacaagaggcgccgugcuuaugcacaaggggaaacggauugagcccuccugggcugauguuaagaaagaccugaucagcuauggaggcggguggaagcucgagggagaauggaaggagggcgaagaggugcagguccuggcccucgaaccuggcaaaaauccgcgcgcggugcagaccaagcccgggcuguuuaaaacaaacaccggaacgauuggcgcugugucccuugauuucucuccugggaccagcggaucccccaucauugacaagaaaggcaagguugucgggcuguacggaaacggcguggugacaagaagcggcgccuaugucucugccaucgcucaaaccgagaaguccaucgaggauaauccugaaauugaggacgauaucuuucggaaacgcagacugacaauuauggaccuccaccccggggccggaaagaccaaacgguaccugccugcgaucgugagagaagcuauuaagcgcggccuucggacacugauccucgccccgacgagaguuguggccgcugagauggaagaggcccugcgcgggcuccccauucgguaucagaccccugcuaucagagccgagcauacaggacgcgaaaucgucgaccugaugugucacgcgaccuucaccaugcggcuucugagccccgugagaguuccuaacuacaaucugauuaucauggaugaggcccauuucacagaccccgcuucuauugccgcucgcggcuauaucuccacgcggguggaaaugggggaggccgccggcauuuuuaugaccgcuacaccgccuggaagcagagaucccuucccccaguccaacgcgccuaucauggacgaggaacgggagauccccgaacgcucuuggaauagcggccacgagugggucaccgauuuuaaagggaagacagugugguucguuccuuccauuaaggccggaaacgacaucgcugccugccuccgcaaaaauggcaagaaagugauucaacugagccggaagaccuuugauucugaauacgucaaaacgcgcacaaacgacugggauuucguggugaccaccgacaucuccgagaugggggccaauuuuaaggcugagagagucauugauccgcggagauguaugaaacccguuauccuuacagacggagaggaacgcgugauccuggccggcccuaugcccgugacccauagcucugcggcucagcggagagggcgcauuggccggaacccuaagaaugaaaacgaccaguacaucuauaugggagagccccucgaaaaugaugaggacugcgcccacuggaaggaggccaaaaugcugcuggauaacauuaauacaccggaaggcaucauuccuagcauguucgagcccgaaagagagaaggucgacgcuaucgauggggaauaccgccuccggggagaggccagaaaaaccuuuguggaccuuaugcgcagaggcgaucugccuguuuggcuggcguauaagguggccgcugaggggauuaacuacgccgaccggcgcugguguuucgauggaaucaaaaacaaucagauccucgaagagaacgucgaaguggagauuuggacgaaggagggcgaaagaaagaaacugaagccccgguggcuugacgcucgcaucuauuccgauccucuggcccucaaagaguuuaaggaguucgcugccgggagaaaaucucugacacugaaucucauuaccgagaugggccggcuucccacauucaugacccaaaagacgagagacgcgcuggauaaccuggccguucuccacaccgcugaagccggaggccgcgcuuacaaucaugcccugagcgagcuuccggagacacuggaaacccuccugcugcucacacuucuggccaccgugacagggggaaucuuucuguuccucauguccggccgggggauuggaaagaugacccugggcaugugcugcaucaucacggcuucuauucuucugugguaugcgcagauccagccucacuggauugccgcuagcaucauucucgaguuuuuccugaucguccugcucauccccgaacccgagaaacagagaacaccucaagacaaccagcuuaccuacguggucauugccauccugaccgugguugccgcuacaauggccaaugaaaugggcuuucuggagaagaccaaaaaggacuucgggcucggauccauugcgacacagcagccggagagcaacauccuggauauugaccuucgccccgccucugcuuggacgcuguacgccguggcuaccacauuugugaccccuaugcuccggcauuccaucgaaaauagcuccgucaacguuucucugacagccauugcgaaucaagccaccgugcugaugggccucgggaaaggauggccccuuagcaagauggauaucggcgugccucugcuggcuaucggguguuauucccaggucaaccccauuacgcucaccgccgcucugcuucugcucguggcccacuacgcuaucauuggaccuggccugcaggccaaggcgacaagagaggcccagaaacgggcugccgcuggcaucaugaagaauccgaccguugacgggauuacagugaucgaucuggaccccaucccuuaugaucccaaauucgaaaagcaacucggacaggucaugcuucugauucugugcgugacccagguccucaugaugcgcacgacaugggcccugugugaggcccuuacccuggcgacaggcccuaucucuacccucugggaagggaaccccggaagauuuuggaauaccacaauugcugugagcauggccaacaucuuccggggcuccuaccuggcuggggccggacugcucuuuagcauuaugaaaaauacgaccaacacacgcagaggcaccggcaacaucggggagacacuuggagagaaguggaaaucucggcugaaugcccugggcaaguccgaguuccaaaccuauaagaaaagcgggauccaggagguugaccgcacgcucgcuaaggaaggaauuaaaagaggcgagacagaucaccaugccgugucucggggguccgcgaagcugcgcugguuugucgagagaaaccuugugaccccggaaggaaaaguuguggaccugggcugcggcagagggggauggagcuacuauuguggcgggcucaagaauguccgggaggugaagggacugaccaaaggcgggccuggacacgaagaacccauccccaugucuacauacggcuggaaccuggugcgccuccagagcggcguugaugucuucuucauuccucccgaaaagugcgacacccuucugugugauaucggggaguccucuccuaauccgacaguggaggccggacggacgcugagagugcucaaccuggucgaaaauuggcuuaacaauaacacccaguuuugcauuaaaguucugaaucccuacaugccuagcgugaucgagaagauggaagcucuccaacgcaaauauggcggggcccuggugcggaacgaccuguccagaaauagcacacaugagauguacugggucuccaacgcuucuggaaauaucgugagcuccguuaacaugauuucucgcaugcucaucaaccgguucaccaugagacacaagaaggccacauaugaacccgacguggaucuuggcagcgggacccgcaauauuggaaucgaguccgagauuccuaaccuggacaucauuggcaaacggaucgaaaagaucaaacaggagcaugaaacgucuuggcacuacgaucaggaccaccccuauaagaccugggcguaccauggcagcuaugagacaaaacagaccggguccgccagcucuauggucaauggagugguuagacugcucacaaagccgugggaugugcugccuaccgucacacaaauggcuaugaccgacacgacacccuuuggccagcagcgcguguucaaggaaaaaguggauacccggacccaggagccuaaggaggggaccaagaaacuuaugaaaauuacggccgaauggcuguggaaggagcucggcaaaaagaagacccccagaauguguacacgcgaagaguuuaccagaaaaguccgguccaacgcugcccugggcgcuaucuucacagacgagaauaaguggaaaagcgcccgcgaagcgguugaggauucuagauuuugggaacugguggacaaggagcggaaccuccaccuggaagggaaaugcgagaccuguguguacaauaugaugggaaagagagagaagaaacuuggcgaguucggcaaggccaaagggucccgggcuauuugguacauguggcugggagcccgcuuucucgaguucgaagcucugggcuuucuuaacgaggaucauugguucagcagagaaaauucucuguccggggucgagggagagggccuccacaagcugggguauauccugcgggacgugagcaaaaaggaaggcggagccauguacgccgacgauacagcgggcugggacacccgcauuacgcucgaggaucugaagaacgaagagaugguuaccaaucacauggaaggggagcauaagaaacuugcugaggccaucuuuaaacugacauaucaaaacaaaguggucagagugcagcggccuacccccagaggaacaguuauggacaucauuuccagacgggaucagcgcggcagcgggcaagugggaaccuacggccucaauacguucacaaacauggaagcccagcugaucagacagauggagggggaaggcgucuucaaaaauauucagcaccuuaccgugacagaggagguugcugugcaaaacuggcuggcccgggucggacgcgaaagacucucucggauggcuaucagcggcgacgauugcguggucaagccgcuggacgaucgcuuugccaacgcgcugaccgcccucaaugacauggggaagauuagaaaagauauccagcagugggagccuuccaagggauggaacgacuggacacaggugcccuucugcucucaucacuuucaugaacugaucaugaaagauggccggguucuugugguccccuguagaaaucaagacgagcugauugggcgcgcucggaucagccagggagccggcuggucccucagagaaaccgcuugccuggggaagucuuaugcccagauguggagccuuauguacuuccaccgccgggaccugagacucgcggccaacgcuauuuguuccgccgugccuucucacugggugccgacaagccgcaccacaugguccauccaugcuaaacacgaguggaugaccacagaggauaugcugaccguuuggaaucggguguggauuagagaaaaccccuggauggaggacaagacgccugucgaaagcugggaggaaauccccuaucugggcaagcgcgaggaucaguggugcggaucucucauuggccugacaucccgggccaccugggcuaaaaauauccaagccgcgaucaaccaggugagaagccuuauugggaaugaggaauacaccgacuacaugccuucuaugaagcgcuuucggagagaggaagaggaagccggaguucugugguga

SEQ ID NO: 20167 - RNA, 9876 nt, Artificial Sequence
  derived and/or modified CDS sequence (opt5) from DENV-2__JQ045686__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccguuauucucgcuuacacaaucggaaccacccacuuucagcgcgugcugauuuucauccuucugacagccgucgcuccuuccaugacgaugagaugcauuggcaucucuaaccgggauuuuguggaagggguuagcggaggcuccuggguggacaucguccucgagcacgggagcugugugaccacaauggccaagaauaagcccacccuggauuucgaacuuauuaaaacagaggcgaagcagccugccacccugcgcaaauauugcaucgaagcuaagcucacgaacacaaccaccgagucuagauguccgacacaaggagagcccucccugaaagaagaacaggacaagcgguuugugugcaagcauagcauggucgaucgcggcuggggcaauggguguggacuguucggcaaagggggaauuguuaccugcgccauguuuacaugcaagaaaaacauggaaggcaagaucgugcagccugagaaucucgaauacacgauuguggucacaccccacucuggggaggagcaugcugugggaaacgacacaggcaaacacggccaggaaaucaagguuaccccucaauccagcaucacagaggccgaacugaccggguauggaacggugaccauggaguguucucccagaacaggccuugauuucaaugaaaugguccugcuccagauggagaacaaagcguggcuggugcaccggcagugguuucuugaccugccgcucccuuggcugcccggggccgauaagcaggaguccaauuggauucaaaaggaaacccugguuacauucaaaaacccucaugcuaagaaacaggacguggucgugcucggaagccaggagggcgccaugcacaccgcucugacgggggccacagaaauccaaauguccucuggcaaucuucuguuuaccggacaucucaagugccgccugagaauggacaaacuucagcugaagggcaugagcuacuccauguguacagggaaguucaaagucgugaaggagauugccgagacccagcacggaaccaucguuauucgggugcaguaugaaggcgaugggagccccugcaaaauccccuucgagaucauggaccucgaaaagagauacguccugggacgccugauuacagugaacccuaucguuacggagaaagauucuccggugaacauugaagcugagcccccuuuuggcgacuccuacaucauuaucggggucgagcccggccaacucaagcugaauugguucaagaaaggaagcucuauuggccagauguuugaaaccacaaugagaggggcgaagagaauggccauccuuggagauaccgcuugggacuucggcagccucgggggaguguuuacauccaucggcaaagcccuccaucagguguucggggccauuuauggcgcugccuuuucuggaguuagcuggaccaugaagauccugauuggcgucaucauuacguggaucgggaugaacucccgcagcacaucucuguccgugagccuugugcucgucggaaucgugacccuguaccugggcguuauggugcaggcggauucugggugugucguguccuggaaaaauaaggagcucaagugcggaagcggcauuuucaucaccgacaacguucacacauggaccgaacaauauaaauuucagccugagucccccucuaagcuggcuagcgccauucagaaagcccaggaagaggggaucuguggcauucgguccgugacaagacuugagaaucugauguggaagcaaaucacgccggaacucaaccacauccuggcugagaaugaagucaaacugaccauuaucacaggagauauuaagggcaucaugcaggccgggaaacgcucucuucggccucagcccaccgagcucaaguacagcuggaagacauggggaaaagcuaagaugcuguccaccgaaagcuauaaccagacguuccugauugacggcccugagaccgccgagugccccaauacaaacagagcguggaacucucucgaaguggaggauuacggguuuggaguuuucaccacaaacaucuggcugaaacuuaaggaaaaacaagacgccuuuugugacuccaagcugaugagcgcugccaucaaggauaaucgcgcugugcaugccgacaugggcuauuggauugagucugcgcucaacgauaccuggaaaaucgagaaggccuccuucauugaagucaaaaauugccacuggccuaagagccauacacuguggucuaacggcgugcuggagagcgaaaugaucauucccaaaaaccuugcugggccggugucccagcacaauuaccggccuggauaccacacccagaucgccggccccuggcaucucgggaagcuggagauggacuucaacuuuugugauggaacgacagucauuguuaccgaagacugcggcaauagagggcccagccugcgcaccacaaccgcuucuggaaagcucaucacggaguggugcugucgguccugcacacugccuccgcuuagauaucggggcgaggauggcuguugguacgggauggaaauccgcccccugaaagagaaggaagagaaccucgugaauagccuggugaccgccggacacggccaagucgacaacuucucccugggggugcuuggaauggcccucuuucuggaagagaugcugagaacacggguuggcaccaaacaugcuauucuccugguggcggucucuuucgugacacuuaucaccgggaauaugagcuuuaaggaucugggaagaguuguggucauggugggcgccacgaugaccgacgauauuggcauggggguuacauaucucgcucugcuggccgccuucaaagugcgcccuaccuuugcugccggacuucugcuccggaagcugacauccaaggagcucaugaugaccacgaucggcauuguccugcuuucucagagcacaauccccgaaaccgugcuggagcucacagacgcgcuggcucuggggaugauggugcuuaaaaucgucagaaacauggaaaaguaccagcuggccguuaccauuauggccauccucugcgugccuaaugcugugauucugcagaacgccuggaaagucuccuguaccauccucgcggugguuucugugagcccccugcuucugacauccagccaacagaagacggauuggauuccucucgcucugaccaucaaaggacugaaucccacagccaucuuccuuaccacacugucucgcaccaacaagaaaagauccuggccgcucaaugaggccauuauggcugucggcauggugagcauccuggccucuucccuccugaagaacgacauuccuaugacggggccccuuguugcuggaggccugcugacagugugcuauguccucaccggccggagcgccgaccuggaacuugagcgcgcgaccgaugugaagugggaggaccaggccgaaaucucuggguccagcccuauucuguccaucacaauuagcgaggauggaucuaugagcaucaaaaaugaagaggaggaacagacccucacaauccugauuagaacgggccuccuggucaucuccgggcuuuuucccauuucuaucccgauuaccgcugccgcuugguaccugugggaggugaagaaacaacgggccggaguucugugggacgugccuucucccccucccaugggcaaggccgaacucgaggauggggcuuaucgcaucaaacagaagggaauccugggcuacucccagauuggcgcgggggucuacaaggaaggaacauuccacaccauguggcaugugacaagaggcgccguucuuaugcacaaagggaagcggaucgagcccuccugggcugacgugaaaaaggaucugauuagcuauggaggcggguggaaacucgagggagaauggaaggagggcgaagagguccaggugcuggcccucgaaccuggcaagaacccgcgcgccgugcaaaccaaacccgggcuguuuaagacgaacaccggaacaaucggcgcuguuucccuugacuucucuccugggaccagcggaucccccauuaucgauaaaaagggcaaagucguggggcuguacggaaauggcguggucacaagaagcggcgccuaugugucugcgaucgcucagaccgagaaguccauugaggacaacccugaaaucgaggaugacauuuuucggaagcgcagacugacaaucauggaucuccaccccggggccggaaaaacgaagcgguaccugccugccauuguuagagaagcuaucaaacgcggccuucggacccugauucucgccccgacaagaguggucgcggcugagauggaagaggcccugcgcgggcuccccauccgguaucagaccccugccaucagagcugagcauaccggacgcgaaauuguggaccugaugugucacgccacauucacgaugcggcuucugagccccguuagagugccuaauuacaaccugaucauuauggacgaggcucauuucaccgaucccgccucuaucgcggcccgcggcuauauuuccacacgggucgaaaugggggaggcugccggcaucuuuaugaccgcuacaccgccuggaagcagagaccccuucccccaauccaaugccccuaucauugaugaggaacgggagauccccgaacgcucuuggaacagcggccacgagugggugaccgacuuuaaggggaaaacgguuugguucgugccuuccauuaaggccggaaaugauaucgcugcgugccucagaaagaacggcaaaaaggucauucagcugagccggaaaacauuugacucugaauacgugaagacccgcaccaaugauugggacuucguggucacaaccgauaucuccgagaugggggccaacuuuaaagcugagagaguuaucgacccgcggagauguaugaagcccgugauucuuacagauggagaggaacgcgugauccuggccggcccuaugcccgucacccauagcucugccgcucagcggagagggcgcauuggccggaauccuaaaaacgaaaaugaccaguacaucuauaugggagagccccucgaaaacgacgaggauugcgcccacuggaaggaggcgaagaugcugcuggacaauauuaacacgccggaaggcaucauuccuagcauguucgagcccgaaagagagaaaguggaugcuaucguuggggaauaccgccuccggggagaggccagaaagacauuuguggaccuuaugcgcagaggcgaucugccugucuggcuggccuauaaaguggcugccgaggggaucaacuacgcggaccggcgcugguguuucgauggaauuaagaauaaccaaauccucgaagagaauauggaaguugagauuuggaccaaagagggcgaaagaaagaagcugaaaccccgguggcuugacgcccgcaucuauuccgauccucuggcucucaaggaguuuaaagaguucgccgcugggagaaagucucugacacugaaccucauuaccgagaugggccggcuucccacguucaugacccagaaaacaagagacgcccuggauaaucuggcugugcuccacaccgccgaagcgggaggccgcgccuacaaccaugcucugagcgagcuuccggagacacuggaaacccuccugcugcucacacuucuggccaccgucacagggggaaucuuucuguuccucauguccggccgggggaucggaaagaugacacugggcaugugcugcauuaucaccgcuucuauucuucugugguaugcccagauccagccucacuggauugccgcuagcaucauccucgaguuuuuccugauugugcugcucauccccgaacccgagaagcaaagaaccccucaggacaaucagcuuacauacgucgugauugcgauccugaccguuguggccgcuacaauggccaacgaaaugggcuuucuggagaaaacgaagaaagaucucgggcugggauccauugccacccagcaaccggagagcaauauccuugacauugaccugcgccccgcuucugccuggacacucuacgcgguggccaccacauucgucaccccuaugcugcggcauuccaucgaaaacagcuccguuaaugugucucugacggcuaucgccaaccaggcuaccgugcucaugggccuugggaagggauggccccugagcaaaauggauauuggcgucccucugcucgccaucggguguuauucccaggugaaucccauuacacugaccgcggcccuucugcuccugguugcucacuacgccaucauuggaccuggccugcaggcuaaggccacaagagaggcucaaaagcgggccgcggccggcaucaugaaaaacccgaccguggacgggaucacggucauugaucucgaccccaucccuuaugaucccaaguuugaaaaacagcuuggacaggugaugcugcugguccucugcgugacacaaguucugaugaugcgcaccacaugggcucuuugugaggcccugacccucgcuaccggcccuauuucuacacugugggaagggaaucccggaagauucuggaacacgaccaucgccgugagcauggccaauauuuuucggggcuccuaccuggcgggggcuggacuccuuuucagcaucaugaagaacacaaccaacacacgcagaggcaccggcaauaugggggagacgcugggagagaaauggaagucucggcugaacgcccucggcaaauccgaauuucagaucuauaaaaagagcgggauucaggaggucgaccgcacacuggcuaaagaaggaaucaagagaggcgagaccgaucaccaugccgugucucggggguccgccaaacuucgcugguucguugagagaaauauggugaccccggaaggaaaggucguggaccugggcugcggcagagggggauggagcuacuauuguggcgggcucaaaaacgugcgggagguuaagggacugacaaagggcgggccuggacacgaagaacccauucccaugucuaccuacggcuggaaucugguccgccuccagagcggcguggauguguuuuucaucccucccgaaaaaugcgacacacuucugugugauauuggggaguccucuccuaacccgacggucgaggcuggacggacccugagaguucucaaucugguggaaaacuggcuuaauaacaauacacaauucugcaucaaggugcugaaccccuacaugccuagcgucaucgagaaaauggaagcccuccagcgcaaguauggcggggcgcuggugcggaauccccuguccagaaacagcacccaugagauguacuggguuuccaaugccucuggaaacauugugagcuccgucaacaugaucucucgcaugcucauuaaucgguuuacaaugagacacaaaaaggcuaccuaugaaccugacguggaucuuggcagcgggacgcgcaacaucggaauugaguccgagauccccaaucuggacauuaucggcaagcggaucgagaagauuaagcaggagcaugaaaccucuuggcacuacgaccaggaucacccguauaaaacaugggccuaccauggcagcuaugagaccaagcaaacaggguccgcuagcucuaugguuaacggaguggucagacugcucaccaaaccuugggacgugcugcccacagugacccagauggccaugacggauacaaccccuuucggccagcagcgcgucuuuaaggaaaagguugacacccggacacaagagcccaaagaggggacgaagaaacuuaugaagaucaccgcggaauggcuguggaaagagcucggaaagaaaaagacaccuagaauguguacccgcgaagaguucacaagaaaggugcgguccaaugccgcucugggcgccauuuuuaccgaugagaacaaauggaaaagcgcucgcgaagccguggaggacucuagauucugggaacuggucgauaaagagcggaaucuccaccuggaagggaagugcgagacauguguguacaacaugaugggaaaaagagagaagaaacuuggcgaauuuggcaaagcuaaggggucccgggccaucugguacauguggcugggagcgcgcuuccucgaguuugaagcccugggcuuccuuaaugaggaccauugguuuagcagagaaaacucucuguccgggguugagggagagggccuccacaaacugggguauauucugcgggaugugagcaagaaagaaggcggagcuauguacgccgacgauaccgcuggcugggacacgcgcgucacccucgaggaccugaagaaugaagagauggugacaaaccacauggaaggggagcauaagaaacuugccgaggccaucuucaagcugaccuaucagaauaaaguugugagaguccagcggcccacaccgcgcggaaccgugauggauaucauuuccagacgggaccaacgcggcagcgggcagguuggaacguacggccucaacacauuuaccaauauggaagcgcagcugaucagacagauggagggggaaggcguguucaagaacauucaacaccuuacagucaccgaggagguggcugucaaaaacuggcuggcccgggugggacgcgaaagacucucucggauggccaucagcggcgaugacugcguugugaagccucuggaugaccgcuucgcuaaugcccugacggcucucaacgauauggggaagauuagaaaagacauccagcagugggagcccucccggggauggaaugauuggacccagguccccuuuugcucucaucacuuccaugaacugaucaugaaggacggcagagugcuugugguuccuugucgcaaccaagaugagcugauugggcgggccagaaucagccagggagcgggcuggucccuccgcgaaacagccugccuggggaaaucuuaugcucagauguggagccuuauguacuuucaccggagagaccugcgccucgccgcuaaugccauuuguuccgcggugccgucucacuggguccccaccagccggacaaccugguccauccaugccaagcacgaguggaugacaaccgaggauaugcugacgguguggaacagaguuuggauucgcgaaaauccuuggauggaggacaaaacacccguggaaagcugggaggaaaucccuuaucugggcaagcgggaggaccaguggugcggaucucucauuggccugaccuccagagcuaccugggccaagaacauccaagcugccaucaaucagguccgcagccuuauugggaacgaggaauacacagauuacaugcccucuaugaaacgguucagacgggaggaagaggaagcuggagugcugugguga

SEQ ID NO: 20168 - RNA, 9876 nt, Artificial Sequence
  derived and/or modified CDS sequence (opt5) from DENV-2__KU094070__SS-prME
accgcgggaaugaucauuaugcugauccccaccgugauggcuuuccaccucacgaccagaaacggggagccucauaugauugucagccggcaggaaaagggaaagucccugcuuuuuaagacagaggacggcguuaauaugugcacccugauggccauggaucucggggaauggcuggaggacaagaucacauacaaguguccgcuucugagacaaaacgaacccgaggauauugacugcugguguaauucuaccagcacaugggugaccuauggaacgugcaccacaaccggcgagcacagacgggaaaaacgcuccguggcgcucgucccucauguggggaugggacuggagacaagaaccgaaacguggaugucuagcgagggcgcuuggaagcacgcccagcggaucgagacauggauccugcgccaucccggcuucaccauuauggccgcuauccucgccuacacaauugggaccacccacuuucagagagcucugaucuucauucuucugacagccguugcgccuuccaugacgaugcgguguaucggaauuucuaaccgcgauuuuguggaaggcgucagcgggggauccuggguggacaucguucucgagcacggcagcugcgugaccacaauggccaagaauaaacccacccuggauuucgaacuuaucaagacagaggcuaaacagccugccacccugagaaaguauuguauugaagcuaaacucacgaacacaaccaccgagucucggugcccgacacaaggggagcccucccugaaugaagaacaggacaagcgcuuugucuguaagcauagcaugguggauagaggauggggcaacggcugcgggcuguucggaaaaggcucuaucgugaccugugccauguuuacaugcaagaaaauuaugaaggggaaagucguucagccugaaaaucucgaguacacgaucgugauuacaccccacuccggagaagaacaugcggugggcaacgacacagggaagcacggaaaagagaucaagaucaccccucagagcucuauuacagaagccgagcugaccggcuauggcacggucaccauggaaugcagcccccggacagggcuugauuucaaugagauggugcugcuccaaauggaaaacaaggcuuggcugguucaccgccagugguuucuugaccugccgcucccuuggcugcccggagccgauacccagggcagcaauuggauccagaaagagacacuggugaccuucaagaacccucaugcuaaaaagcaagacgucgugguucucgggucccaggagggagccaugcacacggcccugacaggcgcuaccgaaauucagaugucuagcggguaccuucuguuuacaggccaucucaaauguagacugcggauggacaaacuucaacugaagggaauguccuauagcaugugcaccggcaaauucaagguggucaaagagaucgcggaaacccagcacgggacaauugugaucagaguccaguacgagggagauggcucucccuguaagauccccuucgagauuauggaccucgaaaaacgccaugugcuggggcggcugaucacgguuaauccuauugugaccgagaaggauuccccggucaacaucgaagccgagcccccuuuuggagacagcuacauuaucauuggcguggaacccgggcagcucaagcugaacugguucaaaaagggcucuagcaucggacaaauguuugagacaaccaugagaggcgcuaaacgcauggccauccuuggggauacagccugggacuucggaucccugggcgggguuuuuaccucuauuggaaaggcucuccaccagguguucggcgccaucuauggggcggcuuuuagcggcgucuccuggacgaugaaaauucugacaggagugaucauuaccuggaucggcaugaauagccggucuaccucccugagcgugucucuuguucucgucggggccgugacacuguaccugggagugaugguccaggccgauuccggcugcgugguuagcuggaagaacaaggagcucaaauguggguccggaaucuucauuaccgacaaugugcacacauggacggaacaguauaaguuucaaccugagucucccagcaaacuggcuuccgccauccagaaggcucaugaagagggcauuugcgggaucagaucugucacccgccuugaaaaccugauguggaaacagauuacaccggagcucaaucacauccugagcgagaacgaagugaagcugaccaucaugacaggcgauauuaaaggaaucaugcaggccggcaagcggucccuuagaccucaacccaccgagcucaaguacagcuggaaaacgugggggaaggcgaaaaugcugucuaccgaaucccauaaucagacauuccugauugacggaccugagaccgccgaaugucccaacacaaaucgcgcuuggaacagccucgagguugaggauuauggcuuugggguguucaccacaaauaucuggcugaaacuucgggaggaacaggacgucuuuugcgacucuaaacugauguccgccgcuauuaaggauaacagagccgugcacgcggacaugggauacuggaucgaaagcgcccucaaugauaccuggaagaucgagaaggcuucuuucauugagguuaagagcugucacuggccuaaaucccauacgcuguggagcaacggcgugcuggaaucugagaugaucauucccaagaauuucgccggcccggucucccagcacaacuaucgcccuggguaccauacacaaaccgcuggacccuggcaccuuggcaaacucgaaauggacuuugauuucugcgaggggaccacagugguggucaccgaagacuguggaaaccggggccccagccugagaacgacaaccgccuccgggaagcugaucacagaguggugcugccggucuuguacccucccuccgcugcgcuacagaggagaggauggcugcugguauggcauggaaauucggccccuuaaggagaaagaagagaaucugguuaacagccucgugacagccgggcauggacagaucgacaauuuuucccugggcgugcuggggauggcucuuuuccucgaagagaugcugagaacccgcgucggaacgaagcacgcgauucugcucguggccguuucuuuugugacccugaucacaggcaacaugagcuuccgggaucuugggagagucauggugaugguuggagcuaccaugacagacgauaucggcaugggcgugaccuaccuggcccuccuggccgcuuuuaaaguccgcccuacguucgccgcggggcugcuucugagaaagcucacauccaaagagcugaugaugaccacaauuggaaucgugcuccugucucagagcaccauucccgaaaccauccuugagcugacagacgcucucgcccugggcaugaugguucugaagauggugcggaagauggaaaaauaucaacuugccgucacgauuauggcuauccugugugugccuaaugccgugauccuccagaacgcguggaaggucuccugcaccauucuggcuguugugagcgugucuccccucuuucugacauccagccagcagaaagccgauuggaucccucuugcccugaccauuaaggggcucaaucccacagcuaucuuccugaccacgcugucucgcacaaacaaaaagagauccuggccgcuuaaugaggccauuauggcugucggaauggugagcauccuggccucuucccuccugaaaaacgacaucccuaugaccggcccccucguugccgggggacugcuuaccguguguuacguccugacaggccggagcgccgaccuggaacucgagcgcgcugccgaugugaagugggaggaccaagcugaaauuuccggcagcucuccuauccugagcauuaccaucuccgaggaugggucuaugagcauuaagaaugaagaggaggaacagacacuuacgauccugauuagaaccggacuccugguuaucuccggccucuuucccgugucuaucccgauuacagccgccgcuugguaucugugggaggucaaaaagcagcgggcgggggugcuuugggacgucccuucucccccucccgugggaaaagccgaacuggaggauggcgcuuaccgcaucaagcagaaagggauucugggauauucccaaaucggcgccggcguuuacaaggaagggaccuuccacacaauguggcaugugaccagaggagccguccucaugcacaagggcaaacggauugagcccuccugggcugacgugaagaaagaucugaucagcuacgggggaggcuggaaacuugagggggaauggaaagagggagaagagguucaggugcuggcccucgaaccuggcaagaacccgcgcgcgguccagacgaagcccggccuguuuaaaaccaaugcugggacaaucggagccgugucccucgacuucagcccuggcaccucugggucccccauuaucgauaagaaaggaaaggugguuggccuguaugggaacggagucgugacaagaagcggcgccuacgugucugcuauugcccagaccgagaaauccaucgaggacaauccugaaauugaggaugacaucuuccggaagagaaaacuuacaaucauggaucugcaucccggcgcggggaaaacgaagcgcuaucugccugcuauuguccgggaagccaucaaaagaggacuccgcacccugauucuugccccgacacgggugguugcugccgagauggaagaggcucugagaggccuccccauccgcuaccaaaccccugccauucgggcggagcacaccgggagagaaaucguggaccugaugugccaugccacauuuacgaugcgccuccugagccccguccgggugccuaacuauaaccuuauuaucauggacgaggcucacuucaccgaucccgccuccaucgcugccagaggauacauuucuacacggguugaaaugggcgaggccgcugggaucuuuaugaccgcgacaccgccuggcagccgcgaccccuucccccaguccaaugccccuauuauggaugaggaaagagagauccccgaacggagcuggucuuccggacacgagugggugaccgacuuuaagggcaaaacggucugguucgugccuagcauuaaggcugggaacgauaucgccgccugucugcgcaagaauggcaagaagguuauccagcugucuagaaaaacauuugacagcgaauaugugaagacccggaccaacgauugggacuucgucgugacaaccgauauuuccgagaugggcgcuaauuuuaaagccgagagagugaucgacccgcgccggugcaugaagcccgucauucucacagauggggaagagagaguuacccuggcgggaccuaugcccgugacgcauucuagcgcugcccaacgccggggcagaaucgggcgcaacccuaaaaaugaaaacgaccaguacauuuacaugggcgagccccuugaaaaugacgaggauugugcccacuggaaggaggcuaagaugcugcucgacaacaucaauacaccggaaggaaucauuccuuccauguucgagcccgaacgggagaaaguggaugccaucgacggcgaauauagacugcgcggggaggcgagaaagaccuuugucgaucugaugcggcgcggagaccucccuguguggcuugccuacagaguugcugccgagggcauuaacuaugcugaucggcgcuggugcuucgacgggaucaaaaauaaccagauucuggaagagaauguggaagucgagaucuggacaaaggagggagaacgcaagaagcugaagccccgguggcucgaugccagaauuuacucugacccucuggcucuuaaagaguucaaggaauuugccgcgggccgcaaaagccugacccucaaccugaucacggagauggggcggcugcccaccuucaugacacagaaggccagagaugcucucgacaaccuugccgugcugcauaccgcugaagccggcggacgcgccuauaaucacgcucuguccgagcucccggagacacuggaaacccuucugcuccugacacugcucgcgaccguuacgggcgggaucuuucuuuuccugaugagcggacggggcauugggaaaaugacacugggaauguguugcaucauuaccgccucuauccuccugugguacgcucaaauucagccucacuggaucgccgccuccaucauucuugaguuuuuccugaucgugcuccugauucccgaacccgagaagcagagaaccccucaggauaaccaacugacauaugucgugaucgcuauucucaccgucguggccgcgacaauggccaaugaaaugggcuuucuugagaagacgaaaaaggaccugggccuggggagcaucaccacacagcagccggaguccaacauccucgacauugaucugcggcccgcuucugccuggacccuuuacgcuguugccacaaccuucgugacgccuaugcugcgccauagcaucgaaaauuccucugugaacgucagccucaccgcgauugccaaucaggcuacaguucugaugggacugggcaaaggguggccccucuccaagauggacaucggagugccucuucuggccauuggcugcuacagccaagugaaccccaucacccugacagcugcccucuuucugcuugucgcucacuaugccauuaucgggccuggacugcaggcgaaagccaccagagaggcucagaagcgggccgcugccggcaucaugaagaauccgacgguggauggcauuacaguuaucgaccucgaucccauuccuuacgaccccaaauucgaaaagcagcuggggcaagugaugcugcucguccuuugugugacccagguccugaugaugcgcacaaccugggcccugugcgaggcgcucacccuggcuacaggaccuaucucuacgcuuugggaaggcaaccccgggagauuuuggaauaccacaauugccguguccauggcuaacaucuuccggggaagcuaucuggccggcgccgggcuccuguuuucuaucaugaaaaauaccacaaacacccgcagaggaacgggcaauauuggcgagacacugggggagaaguggaaaucccggcucaacgcucuuggaaagagcgaguuccagaucuacaaaaagucuggcauucaagagguugaucgcacccuggccaaggaagggaucaaaagaggagagaccgaccaucacgcggugagccggggcuccgccaagcugagaugguucgucgagcgcaaucucgugacaccggaagggaaaguuguggaucugggauguggccggggcggguggucuuauuacugcggaggccuuaagaacgucagagaggugaaagggcugaccaagggaggcccugggcaugaggaacccauucccaugagcacauauggauggaaccucgugcgccugcaguccggcguugacgucuuuuucacgccucccgaaaagugugauacccugcucugcgacaucggcgagagcuccccuaauccgacaguggaggcugggcggacccuuagagugcugaaccuggucgaaaauuggcucaacaauaacacacaguuuuguaucaaaguucugaaucccuacaugccuucugugauugagaagauggaagcccuucagcgcaaauacggaggcgcucuggugcggaacccccucagcagaaauuccacccacgagauguauugggucucuaacgccagcgggaauaucguguccucuguuaacaugauuagccgcaugcugaucaaucgguucacgaugagacacaagaaagcgaccuacgaaccugauguggaccugggauccggcacacgcaacauugggaucgagagcgagauccccaaucucgacauuaucggaaagcggauugaaaagaucaaacaagagcaugaaaccucuuggcacuaugaucaggaccauccguacaagacaugggccuaucacggcuccuacgagaccaaacagacaggcagcgcuucuuccauggucaacggggugguuagacuucugaccaagccuugggaugugguccccauggugacgcagauggccaugacagacaccaccccuuuuggacaacagcgcguguucaaagaaaaggucgauacaagaacgcaggagcccaaggagggcaccaaaaagcugaugaaaauuacagcugaauggcucuggaaggagcuggggaaaaagaaaaccccucggaugugcacacgcgaagaguuuaccagaaagguucggagcaacgccgcucuuggagccaucuucacagacgagaauaaguggaaaucugcgagagaagccguggaggauucccgguuuugggaacugguggacaaggagcgcaaccuccaccuggaaggcaaaugugagaccugcgucuauaauaugauggggaagagagagaaaaagcugggagaguucggcaaggcuaaaggcagccgggccauuugguacauguggcucggggcucgcuuucuggaguucgaagcccuuggauuucugaacgaggaucauugguucuccagagaaaauagccucucuggcguggagggggagggacugcacaaacuuggcuacauccugcgggacguuagcaaaaaggaagggggcgccauguaugcggaugacacggcuggaugggacacccgcaucacacucgaggaucugaaaaacgaagagauggugaccaaucauauggaaggcgagcacaagaagcuggccgaggccauuuucaaacucacauaccagaacaaggucgugagaguucaacggcccaccccgcgcgggacggugauggacaucauuuccagacgggaucagcgcggaucuggccaggucgggacauauggacugaauaccuuuacaaacauggaagcucaacuuaucagacagauggagggcgaagggguguucaaaagcauucagcaucugaccguuacggaggagaucgccgugcagaauuggcucgcucgggucggccgcgaaagacugucccggauggccaucucuggagacgauuguguggucaagccucuugacgauagauuugcgagcgcccugaccgcucucaacgacaugggcaaagugcgcaaggauauucaacagugggagcccucccggggguggaaugacuggacacagguucccuucugcucucaccacuuucaugaacugaucaugaaggauggaagagugcuggucgugccuugccgcaaccaggacgagcucauuggccgggccagaaucagccaaggggcuggauggucccugcgcgaaaccgccugucuuggcaaaagcuacgcgcagauguggucucugauguauuuccaccggagagaucuccgccuggccgcuaaugccauuugcuccgcugugccgagccauuggguucccacaucucggaccacaugguccauccacgccaagcacgaguggaugaccacggaggacaugcuuacaguguggaacagagucuggauccaggaaaacccuuggauggaggacaaaacccccguggaaagcugggaggaaauuccuuaccuggggaagcgcgaggaucagugguguggcucccucaucggacugaccucucggguuacauggggcaaaaauauucaaaccgcuaucaaccaggugagaagccugauugggaaugaggaauauacagacuacaugcccuccaugaagcgguuuagacgcgaggaagaggaagccggaguccucugguga

SEQ ID NO: 20169 - RNA, 9876 nt, Artificial Sequence
  derived and/or modified CDS sequence (opt5) from DENV-2__FM210215__SS-prME
agcgccggcaugaucgugaugcugauucccacagugauggcuuuccaccugacaacgagaaauggggagccucauaugaucguuggcauucaagaaaagggaaaaucccugcuuuuuaagaccgaggacggggugaauaugugcacacugauggccauggaucugggagaacugugugaggacaccaucacauacaaaugcccgcuucugcggcaaaacgaacccgaggauauugacuguuggugcaauucuaccagcacaugggugaccuauggcacguguaccacaaccggggagcaccgcagagaaaagcgguccgucgcgcucgugccucauguuggaaugggccuggagacacgcaccgaaacguggaugucuagcgagggcgcuuggaaacacgcccagagaaucgagacauggauccugcggcaucccggguucaccauuauggccgcuauccucgccuacacaauuggaaccacccacuuucagcgcgugcugaucuucauucuucugacagcugucgccccuuccaugacgaugagaugcaucggcauuucuaaccgggauuuuguggaagggguuagcggaggcuccuggguggacaucguccucgagcacgggagcugugugaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaagacaagcgguuugugugcaagcauagcauggucgaucgcggcuggggcaauggguguggacuguucggcaaagggggaaucguuaccugcgcuauguuuacaugcaagaaaaacauggaaggcaagauugugcagccugagaaucucgaauacacgaucguggucacaccccacucuggggaggagcaugccgugggaaacgacacaggcaaacacggcaaggaaauuaaaguuaccccucaguccagcaucacagaggcggaacugaccggguauggaacggugaccauggaguguucucccagaacaggccuugauuucaaugaaaugguccugcuccaaauggagaacaaggccuggcuggugcaccggcagugguuucuugaccugccgcucccuuggcugcccggggcugauaagcaggaguccaauuggauccagaaagaaacccugguuacauucaagaacccucaugccaaaaagcaagacguggucgugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauuguuauccgggugcaguaugaaggcgaugggagccccugcaagauucccuucgagaucauggaccucgagaagcgguacguccugggacgccugaucacagugaacccuauuguuacggagaaggauucuccggugaacaucgaagcggagcccccuuuuggcgacuccuacauuaucauuggggucgagcccggccagcucaagcugaauugguucaaaaagggaagcucuaucggccaaauguuugaaaccacaaugagaggggccaaaagaauggcuauucuuggagauaccgccugggacuucggcagccucgggggaguguuuacauccaucggcaaggcccuccaucagguguucggggcuaucuauggcgccgcguuuucuggaguuagcuggaccaugaaaauucugaucggcgucauuaucacguggauugggaugaacucccgcagcacaucucuguccgugagccuugugcucgucggaaucgugacccuguaccugggcguuauggugcaggcugauucugggugugucguguccuggaagaauaaggagcucaaaugcggaagcggcaucuucauuaccgacaacguucacacauggaccgaacaguauaaguuucaaccugagucccccucuaaacuggccagcgccauccagaaggcucaggaagaggggauuuguggcauccgguccgugacaagacuugagaaucugauguggaaacagauuacgccggaacucaaccacauccuggccgagaaugaagucaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaagaaaagcaggacgcuuuuugugacuccaagcugaugagcgccgcuauuaaagauaaucgcgccgugcaugcggacaugggcuauuggaucgagucugcccucaacgauaccuggaagaucgagaaggcuagcuucauugaagucaagaauugccacuggccuaaaagccauacacuguggucuaacggcgugcuggagagcgaaaugaucauucccaagaaccuugccgggccggugucccaacacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauucgcccccugaaggagaaagaagagaaucucgugaacagccuggugaccgccggacacggccaggucgauaauuucucccugggggugcuuggaauggcucucuuucuggaagagaugcugagaacacggguuggcaccaagcaugcgauccuccugguggccgucucuuucgugacacuuaucaccgggaacaugagcuuuaaagaccugggaagaguuguggucauggugggcgcuacgauggccgaugacauuggcauggggguuaccuaucucgcccugcuggcugccuucaaggugcgcccuacauuugcggcuggacuucugcuccggaagcugaccuccaaagagcucaugaugacaaccaucggcauuguccugcuuucucaaagcacgauccccgaaacagugcuggagcucaccgaugcccuggcccuggggaugauggugcuuaagauugucagaaauauggaaaaauaccagcuggcuguuacaaucauggccauccucugcgugccuaacgcggugguccugcagaaugcuuggaagguguccuguaccauucucgccguugugucugucagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccauuauggcugugggcaugguuagcauccuggccucuucccuccugaagaaugacaucccuaugaccgggccccuuguggcgggaggccugcugacggucugcuaugugcucacaggccggagcgccgaucuggaacuugagaaagcuaccgacgucaagugggaggaucaggccgaaauuucuggguccagcccuauccuguccauuaccaucagcgaggacggaucuaugagcauuaaaaacgaagaggaggaacagacacucaccauccugauucgcacaggccuccuggugaucuccgggcuuuuucccaucucuauuccgaucacggcugccgccugguaccugugggagguuaagaaacagagagcuggagugcugugggaugucccuucucccccucccaugggcaaggcggaacucgaggacggggccuaucggauuaagcaaaaaggaauccugggcuacucccagauuggcgcugggguguacaaggaaggaaccuuccacacaauguggcauguuacccgcggcgccgugcuuaugcacaaagggaagagaaucgagcccuccugggccgaugucaaaaaggaccugaucagcuauggaggcggguggaagcucgagggagaauggaaagagggcgaagagguccaggugcuggcucucgaaccuggcaagaauccgcgggccguucagacaaaacccgggcuguuuaagaccaacacgggaaccauuggcgcggucucccuugauuucucuccugggacaagcggaucccccaucauugacaaaaagggcaaggugguggggcuguacggaaacggcgucgugacccgcagcggcgcuuauguuucugccaucgcccaaacagagaaauccauugaggauaauccugaaaucgaggacgauaucuuuagaaagcggcgccugaccauuauggaccuccaccccggggcuggaaaaacaaagagauaccugccugccaucgugcgggaagcgauuaaaagaggccuucgcacgcugauccucgcuccgacccgggucguggccgccgagauggaagaggcucugagagggcuccccauucgcuaucagaccccugccaucaaggcugagcauaccggacgggaaauuguugaccugaugugucacgccaccuucacaaugagacuucugagccccgugcgcgucccuaacuacaaucugaucaucauggaugaggcgcauuucacggaccccgccucuauugcugcccggggcuauaucuccaccagaguggaaaugggggaggcugccggcauuuuuaugacagccaccccgccuggaagccgcgaucccuucccccaguccaacgcuccuaucauugacgaggaacgggagauccccgaaagaucuuggaauagcggccacgaguggguuacagauuuuaaggggaaaaccgugugguucgucccuuccaucaaggcgggaaacgacauugccgcuugccuccggaaaaauggcaagaaagugauccaacugagccgcaagacguuugauucugaauacgugaaaacaagaaccaacgacugggauuucgucguuaccacagacauuuccgagaugggggccaauuuuaaggccgagcgggugaucgauccgcgcagauguaugaagcccgugauucuuaccgacggagaggaacgggucauccuggcuggcccuaugcccgugacacauagcucugccgcgcagagacgcgggcggaucggcagaaacccuaaaaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaacgcgagaagguugacgccauugauggggaauaccggcucagaggagaggcucgcaaaacguuuguggaccuuaugcggagaggcgaucugccugucuggcuggccuauaagguggcggccgaggggaucaacuacgcugaccgcagaugguguuucgauggaauuaagaacaaucagauccucgaagagaacguugaaguggagaucuggacaaaagagggcgaacggaagaaacugaagccccgcuggcuugacgccagaauuuauuccgauccucuggcucucaaagaguuuaaggaguucgccgcugggcggaagucucugacccugaaucucaucacagagaugggccgccuucccaccuucaugacgcagaagacaagagacgcccuggauaaccuggcgguccuccacacagccgaagcuggaggccgggccuacaaucaugcucugagcgagcuuccggagacccuggaaacacuccugcugcucacccuucuggccacagugaccgggggaauuuuucuguuccucauguccggcagagggaucggaaagaugacgcugggcaugugcugcauuaucacagccucuauccuucugugguaugcucagauucagccucacuggaucgcggccagcauuauccucgaguuuuuccugauuguccugcucauccccgaacccgagaaacagcgcaccccucaagacaaccagcuuaccuacgugguuaucgcuauucugacagugguggccgccaccauggcuaaugaaaugggcuuucuggagaagaccaagaaggaccucgggcugggauccaucgccacgcagcagccggagagcaacauucuugauaucgaccugcggcccgcgucugccuggacccucuacgcugucgccacaaccuucguuacaccuaugcugagacauuccauugaaaauagcuccgugaacgugucucugaccgcuaucgccaaucaagcgacgguccucaugggccuugggaagggauggccccugagcaaaauggauauuggcgugccucugcucgccaucggguguuauucccagguuaaccccaucacccugacagcugcccuucugcuccugguggcucacuacgccauuaucggaccuggccugcaggcuaaggccacccgcgaggcgcagaaacgggccgcugccggcauuaugaagaauccgacagucgacgggaucaccgugauugaucucgaccccaucccuuaugaucccaaauuugaaaagcaacuuggacaggucaugcugcugauccucugcgugacgcagguucugaugaugagaacaaccugggcucuuugugaggcccugacacucgccaccggcccuauuucuacccugugggaagggaaccccggacgguucuggaauacaacgaucgcggugagcauggcuaacauuuuucgcggcuccuaccuggccggggcuggacuccuuuucagcaucaugaaaaauaccacaaacaccagacggggcacaggcaacauuggggagacccugggagagaaguggaagucucgccucaauucccucggcaaaagcgaauuucaaaucuauaagaaaucugggauccaggaggucgacagaacgcuggccaaggaaggaauuaaacggggcgagacagaucaccaugccgugucccgcgggagcgcuaaacuuagaugguucguugagcggaacauggugaccccggaaggaaaggucguggaccugggcugcggccgcgggggauggucuuacuauuguggcgggcucaaaagcgugagagagguuaagggacugaccaaaggcgggccuggacacgaagaacccauccccauguccacauacggcuggaaucugguccggcuccagucuggcguggauguguuuuucauuccucccgaaaagugcgacacccuucugugugauaucggggagagcuccccuaacccgacagucgaggccggaagaacgcugcgcguucucaaucugguggaaaacuggcuuaauaacaauacccaguucugcauuaaagugcugaaccccuacaugccuagcgucaucgagaagauggaagcgcuccaacggaaguauggcggggcccuggugagaaauccccugucccgcaacucuacacaugagauguacuggguuagcaaugcuuccggaaacaucgugucuagcgucaauaugauuucccggaugcucaucaacagauuuaccaugcgccacaaaaaggccacauaugaaccugacguggaccuuggcucugggacccggaacauuggaaucgagagcgagauucccaaucuggauaucauuggcaaaagaaucgaaaagaucaaacaggagcaugaaacguccuggcacuacgaccaggaucacccguauaagaccugggcuuaccauggcagcuaugagacaaagcagaccgggucugccuccagcaugguuaacggagugguccgccugcucacaaaaccuugggacgugcugcccaccgugacacaaauggcgaugaccgauacgacaccuuucggccagcagcgggucuuuaaggaaaaaguugacaccagaacccaggagcccaaggaggggaccaagaaacuuaugaaaauuacggccgaauggcuguggaaagagcucggaaagaaaaagaccccucgcauguguacacgggaagaguucaccagaaaagugcgcucuaaugcugcccugggcgcuaucuuuacagaugagaacaaguggaaauccgccagagaagcuguggaggacagccgguucugggaacuggucgauaaggagcgcaaucuccaccuggaagggaagugcgagaccuguguguacaacaugaugggaaaaagagagaagaaacuuggcgaauuuggcaaggccaaagggucucgggcgauuugguacauguggcugggagccagauuccucgaguuugaagcucugggcuuccuuaaugaggaccauugguuuucccgggaaaacagccuguccgggguugagggagagggccuccacaagcugggguauauccugcgcgaugugagcaagaaagaaggcggagccauguacgcugacgacacagccggcugggauaccagaauuacgcucgaggaccugaagaaugaagagauggucaccaaccacauggaaggggagcauaagaaacuugccgaggcgaucuucaaacugacauaucaaaauaaagugguucgggugcagcgccccaccccgagaggaacagucauggauaucauuucucggcgcgaccagagaggcagcgggcaagugggaaccuacggccucaacacguuuacaaauauggaagcucagcugauccggcagauggagggggaaggcguuuucaagaacauucagcaccuuaccgugacagaggaggucgccgugcaaaauuggcuggcccgcgucggaagagaacggcucucccgcauggcuaucucuggcgaugacugcgugguuaaaccucuggaugacagauucgccaacgcucugaccgcccucaacgauauggggaagauucggaaagacauccagcagugggagcccagcaagggauggaaugauuggacacaggugcccuuuugcucccaucacuuccaugaacugaucaugaaagacggccgcguccuuguggugccuuguagaaaccaagaugagcugauugggcgggcgagaaucucucagggagccggcuggagccuccgcgaaaccgcuugccuggggaaguccuaugcccagauguggucucuuauguacuuucaccggagagaccugcgccucgcugccaaugcgauuuguagcgccguuccgucccacugggugcccacaagccggaccacauggucuauccaugcuaagcacgaguggaugaccacagaggacaugcugaccgucuggaacagaguguggauucgcgaaaauccuuggauggaggauaaaacgcccguugaauccugggaggaaaucccuuaucugggcaagcgggaggaccaguggugcggaagccucauuggccugacaucuagagccaccugggcuaaaaacauccaagccgcuaucaaucaggugcgcucccuuauugggaacgaggaauacaccgauuacaugcccagcaugaagcgguucagacgcgaggaagaggaagccggaguccugugguga

SEQ ID NO: 20170 - RNA, 9876 nt, Artificial Sequence
  derived and/or modified CDS sequence (opt5) from DENV-2__FM210216__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcgccaccauggcugaugacaucggcaugggggugacauaucucgcccugcuggccgcuuucaagguucgcccuaccuuugccgcgggacuucugcuccggaagcugacauccaaagagcucaugaugaccacgauuggcaucgugcugcuuucucaaagcacaauucccgaaaccguccuggagcucacagaugcucuggcccuggggaugauggugcuuaagaucgugagaaauauggaaaaauaccagcuggccgucaccaucauggcuauucucugcguuccuaacgccgugauccugcagaaugcguggaagguguccuguaccauucucgcugucgugucuguuagcccccugcuucugacauccagccagcagaagacggacuggaucccucucgcccugaccauuaagggacugaaccccacagccaucuuccuuaccacacugucucgcaccaauaaaaagagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaaaugggaggaucaggcugaaauuucuggguccagcccuauccuguccauuacaaucagcgaggacggaucuaugagcauuaagaacgaagaggaggaacagacccucacaauccugaucagaacgggccuccuggugauuuccgggcuuuuucccaucucuauuccgaucaccgccgcugccugguaccugugggaggucaaaaagcagcgggccggagugcugugggauguuccuucucccccucccaugggcaaagcugaacucgaggacggggcguaucgcauuaagcaaaagggaauccugggcuacucccagaucggcgccgggguguacaaagaaggaacauuccacaccauguggcaugucacaagaggcgcugugcuuaugcacaaggggaaacggauugagcccuccugggccgauguuaagaaagaccugaucagcuauggaggcggguggaagcucgagggagaauggaaggagggcgaagaggugcagguccuggcccucgaaccuggcaaaaauccgcgcgcugugcagaccaagcccgggcuguuuaaaacgaacaccggaacaauuggcgccgugucccuugauuucucuccugggaccagcggaucccccaucauugacaagaaaggcaagguugucgggcuguacggaaacggcguggugacaagaagcggcgcguaugucucugcuaucgcccaaaccgagaaguccaucgaggauaauccugaaauugaggacgauaucuuucggaaacgcagacugacaauuauggaccuccaccccggggccggaaagacgaaacgguaccugccugcuaucgugagagaagccauuaagcgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaacuacaaucugauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaguccaacgccccuaucaucgacgaggaacgggagauucccgaacgcucuuggaauagcggccacgagugggucaccgauuuuaaagggaagacggugugguucguuccuuccaucaaggcuggaaacgacauugcggccugccuccgcaaaaauggcaagaaagugauccaacugagccggaagacauuugauucugaauacgucaaaacccgcaccaacgacugggauuucguggugacaaccgacauuuccgagaugggggcuaauuuuaaggccgagagagucaucgauccgcggagauguaugaaacccguuauccuuacagacggagaggaacgcgugauucuggccggcccuaugcccgugacccauagcucugcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauacgccggaaggcauuaucccuagcauguucgagcccgaaagagagaaggucgacgccauugauggggaauaccgccuccggggagaggccagaaaaacauuuguggaccuuaugcgcagaggcgaucugccuguuuggcuggcuuauaagguggccgcggaggggaucaacuacgccgaccggcgcugguguuucgauggaaucaaaaacaaucagauucucgaagagaacgucgaaguggagaucuggaccaaggagggcgaaagaaagaaacugaagccccgguggcuugacgcucgcauuuauuccgauccucuggcccucaaagaguuuaaggaguucgcugccgggagaaaaucucugacacugaaucucaucaccgagaugggccggcuucccacguucaugacccaaaagacaagagacgcucuggauaaccuggccguucuccacaccgcggaagccggaggccgcgcuuacaaucaugcccugagcgagcuuccggagacacuggaaacccuccugcugcucacacuucuggcuaccgugacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucguccugcucauucccgaacccgagaaacagagaaccccucaagacaaccagcuuacauacguggucaucgccauucugaccgugguugcugccacaauggccaaugaaaugggcuuucuggagaagacgaaaaaggaccucgggcugggauccaucgcuacccagcagccggagagcaacauucuugauaucgaccugcgccccgccucugcguggacacucuacgccguggcuaccacauucgugaccccuaugcugcggcauuccauugaaaauagcuccgucaacguuucucugacggccaucgcuaaucaagccaccgugcucaugggccuugggaaaggauggccccugagcaagauggauaucggcgugccucugcucgcgauuggguguuauucccaggucaaccccaucacacugaccgccgcccuucugcuccugguggcccacuacgcuauuaucggaccuggccugcaggccaaggcuacaagagaggcccagaaacgggcggccgcuggcauuaugaagaauccgaccguugacgggaucacggugaucgaucucgaccccauuccuuaugaucccaaauuugaaaagcaacuuggacaggucaugcugcugauccucugcgugacacagguccugaugaugcgcaccacaugggcccuuugugaggcucugacccucgccaccggcccuauuucuacacugugggaagggaaccccggaagauucuggaauacgaccaucgccgugagcauggcgaacauuuuucggggcuccuaccuggcuggggccggacuccuuuucagcaucaugaaaaauacaaccaacacacgcagaggcaccggcaacaucggggagacgcugggagagaaguggaaaucucggcugaaugcucucggcaaguccgaauuucaaauuuauaagaaaagcgggauccaggagguugaccgcacacuggccaaggaaggaauuaaaagaggcgagaccgaucaccaugccgugucucggggguccgcuaaacuucgcugguucgucgagagaaacauggugaccccggaaggaaaaguuguggaccugggcugcggcagagggggauggagcuacuauuguggcgggcucaagaauguccgggaggugaagggacugacaaaaggcgggccuggacacgaagaacccauccccaugucuaccuacggcuggaaccuggugcgccuccagagcggcguugaugucuuuuucauuccucccgaaaagugcgacacacuucugugugauaucggggaguccucuccuaauccgacgguggaggccggacggacccugagagugcucaaccuggucgaaaauuggcuuaacaauaacacacaguucugcaucaaaguucugaaucccuacaugccuagcgugauugagaagauggaagcgcuccaacgcaaauauggcggggcccuggugcggaacccccuguccagaaauagcacccaugagauguacugggucuccaacgcuucuggaaauaucgugagcuccguuaacaugauuucucgcaugcucaucaaccgguuuacaaugagacacaagaaggccaccuaugaaccugacguggaccuuggcagcgggacgcgcaauauuggaaucgaguccgagauucccaaccuggauaucaucggcaaacggauugaaaagaucaaacaggagcaugaaaccucuuggcacuacgaccaggaucacccguauaagacaugggcuuaccauggcagcuaugagaccaaacagacaggguccgccagcucuauggucaauggagugguuagacugcucaccaagccuugggacgugcugcccacagucacccaaauggcgaugacggauacaaccccuuucggccagcagcgcguguuuaaggaaaaaguggacacccggacacaggagcccaaggaggggacgaagaaacuuaugaaaauuaccgccgaauggcuguggaaagagcucggcaagaagaagacaccuagaauguguacccgcgaagaguucacaagaaaaguccgguccaacgcugcccugggcgcuaucuuuaccgaugagaauaaguggaaaagcgcccgcgaagcuguugaggacucuagauucugggaacugguggauaaggagcggaaccuccaccuggaagggaaaugcgagacauguguguacaauaugaugggaaagagagagaagaaacuuggcgaauuuggcaaggccaaagggucccgggcgauuugguacauguggcugggagcccgcuuccucgaguuugaagcucugggcuuccuuaacgaggaccauugguuuagcagagaaaauucucuguccggggucgagggagagggccuccacaagcugggguauauccugcgggaugugagcaaaaaggaaggcggagccauguacgcugacgacaccgccggcugggauacgcgcaucacccucgaggaccugaagaacgaagagaugguuacaaaucacauggaaggggagcauaagaaacuugccgaggcgauuuucaaacugaccuaucaaaacaaaguggucagagugcagcggcccacaccgcgcggaaccguuauggauaucauuuccagacgggaccagcgcggcagcgggcaagugggaacguacggccucaauacauuuaccaacauggaagcucagcugaucagacagauggagggggaaggcgucuucaaaaauauucagcaccuuacagugaccgaggagguugccgugcaaaacuggcuggcccgggucggacgcgaaagacucucucggauggcuaucagcggcgaugacugcguggucaagccucuggaugaccgcuucgccaacgcucugacggcccucaaugauauggggaagaucagaaaagacauucagcagugggagcccuccaagggauggaacgauuggacccaggugcccuuuugcucucaucacuuccaugaacugaucaugaaagacggccggguucuuguggucccuuguagaaaucaagaugagcugauugggcgcgcgcggaucagccagggagccggcuggucccucagagaaacagcuugccuggggaagucuuaugcccagauguggagccuuauguacuuucaccgccgggaccugagacucgcugccaacgcgauuuguuccgccgugccgucucacugggugcccaccagccgcacaaccugguccauccaugcuaaacacgaguggaugacaaccgaggacaugcugacgguuuggaaucggguguggauuagagaaaacccuuggauggaggauaagacacccgucgaaagcugggaggaaaucccuuaucugggcaagcgcgaggaccaguggugcggaucucucaucggccugaccucccgggccaccugggcuaaaaauauucaagccgcuaucaaccaggugagaagccuuauugggaaugaggaauacacagauuacaugcccucuaugaagcgcuuccggagagaggaagaggaagccggaguucugugguga

SEQ ID NO: 20171 - RNA, 9876 nt, Artificial Sequence
  derived and/or modified CDS sequence (opt5) from DENV-2__FM210217__SS-prME
accgccggcgugaucauuaugcugauccccacagcuauggccuuccaccucacgaccagaaacggggaaccucauaugauugucggacggcaggaaaagggcaagagccugcuuuuuaagacagaagacgggguuaauaugugcacccugauggcgaucgaucucggagaacugugugaagacacaauuaccuacaagugcccccuucugcgccaaaacgaacccgaggauaucgacuguuggugcaauuccacaucuaccugggugacguauggcaccuguacaaccacaggggaucacagacgggagaagcgcagcguggcucucgucccucaugugggaaugggccuggaaaccagaacggagacauggauguccucugaaggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgacuuugucgagggggugucuggaggcagcuggguugauaucgugcucgaacacggguccugugucaccacaauggccaagaauaagcccacccuggacuucgagcuuaucaaaacagaagcuaagcagccugccacccugagaaaauauugcauugaggcgaagcucacgaacacaaccaccgaaagccgguguccgacacaaggagagcccucucugaaugaggaacaggauaaacgcuuugugugcaagcauuccaugguggacagaggcuggggcaacggguguggacuguucggcaaagggggcaucguuaccugcgccauguuuacaugcaaaaagaauauggagggcaaaauuguucagccugaaaaccucgaguacacgaucgugauuacaccccacagcggggaagaacaugcugugggaaaugauacaggcaagcacggcaaagagaucaagaucaccccucagucucccauuacagaagccgagcugaccggguauggaacggucaccauggaauguuccccgcggacaggccuugacuucaacgagauggugcugcuccaaauggaagauaaggcuuggcugguucaccgccagugguuucuugaccugccucuccccuggcugccuggggccgacacccagggaagcaauuggauccagaaggagacacuggugaccuucaagaacccccaugccaaaaagcaagaugucgugguucucggcucucaggagggggcuaugcacacggcgcugacaggcgccaccgaaauucagauguccagcggaaaucuucuguuuacaggccaucucaaaugcagacugcggauggacaaacuucaacugaaagggauguccuacucuauguguaccggaaaguucaagaucgugaaagagauugcugaaacccagcacggcacaaucgucaucagagugcaguaugagggggauggaagccccugcaagauuccuuucgagaucauggaccucgaaaaacgccauguccugggccggcugauuacggugaacccgaucguuaccgagaaggauucccccgugaacauugaagccgagccucccuuuggggacagcuacaucauuaucggcgucgaaccuggacagcucaaacugaauugguucaagaagggaucuuccaucgggcaaauguuugagacaaccaugagaggagccaaacgcauggcuauucuuggcgauacagccugggacuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgauuccggauguguggucagcuggaagaauaaagagcucaagugcggcucugggauuuucaucacagacaacgugcacaccuggacagaacaguacaaguuucaacccgaguccccgagcaaacuggcuuccgccauucagaaggcgcaugaagagggcaucuguggaaucagaucuguuacgcgccuugaaaaucugauguggaaacagauuaccccugagcucaaccacauccugagcgagaaugaagugaagcugacaauuaugaccggcgauaucaaagggauuaugcaggccggaaagcggucccuuagaccccaaccuacagagcucaaauauucuuggaagaccuggggcaaggcuaaaaugcugagcacggaaucccauaaccagaccuuccugaucgacgggcccgagacagccgaaugcccuaauaccaaccgcgcuuggaauagccucgaggucgaggacuacggauuuggcguguucacaaccaacaucuggcugaaacuucgggaaaaacaggaugucuuuugugacucuaagcugauguccgccgcgauuaaagauaauagagccgugcacgcugacaugggcuauuggaucgagagcgcccucaacgauacauggaagauggaaaaggcuucuuucauugaggucaaauccugccacuggcccaagagccauacccuguggucuaauggggugcuggagagcgaaaugaucauuccgaaauccuucgccggaccuguuagccagcacaacuaccgccccggcuauuacacgcaaacagccgggcccuggcaucuuggaaagcucgagauggacuuugauuucugugaaggcaccaccguggucgugacagaggacugcgggaaccggggaccuucucugagaaccacgacagcuuccggcaaacugaucaccgaauggugcugucggagcugcacacucccgccccugcgcuacagaggcgaggauggguguugguauggaauggagauucggccucuuaaggaaaaggaggaaaaucuggugaacucccucgucaccgcgggccacgggcagaucgacaauuuuucucugggaguucugggcauggcccuuuuccucgaggaaaugcugagaacacgcguggggaccaaacaugcuauccugcucguggccgucagcuuugugacgcugauuaccggaaacauguccuuccgggaucuuggcagaguuauggugauggucggcgccgcuaugacagacgauaucgggauuggagugaccuaccuggcccuccuggcggcuuuuaagguucgccccacauucgccgccggccugcuucugagaaaacucaccucuaaggagcugaugauggcuacgaucgggauugcccuccugagccaguccacaaucccugagaccauccuugaacugacagacgcgcucgcucugggaaugauggugcugaaaauuguccggaauauggagaaguaucaacuugccgugaccaucauggccauuucuugcguucccaacgcugugauccugcagaaugccuggaaggucagcuguaccauucucgcuacaguguccgugagcccucugcuccugacgucuucccagcagaaagccgacuggaucccccuugcgcugaccaucaagggccucaacccgacagccauuuuucugaccacacugagccgcaccucuaaaaagagauccuggccucuuaaugaagcuaucauggccgucgggaugguuagcauucuggcuucuucccuccugaaaaacgauauccccaugacgggaccucucguggccggcggccugcuuacagugugcuacguccugaccgggcggagcgccgaccuggagcucgaacgcgcuaccgaugugaagugggaggaccaagcggagauuuccggaagcucucccauccugagcauuacaaucgccgaagauggcuccaugucuaucaaaaaugaggaagaggagcagacccuuacaauucugaucagaacggggcuccugguuauuagcggacucuucccgguguccaucccuauuaccgcugccgccugguaucugugggaagucaagaagcagcgggcuggcgugcuuugggacguucccucuccuccgcccguggggaaagccgagcuggaagauggagcguaccgcaucaagcagaaaggcauccugggcuauagccaaauuggggcuggagucuacaaggagggcacauuucacaccauguggcacgugacaagaggggccguccucaugcaucggggaaaacgcaucgaaccuuccugggccgacgugaagaaggaucugauuucuuacggcgggggauggaaacuugagggcgaguggaaggaaggcgaggaaguucaggugcuggcucucgagccggggaaaaaccccagagccguccagaccaagccuggacuguucaaaacgaauaccggcacaaucggggcggugagccucgacuuuucccccggaaccagcggcucuccuauuguugaucggaaggggaagguggucggacuguauggcaacggcguggugacaagauccggggcuuacguuagcgccaucgcccagaccgaaaaaucuaucgaggacaaucccgagauugaagaugacaucuuccgcaagaaacggcuuacaauuauggaccugcacccuggagcuggcaagacgaaaagauaucugccggccaucguccgcgaggcuauuaagcgggggcucagaacccugauccuugcccccacacgcgugguggcggccgaaauggaggaagcucugcggggacucccuauuagauaccaaacccccgccauccgcgcugagcauaccggccgggagaucgucgaucugaugugucacgccacauucacgaugagacuccuguccccugugcggguucccaacuauaaccuuauuaucauggacgaagcccauuuuaccgauccggcuagcauugcggcccgcggguacaucuccacaagaguggagaugggcgaagcugccggaauuuucaugaccgccacaccucccggcucuaaggaccccuuuccucagagcaaugcucccaucauggaugaggagcgggaaaucccugagcgcuccuggaacagcgggcacgaaugggucaccgacuucaaaggaaagacggugugguuuguuccgucuauuaaagccggcaaugauaucgcggcuugccugagaaagaacgggaaaaaggugauucagcugucccggaagacauucgacagcgaguaugucaaaaccagaaccaaugauugggacuuugugguuacaaccgauaucucugaaaugggagccaacuucaaggccgagcgcgugauugacccccggagauguaugaaaccugucauccucacagacggcgaggaacgcgugauccuggcugggcccaugccugugacccacagcuccgccgcgcaacggagaggccgcauuggacggaaucccaagaacgagaaugaucaguacaucuacaugggcgaaccgcuugagaacgacgaagauugcgcccauuggaaagaggcuaagaugcugcucgacaauauuaacacgccugaggggaucauucccucuauguuugaaccugagagagaaaaagucgaugccaucgacggagaguaucgccugagaggcgaagcucggaagacauucguugaucugaugcgcagaggggaccuccccguguggcuugccuaccggguggcugccgagggaauuaauuaugcggaucgcagaugguguuuugacggcgucaagaacaaucagauccuggaggaaaacguggagguugaaaucuggaccaaagagggggagcggaagaaacugaagccuagauggcucgaugcccgcauuuacagcgacccccuggcucuuaaagaguucaaggaguucgccgcuggccggaagucccugacacucaaccugaucaccgaaaugggaagacugccgacguuuaugacccagaaagcccgcgaugcccucgacaaucuugcugugcugcacacagcggaggccggcgggcgggcuuauaaccaugcccugucugaacucccugagacccuggagacacuucugcuccugacccugcucgccacagucaccggaggcauuuuccuuuuucugaugagcgggaagggagugggcaaaaugacgcugggcaugugcugcaucauuacagcuuccauccuccuguggcacgcccaaauccagccccacuggauugcggccagcaucauucuugaguucuuucugaucguucuccugauucccgagccugaaaagcagagaaccccgcaggacaaucaacugaccuacguggucaucgcuauccucacaguggucgccgcuaccauggccaacgagaugggguuccuugagaagaccaagaaggaucugggacugggcucuauugcgacgcaggagcccgaguccaauauccucgacauugaucugcggccugccagcgcuuggacccuuuaugccguggcuacaaccuuuguuacacccaugcugcgccauuccaucgaaaacucuagcgugaaugugucccucaccgccauugcuaaccaggccacgguccugauggggcugggaaaaggcuggccucucucuaagauggacaucgggguuccccuucuggcgauuggauguuacagccaggugaauccuaucacccugacagccgcucuccugcuucugguggcccacuacgcuaucauuggcccgggccuccaagccaaagccaccagagaggcgcagaagcgggcugccgcugggaucaugaaaaaccccacagucgauggaauuaccgugaucgaccuggauccuauucccuaugacccuaaguucgaaaagcagcugggccagguuaugcuccuuauccugugcgugacgcaaguccugaugaugcgcacaaccugggcccucugugaggcccugacacuugcuaccgggcccaucuccacccugugggaaggaaauccgggcagauuuuggaacacaacgauugccgugagcauggcgaauaucuuccgggggucuuaccucgccggagcuggccugcuguuuuccauuaugaaaaacaccacaaauacccgcagaggcacagggaacaucggagagacccucggcgagaaguggaaaagccggcuuaaugcccuggggaagucugaguuccagauuuauaaaaaguccggaauccaggaggucgaucgcacgcuggcuaaagaaggcaucaagagaggggagacagaccaucacgccgugagccggggaucugcgaagcucagaugguuuguugagcgcaacauggugaccccugaaggcaaagucguggaucugggcugcgggcggggaggcuggagcuacuauugugggggacuuaagaacguuagagaggugaaaggccugaccaaagggggacccggccaugaagaacccauuccuauguccacauacggcuggaaucucguccgccugcaaucugggguggacguguucuucacacccccugaaaaaugcgauacccugcucugugacaucggagagagcuccccgaaccccacgauugaggccggccggacccuuagaguucugagccuggucgaaaauuggcucaacaaugacacacaguuuugcaucaaggugcugaacccuuauaugcccuccgugauugagaagauggaaacccuucagcgcaaauacgggggagcucugguccggaauccucucucuagaaacagcacacacgagauguacuggguuuccaaugccaccggcaacaucgugucuagcgugaauaugaucucccgcaugcugauuaaccgguucacgaugaagcacaaaaaggcuaccuaugaacccgaugucgaccuggggucuggaacaagaaauaucggcauugagagcgagaucccgaaccucgauauuaucggcaaacgcauugaaaagaucaagcaggagcaugaaaccuccuggcacuacgaccaagaucauccuuauaaaacaugggccuaccacgggagcuaugagaccaagcagacaggaucugcuuccagcauggugaauggcguugugcggcuucugaccaaacccugggacgucgugccuaugguuacgcagauggccaugacagauaccacccccuuugggcagcaaagaguguucaaggaaaaagucgacacacgcacgcaggagccuaaggagggaaccaagaaacugaugaagaucacagcggaauggcucuggaaagagcugggcaagaaaaagacccccagaauguguacacgggaagaguuuacccgcaaagugagaucuaacgccgcucuuggggccauuuucacagaugagaacaaguggaaguccgcucgggaagccguggaggacagcagauuuugggaacuggucgauaaagagcggaaucuccaccuggaaggaaagugcgagaccuguguuuacaacaugaugggcaaacgcgagaagaaacugggcgaguucgggaaggccaagggaucuagagcgaucugguauauguggcucggcgcucgguuucuggaguucgaagcccuuggguuucugaaugaggaccauugguucucccgcgaaaacagccucuccggaguggagggcgaggggcugcacaaacuuggcuacauucugagagacgugagcaagaaagaaggaggcgccauguacgcugaugacacggccgggugggauacccggaucacacucgaggaccugaagaaugaagagauggucaccaaccauauggaaggagagcacaaaaagcuggcugaggccauuuuuaagcucacauaucagaauaaagugguucgcgugcagagaccgaccccucggggcacggucauggauaucaucucucgcagagaccaacgggggagcggacaggugggcacauacgggcugaacaccuucacaaauauggaagcgcagcuuauucgccaaauggagggcgaaggaaucuucaaguccauucagcaucugaccgccacggaggagaucgcuguucagaacuggcucgccagagugggccgggaacgccugucuagaauggcuauuagcggggaugacugcgucgugaaaccccuugaugaccgguuugccuccgcgcugaccgcccucaaugauaugggaaagguuagaaaagacauccagcaaugggagcccucucgcggcuggaacgauuggacacaggugccuuucugcagccaccacuuucaugaacugaucaugaaggacgggcggguccugguggucccguguagaaaucaggacgagcucauuggacgcgcucggaucucccagggcgccggguggucucugaaggaaaccgcuugccuuggcaaaagcuaugcccaaauguggucccugauguacuuccacagacgcgaucuccggcuggcugccaacgcgauuuguagcgccgugcccucucauuggguuccuacauccagaaccacauggagcauccacgcuaagcacgaguggaugaccacggaggacaugcuuacaguguggaaucgcgucuggauucaggaaaaccccuggauggaggauaaaaccccuguggaaucuugggaggaagugcccuaucugggaaagcgggaggaccaguggugcggcucccucaucgggcugaccagcagagccacaugggccaaaaacauucagaccgcuaucaaucaaguucgcucccugaucggaaacgaggaauacacagauuauaugccuucuaugaagcgguuuagacgggaggaagaggaagccggcgugcucugguga

SEQ ID NO: 20172 - RNA, 9876 nt, Artificial Sequence
  derived and/or modified CDS sequence (opt5) from DENV-2__JX286524__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaagagcuucgccggaccggugucucagcacaacuaccgcccuggcuaucauacccaaacagcugggcccuggcaccuuggaaagcucgaaauggauuuugacuucugugagggcaccacggucguggugacagaagauugcgggaaccggggacccucccugagaaccacaaccgccagcggcaaacugauuacagaguggugcugucgguccugcacccucccuccgcugcgcuacagaggcgaggacggguguugguacggaauggaaauccggccccuuaaggagaaggaagagaaucuggucaacucucucguuacggccggccaugggcagauugauaauuuuagccugggagugcugggcauggcucuuuuccucgaagagaugcugagaacccgcguggggacaaaacacgcgauccugcucgucgcccuguccuuugugacccuuaucacaggaaacaugucuuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaagcaaggagcucaugauggcuaccaucgggauugcccugcuuucccagucuacccugcccgaaacaauccucgagcugacggaugcccuggcucuuggaaugauggcccugaaaauugugcggaauauggaaaaguaccaacucgcggucaccaucauggcuaucagcugcgugccuaacgccguuauucugcagaaugccuggaagguguccuguacaauccucgcugccgucagcgugucuccccugcuucugaccuccagccagcagaaagcugacuggauuccucucgcccugacaaucaagggccugaaccccaccgcgauuuuucuuacgacacugucucgcaccuccaaaaagagaagcuggccgcucaaugaggccaucauggcuguggggauggucucuauccuggccuccagccuccugaaaaacgacauuccuaugaccggaccccuuguugcuggcggccugcugacagugugcuaugugcucaccgggcgguccgccgaucuggaacuugagcgcgccgcugacgucaagugggaggaucaagcggaaaucagcggaucuagcccuauucuguccaucacaauuucugaggacggcagcauguccaucaaaaaugaagaggaggaacagacgcucaccauucugaucagaacagggcuccuggugaucucuggaguuuuccccgugagcauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacagccaaauuggggcgggagucuauaaagaaggcacauuucacaccauguggcaugugacgagaggggcuguccugaugcaccgcggaaagagaaucgagcccagcugggccgaugugaaaaaggaccuuaucuccuacggcgggggauggaagcuggagggcgaauggaaagagggcgaagagguucaggugcucgcccuggaaccugggaagaacccgcgggcuguccagaccaaacccggaauuuucaagacaaauaccggcacaaucggggccgugagccucgauuuuucuccuggaaccuccggcagccccauuguugacagaaaagggaagguggucggacuguacggcaacggcguggugacacgcucuggggcguauguuuccgcuaucgcccagacggaaaaguccauugaggauaauccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugucccccgugcgcguuccuaacuacaaccuuaucaucauggaugaggcccacuuuaccgaccccgccucuauugcugcgagaggguauaucagcacacggguggaaaugggcgaggccgcuggaauuuucaugaccgccacgccgccuggcucccgcgaucccuuuccccagagcaaugccccuaucauggacgaggaaagagagauucccgaacggucuuggaacuccgggcacgagugggucacagauuucaagggaaagaccgugugguuuguuccuagcaucaaagcuggcaaugacaucgccgcgugccugagaaagaacgggaaaaaggugauucagcugucucgcaaaaccuucgauagcgaauacgucaagacacgggcuaaugacugggauuuugugguuaccacagacaucuccgagaugggagccaacuucaaggccgagagagugauugauccgcgccgguguaugaaacccgucauccucaccgacggcgaagagagagugauucuggcugggccuaugcccgugacgcauucuagcgccgcgcaacgccggggcagaaucggacgcaauccuaagaacgaaaaugaccaguauaucuacaugggcgagccccuugaaaacgaugaggacugcgcccacuggaaagaggcuaagaugcugcucgauaauauuaacacaccggaagggaucauuccuuccauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaauuacgcggacagaaagugguguuuugauggcaucaagaacaaucagauucuggaagagaacgucgaaguggagaucuggacaaaagagggggaacggaagaaacugaagcccagauggcucgacgcccgcaucuauucugauccucuggcucuuaaagaguucaaggaguucgccgcuggcagaaagagccugacccucaaccugauuacggagaugggaagacugcccaccuuuaugacacagaaagcccgcaaugcccucgacaaccuugcuguucugcauaccgcggaagugggcgggaaggccuacacacacgcucuguccgagcucccggagacccuggaaacacuucugcuccugacccugcucgccgccgucacgggaggcaucuuccuuuuucugaugagcgggaaaggaauuggcaagaugacacugggcaugugcugcaucauuaccgcuucuauccuccugugguaugcccaaauccagccucacuggauugcggccuccaucauucuugaguucuuucugaucgugcuccugauucccgaacccgagaaacagcggaccccucaggauaaucaacugacauacguugugaucgcuauccucaccgucguggccgcuacaauggccaacgaaaugggguuccuugagaagacgaagaaagaccugggauuuggcagcauuaccacacaggaguccgaaucuaauauccuggacauugaucucagaccggcgagcgccuggacccuguaugcugucgccacaaccuucgugacgcccaugcuucggcauuccaucgagaacucuagcguuaaugugucccugaccgcuauugccaaccaggcuacagugcucauggggcugggaaagggcuggccucugagcaaaauggacaucggggucccccuccuugccauuggauguuacucucagguuaauccuaucacccugacagcggcccugcuccugcuuguggcucacuacgccaucauuggccccggccugcaagcuaaggccacccgcgaagcccagaaaagagcggcugccgggaucaugaagaacccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucuccacgcuuugggagggaaauccuggccgcuucuggaacaccacaauugcugucagcauggccaauaucuuuagagggucuuaccuggcgggagccggccuccuguucuccauuaugaagaacaccacaaauacccggcgcggcacggggaacgugggagaaacacugggcgagaaauggaaaagcagacucaaugcucuugggaaaucugaauuucagaucuauaagaaaagcggcauucaggaggucgaccggacccuggccaaggagggcaucaagcgcggggaaaccgaucaucacgcuguguccagaggaucugccaaacugcggugguucguugagagaaacauggugacacccgaaggcaaggucguggaccucggcugcgggcgcggaggcuggagcuacuauugugggggacugaaaaacguucgggaggugaagggccuuaccaaagggggaccgggccaugaggaaccuauccccauguccacauacggcuggaaucuggucagacuccaaagcgggguggauguguucuuuacgcccccugagaagugcgacacccugcugugugauauuggagaauccucucccaacccuacaaucgaggcgggccgcacccuccggguucuuaaucuggucgaaaacuggcugaauaacaauacacaguucugcauuaaggugcucaacccguauaugcccagcgugaucgagaaaauggaaacccugcagagaaaguacgggggagcccuuguccgcaauccucugucccggaacucuacgcacgagauguacuggguuagcaaugcuaccggcaacauuguguccucugugaauaugaucagcagaaugcucaucaaccgcuuuacaaugaaacacaagaaagccaccuaugagcccgacgucgaucugggguccggaacacggaauauuggcaucgaaagcgagauuccuaaccuggacaucauuggcaagagaaucgaaaagauuaaacaggagcaugaaaccucuuggcacuacgaccaagaucaucccuauaagacaugggcuuaccacggguccuaugagaccaaacagacgggaagcgccucuuccauggugaacggcguugugcgccuccuuacaaagccgugggacgucgugccuaugguuacccagauggcuaugaccgauacaacgcccuucgggcagcaacggguguuuaaagagaaggucgacaccagaacacaggaaccuaaggagggaaccaaaaagcugaugaaaaucacagccgaauggcuguggaaggagcucggcaaagagaagacaccccgcauguguacaagagaagaguucacccggaaagugcgcagcaaugcggcccugggggcuguguuuacggaugaaaacaaguggaagucugccagagaggcugucgaagacggacgguucugggagcuuguugauagagagcggaaucugcaccucgaaggcaaaugcgagaccuguguguacaacaugaugggcaagcgcgagaagaagcugggggaguuuggaaaagccaagggcuccagagccaucugguauauguggcugggggcgcgguuccucgaauuugaggcucugggauuccuuaaugaggaccauugguuuagccgcggcaacucccugagcgggguggaaggcgagggacuccacagacugggcuacauucuucgggaagucgggaagaaagagggaggcgccauguacgccgaugacacagcugggugggauacccgcaucacacuggaagaccucaagaaugaggagauggugaccaaccauaugaaaggagaacacaagaaacuggccgaggcuauuuucaagcugacguaucagaauaagguugugagaguccagcggccuacaccccgcggcaccgugauggacaucauuucuagaaaagaucaacgggggagcggccagguuggaacauacggccucaacaccuucacgaauauggaagcccagcugauccgccaaauggagggggagggaaucuuuaaguccauucagcaucuuaccgcgacagaagagaucgccgugcagaacuggcuggcuagagucggccgggaacgccucucuagaauggccauuagcggggacgauugcgugguuaaaccgaucgacgaucgguucgcuuccgcccugaccgcgcuuaaugacaugggaaaggugagaaaagauauucagcaaugggagccuucucgcggcuggaacgacuggacacagguccccuuuugcagccaccacuuccaugaacuggugaugaaggaugggcggguccucgugguucccuguagaaaucaggacgagcugaucggccgcgcccggaucucccagggagcuggcuggucucugaaggagaccgccugccucgggaaaagcuaugcucaaauguggacacugauguacuuucacagacgcgaucuucggcuggccgcuaacgccauuuguuccgcggugccuagccauugggucccgaccucuagaacgacaugguccauccacgccaagcacgaauggaugaccaccgaggacaugcucgcuguguggaaccgcguguggauucaggaaaaucccuggauggaggauaaaacaccuguugaaagcugggaggaggugcccuaucugggaaagcgggaagaccaguggugcggcucucuuaucgggcugaccuccagagccacaugggccaaaaacauucagacggcuaucaaucaaguccgcagccucauuggaaacgagggcuacaccgacuauaugccuuccaugaagcgguucagacgggaagaggaagaggccggggugcugugguga

SEQ ID NO: 20173 - RNA, 9876 nt, Artificial Sequence
  derived and/or modified CDS sequence (opt5) from DENV-2__JX286520__SS-prME
acagccggcgugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaaucgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucgucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggauguaucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgcccugagcuuugugacacuuauuaccggaaauauguccuuccgggaccugggcagaguuauggugauggucggcgcuacaaugaccgaugacaucgggaugggagugacguaucucgcccugcuggccgcuuuuaagguucgcccuacauucgccgcgggccuucugcucagaaaacugaccucuaaggagcucaugauggcuacaauugggaucgcccugcuuagccaguccacccugcccgaaaccauucucgagcugacagaugcccuggcucuuggaaugauggcccugaaaaucgugcggaacauggaaaaguaccaacucgcggucacgaucauggcuauuucuugcgugccuaaugccguuauccugcagaacgccuggaaggugagcuguaccauucucgcugccgucuccgugagcccccugcuucugacaucuucccagcagaaagcugacuggaucccucucgcccugaccauuaagggccugaaucccacagcgaucuuucuuaccacgcugagccgcacaucuaaaaagagauccuggccgcucaacgaggccaucauggcuguggggauggucagcauucuggccucuucccuccugaaaaaugacaucccuaugaccggaccccuuguugcuggcggccugcugaccgugugcuaugugcucacagggcggagcgccgaucuggaacuugagcgcgccgcugacgucaagugggaggaucaagcggaaauuuccggaagcucuccuauccugagcauuaccaucuccgaggacggcucuaugagcauuaaaaacgaagaggaggaacagacacucacgauccugaucagaaccgggcuccuggugauuuccggaguuuuccccgugucuaucccgauuacagccgcugccugguaccuuugggaggucaagaagcagcgggccggcgugcugugggauguuccuucucccccucccguggggaaagcugaacuggaggacggagccuaucgcaucaagcagagaggcauucucggcuacucccaaaucggggcgggagucuauaaagaaggcaccuuucacacaauguggcaugugaccagaggggcuguccugaugcaccgcggaaagagaaucgagcccuccugggccgaugugaaaaaggaccuuauuagcuacggcgggggauggaagcuggagggcgaauggaaagagggcgaagagguucaggugcucgcccuggaaccugggaagaauccgcgggcuguccagacgaaacccggaaucuucaagaccaacacaggcaccauuggggccgugucccucgauuuuagcccuggaacaucuggcucccccaucguugacagaaaagggaagguggucggacuguacggcaauggcguggugacccgcagcggggcguauguuucugcuauugcccagacagagaaguccaucgaggauaacccugaaaucgaggacgauauuuuccggaaaaagagacuuacgaucauggaccugcaucccggagccggcaaaaccaagcgcuaccugccugcuauuguccgggaagccaucaaaagagggcuccgcacacugauucuugcuccgacccgggugguggccgcggagauggaagaggcccugagaggacuccccauccgcuaucaaaccccugcuauucgggccgagcacacaggcagagaaaucgucgaccugaugugucaugcuacguucaccaugcggcuccugagccccgugcgcguuccuaacuacaaucuuaucauuauggaugaggcccacuuuacagaccccgccuccaucgcugcgagaggguauauuucuacccggguggaaaugggcgaggccgcuggaaucuucaugacagccaccccgccuggcagccgcgaucccuuuccccaguccaacgccccuauuauggacgaggaaagagagauccccgaacggagcuggaacucugggcacgagugggucacggauuucaagggaaagacagugugguuuguuccuuccaucaaagcuggcaacgacauugccgcgugccugagaaagaaugggaaaaaggugauccagcugagccgcaaaaccuucgauucugaauacgucaagacccgggcuaacgacugggauuuugugguuacaaccgacauuagcgagaugggagccaauuucaaggccgagagagugaucgauccgcgccgguguaugaaacccgucauucucacagacggcgaagagagagugauccuggcugggccuaugcccgugacccauuccucugccgcgcaacgccggggcagaaucggacgcaacccuaagaaugaaaacgaccaguauauuuacaugggcgagccccuugaaaaugaugaggacugcgcccacuggaaagaggcuaagaugcugcucgauaacaucaauacgccggaagggauuaucccuagcauguuugagcccgaaagagagaaagucgacgccauugauggagaauaccggcugcgcggcgaggcuagaaagacauucguugaccugaugcggcgcggggaucucccuguguggcuugccuauaaaguggcugccgagggaaucaacuacgcggacagaaagugguguuuugauggcauuaagaauaaccagauccuggaagagaacgucgaaguggagaucuggaccaaagagggggaacggaagaaacugaagcccagauggcucgacgcccgcauuuauuccgauccucuggcucuuaaagaguucaaggaguucgccgcuggccggaagucucugacacucaaucugaucaccgagaugggaagacugcccacguuuaugacccagaaagcccgcaacgcccucgacaaucuugcuguucugcauacagcggaagugggcgggaaggccuacacccacgcucugagcgagcucccggagacacuggaaacccuucugcuccugacacugcucgccgccgucaccggaggcauuuuccuuuuucugauguccgggaaaggaaucggcaagaugacgcugggcaugugcugcauuaucacagcuagcauccuccugugguaugcccaaauucagccucacuggaucgcggccucuauuauccuugaguucuuucugauugugcuccugauccccgaacccgagaaacagcggaccccucaggauaaccaacugaccuacguugugaucgcuauucucacagucguggccgcuaccauggccaaugaaaugggguuccuugagaagacaaagaaagacuuuggauucggcuccaucacgacccaggagagcgaauccaacauucuggacaucgaucugagaccggcgucugccuggacacucuaugcugucgccaccacauuugugacccccaugcugcggcauagcauugaaaauagcucuguuaacgugagccuuacggcuaucgccaaucaggcuaccgugcugauggggcucggaaagggcuggccucuguccaaaauggacauuggggucccccugcucgccaucggauguuacagccagguuaacccuaucacacuuaccgcggcccugcugcuccugguggcucacuacgccauuaucggccccggccuucaagcuaaggccacacgcgaagcccagaaaagagcggcugccgggauuaugaagaauccuaccguggauggaaucacggucauugaccuggagccgauccccuaugauccuaaguucgaaaaacagcucggccaggugaugcugcugauccucugcguuacacaagugcuuaugaugcggaccacaugggcucugugugaggcccugacccucgccaccgggcccauuucuacacugugggagggaaacccuggccgcuuuuggaauacgaccaucgcugucuccauggccaacauuuucagagggagcuaccuugcgggagccggccugcucuuuucuaucaugaagaauacaaccaacacacggcgcggcaccgggaaugugggagaaacgcugggcgagaaauggaaguccagacugaacgcucucgggaaaagcgaguuccagauuuauaagaaaucuggaauccaggaggucgaccggacacuugccaaggagggcaucaagcgcggggaaaccgaucaucacgcugugagcagaggauccgccaaacugcggugguucguugagagaaacauggugacccccgaaggcaaggucguggaccugggcugcgggcgcggaggcuggucuuacuauugugggggacucaaaaauguucgggaggugaagggccugacaaaagggggaccgggccaugaagaaccuauucccaugagcaccuacggcuggaaccuugucagacugcaauccgggguggauguguuuuucacacccccugagaagugcgacacgcuccugugugauaucggagaaagcucccccaauccuaccauugaggcgggccgcacacugcggguucucaaccuugucgaaaauuggcugaacaauaacacccaguuuugcaucaaggugcugaauccguauaugcccucugugauugagaaaauggaaacacuccagagaaaguacgggggagcccugguccgcaacccucuuagcagaaauuccacccacgagauguacuggguuucuaacgcuacgggcaauaucgugagcuccgugaacaugaucucuagaaugcugauuaaucgcuucaccaugaaacacaagaaagccacauaugagcccgacgucgaucucgggagcggaacccggaacaucggcauugaauccgagaucccuaaccuggacauuaucggcaagagaauugaaaagaucaaacaggagcaugaaacaagcuggcacuacgaccaagaucaucccuauaagaccugggcuuaccacgggucuuaugagacaaaacagaccggauccgccagcucuauggugaauggcguugugcgccugcucacgaagccgugggacgucgugccuaugguuacacagauggcuaugaccgauaccacacccuuugggcagcaacggguguucaaagagaaggucgacacgagaacccaggaaccuaaggagggaaccaagaaacuuaugaaaaucaccgccgaauggcuguggaaggagcugggcaaagagaagacaccccgcauguguaccagagaagaguuuacacggaaagugcgcuccaacgcggcccucggggcuguguucaccgaugaaaauaaguggaaaagcgccagagaggcugucgaagacggacgguuuugggagcugguugauagagagcggaaccuucaccuggaaggcaaaugcgagacguguguguacaauaugaugggcaagcgcgagaagaagcucggggaguucggaaaagccaagggcucuagagccauuugguauauguggcugggggcgcgguuucuggaguucgaggcucucggauuucugaacgaggaccauugguucucccgcggcaauagccuuuccgggguggaaggcgagggacugcacagacucggcuacauccugcgggaagucgggaagaaagagggaggcgccauguacgccgaugacaccgcugggugggauacacgcauuacccuugaagaccugaagaacgaggagauggugacaaaucauaugaaaggagaacacaagaaacucgccgaggcuaucuucaagcugaccuaucagaacaagguugugagaguccagcggccuacgccccgcggcacagugauggacauuaucagcagaaaagaucaacgggggucuggccagguuggaaccuacggccugaauacauuuaccaacauggaagcccagcucauccgccaaauggagggggagggaauuuucaagagcauccagcaucugacggcgaccgaagagauugccgugcagaauuggcuugcuagagucggccgggaacgccuguccagaauggccaucucuggggacgauugcgugguuaaaccgauugacgaucgguuugcuagcgcccucacagcgcugaacgacaugggaaaggugagaaaagauauccagcaaugggagccuucccgcggcuggaaugacuggacccagguccccuucugcucucaccacuuucaugaacuugugaugaaggaugggcggguccuggugguucccuguagaaaccaggacgagcucaucggccgcgcccggauuagccagggagcuggcuggucccugaaggagacagccugccuggggaaaucuuaugcucaaauguggacccucauguacuuccacagacgcgaucugcggcuugccgcuaacgccaucuguagcgcggugccuucccauugggucccgacaagcagaaccacguggucuauucacgccaagcacgaauggaugacaaccgaggacaugcuggcuguguggaaucgcguguggauccaggaaaaccccuggauggaggauaaaaccccuguugaauccugggaggaggugcccuaucucggaaagcgggaagaccaguggugcggcagccugauugggcuuacaucuagagccaccugggccaaaaauauccagacagcuauuaaccaaguccgcucccugaucggaaaugagggcuacacggacuauaugccuagcaugaagcgguuuagacgggaagaggaagaggccggggugcucugguga

SEQ ID NO: 20174 - RNA, 9876 nt, Artificial Sequence
  derived and/or modified CDS sequence (opt5) from DENV-2__JX286525__SS-prME
accgccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaagagcuucgccggaccggugucucagcacaacuaccgcccuggcuaucauacccaaacagcugggcccuggcaccuuggaaagcucgaaauggauuuugacuucugugagggcaccacggucguggugacagaagauugcgggaaccggggacccucccugagaaccacaaccgccagcggcaaacugauuacagaguggugcugucgguccugcacccucccuccgcugcgcuacagaggcgaggacggguguugguacggaauggaaauccggccccuuaaggagaaggaagagaaucuggucaacucucucguuacggccggccaugggcagauugauaauuuuagccugggagugcugggcauggcucuuuuccucgaagagaugcugagaacccgcguggggacaaaacacgcgauccugcucgucgcccuguccuuugugacccuuaucacaggaaacaugucuuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaagcaaggagcucaugauggcuaccaucgggauugcccugcuuucccagucuacccugcccgaaacaauccucgagcugacggaugcccuggcucuuggaaugauggcccugaaaauugugcggaauauggaaaaguaccaacucgcggucaccaucauggcuaucagcugcgugccuaacgccguuauucugcagaaugccuggaagguguccuguacaauccucgcugccgucagcgugucuccccugcuucugaccuccagccagcagaaagcugacuggauuccucucgcccugacaaucaagggccugaaccccaccgcgauuuuucuuacgacacugucucgcaccuccaaaaagagaagcuggccgcucaaugaggccaucauggcuguggggauggucucuauccuggccuccagccuccugaaaaacgacauuccuaugaccggaccccuuguugcuggcggccugcugacagugugcuaugugcucaccgggcgguccgccgaucuggaacuugagcgcgccgcugacgucaagugggaggaucaagcggaaaucagcggaucuagcccuauucuguccaucacaauuucugaggacggcagcauguccaucaaaaaugaagaggaggaacagacgcucaccauucugaucagaacagggcuccuggugaucucuggaguuuuccccgugagcauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacagccaaauuggggcgggagucuauaaagaaggcacauuucacaccauguggcaugugacgagaggggcuguccugaugcaccgcggaaagagaaucgagcccagcugggccgaugugaaaaaggaccuuaucuccuacggcgggggauggaagcuggagggcgaauggaaagagggcgaagagguucaggugcucgcccuggaaccugggaagaacccgcgggcuguccagaccaaacccggaauuuucaagacaaauaccggcacaaucggggccgugagccucgauuuuucuccuggaaccuccggcagccccauuguugacagaaaagggaagguggucggacuguacggcaacggcguggugacacgcucuggggcguauguuuccgcuaucgcccagacggaaaaguccauugaggauaauccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugucccccauccgcgugccuaacuacaaccuuaucauuauggaugaggcccacuuuaccgaccccgccucuaucgcugcgagaggguauauuagcacacggguugaaaugggcgaggccgcuggaaucuucaugaccgccacgccgccuggcucccgcgaucccuuuccccagagcaaugccccuauuauggacgaggaaagagagauccccgaacggucuuggaacuccgggcacgagugggugacagauuucaagggaaagaccgucugguuugugccuagcaucaaagcuggcaaugacauugccgcgugccugagaaagaacgggaaaaagguuauccagcugucucgcaaaaccuucgauagcgaauacgugaagacacgggcuaaugacugggauuuugucgugaccacagacauuuccgagaugggagccaacuucaaggccgagagaguuaucgauccgcgccgguguaugaaacccgugauucucaccgacggcgaagagagagucauccuggcugggccuaugcccgugacgcauucuagcgccgcgcaacgccggggcagaaucggacgcaauccuaagaacgaaaaugaccaguauauuuacaugggcgagccccuugaaaacgaugaggacugcgcccacuggaaagaggcuaagaugcugcucgauaauaucaacacaccggaagggauuaucccuuccauguuugagcccgaaagagagaaaguggacgccauugauggagaauaccggcugcgcggcgaggcuagaaagaccuucgucgaccugaugcggcgcggggaucucccuguuuggcuugccuauaaaguggcugccgagggaaucaauuacgcggacagaaagugguguuuugauggcauuaagaacaaucagauccuggaagagaacguggaagucgagaucuggacaaaagagggggaacggaagaaacugaagcccagauggcucgacgcccgcauuuauucugauccucuggcucuuaaagaguucaaggaguucgccgcuggcagaaagagccugacccucaaccugaucacggagaugggaagacugcccaccuuuaugacacagaaagcccgcaaugcccucgacaaccuugcugugcugcauaccgcggaaguuggcgggaaggccuacacacacgcucuguccgagcucccggagacccuggaaacacuucugcuccugacccugcucgccgccgugacgggaggcauuuuccuuuuucugaugagcgggaaaggaaucggcaagaugacacugggcaugugcugcauuaucaccgcuucuauccuccugugguaugcccaaauucagccucacuggaucgcggccuccauuauccuugaguucuuucugauuguccuccugauccccgaacccgagaaacagcggaccccucaggauaaucaacugacauacgugguuaucgcuauucucaccguggucgccgcuacaauggccaacgaaaugggguuccuugagaagacgaagaaagaccugggauuuggcagcaucaccacacaggaguccgaaucuaauauucuggacaucgaucucagaccggcgagcgccuggacccuguaugcuguggccacaaccuucgucacgcccaugcuucggcauuccauugagaacucuagcgugaauguuucccugaccgcuaucgccaaccaggcuacagugcucauggggcugggaaagggcuggccucugagcaaaauggacauuggggugccccuccuugccaucggauguuacucucaggucaauccuaucacccugacagcggcccugcuccugcuuguugcucacuacgccauuaucggccccggccugcaagcuaaggccacccgcgaagcccagaaaagagcggcugccgggauuaugaagaacccuacgguggauggaaucacagugauugaccucgagccgauccccuaugauccuaaguuugaaaaacagcugggccaggucaugcugcucauccuuugcgugacccaaguucugaugaugcggacaaccugggcucugugugaggcccucacccuggccacagggcccauuuccacgcuuugggagggaaauccuggccgcuucuggaacaccacaaucgcugugagcauggccaauauuuuuagagggucuuaccuggcgggagccggccuccuguucuccaucaugaagaacaccacaaauacccggcgcggcacggggaacgucggagaaacacugggcgagaaauggaaaagcagacucaaugcucuugggaaaucugaauuucagauuuauaagaaaagcggaauccaggagguggaccggacccuggccaaggagggcaucaagcgcggggaaaccgaucaucacgcugucuccagaggaucugccaaacugcggugguucguggagagaaacaugguuacacccgaaggcaagguggucgaccucggcugcgggcgcggaggcuggagcuacuauugugggggacugaaaaacgugcgggagguuaagggccuuaccaaagggggaccgggccaugaggaaccuauucccauguccacauacggcuggaaucuggugagacuccaaagcggggucgauguguucuuuacgcccccugagaagugcgacacccugcugugugauaucggagaauccucucccaacccuacaauugaggcgggccgcacccuccgggugcuuaaucugguugaaaacuggcugaauaacaauacacaguucugcaucaagguccucaacccguauaugcccagcgugauugagaaaauggaaacccugcagagaaaguacgggggagcccuugugcgcaauccucugucccggaacucuacgcacgagauguacugggucagcaaugcuaccggcaacaucguuuccucugugaauaugaucagcagaaugcucauuaaccgcuuuacaaugaaacacaagaaagccaccuaugagcccgacguggaucugggguccggaacacggaauaucggcauugaaagcgagaucccuaaccuggacauuaucggcaagagaauugaaaagaucaaacaggagcaugaaaccucuuggcacuacgaccaagaucaucccuauaagacaugggcuuaccacggguccuaugagaccaaacagacgggaagcgccucuuccauggucaacggcgugguucgccuccuuacaaagccgugggacguggucccuauggugacccagauggcuaugaccgauacaacgcccuucgggcagcaacggguuuuuaaagagaagguggacaccagaacacaggaaccuaaggagggaaccaaaaagcugaugaaaaucacagccgaauggcuguggaaggagcucggcaaagagaagacaccccgcauguguacaagagaagaguucacccggaaaguccgcagcaaugcggcccugggggcuguguuuacggaugaaaacaaguggaagucugccagagaggcuguggaagacggacgguucugggagcuugucgauagagagcggaaucugcaccucgaaggcaaaugcgagaccuguguuuacaacaugaugggcaagcgcgagaagaagcugggggaguuuggaaaagccaagggcuccagagccauuugguauauguggcugggggcgcgguuccucgaauuugaggcucugggauuccuuaaugaggaccauugguuuagccgcggcaacucccugagcgggguggaaggcgagggacuccacagacugggcuacauccuucgggaaguggggaagaaagagggaggcgccauguacgccgaugacacagcugggugggauacccgcauuacacuggaagaccucaagaaugaggagauggucaccaaccauaugaaaggagaacacaagaaacuggccgaggcuaucuucaagcugacguaucagaauaaggugguuagagugcagcggccuacaccccgcggcaccgucauggacauuaucucuagaaaagaucaacgggggagcggccaggugggaacauacggccucaacaccuucacgaauauggaagcccagcugauccgccaaauggagggggagggaauuuuuaaguccauccagcaucuuaccgcgacagaagagauugccguucagaacuggcuggcuagagugggccgggaacgccucucuagaauggccaucagcggggacgauugcgucgugaaaccgauugacgaucgguucgcuuccgcccugaccgcgcuuaaugacaugggaaagguuagaaaagauauccagcaaugggagccuucucgcggcuggaacgacuggacacaggugcccuuuugcagccaccacuuccaugaacuggucaugaaggaugggcgggugcucgucgugcccuguagaaaucaggacgagcugaucggccgcgcccggauuucccagggagcuggcuggucucugaaggagaccgccugccucgggaaaagcuaugcucaaauguggacacugauguacuuucacagacgcgaucuucggcuggccgcuaacgccaucuguuccgcgguuccuagccauugggugccgaccucuagaacgacaugguccauucacgccaagcacgaauggaugaccaccgaggacaugcucgcugucuggaaccgcguguggauccaggaaaaucccuggauggaggauaaaacaccuguggaaagcugggaggagguucccuaucugggaaagcgggaagaccaguggugcggcucucuuauugggcugaccuccagagccacaugggccaaaaacauccagacggcuauuaaucaagugcgcagccucaucggaaacgagggcuacaccgacuauaugccuuccaugaagcgguucagacgggaagaggaagaggccgggguccugugguga

SEQ ID NO: 20175 - RNA, 9876 nt, Artificial Sequence
  derived and/or modified CDS sequence (opt5) from DENV-2__KM279598__SS-prME
accgccggcaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagacgugggacgcguuauggugauggucggcgccaccaugacagaugacauuggcaugggggugaccuaccuggcccuccuggcugccuuuaagaucagacccacguucgcggcuggacugcuucugcggaaacucacauccaaggagcugaugaugaccacaaucggcauugugcuccugucucaaagcaccaucccugaguccauucuugaacugaccgaugcccucgcccuggggaugaugguccugaaaaucguucgcaauauggagaaguaucagcuugcugugacaauuauggccauccugugcgugcccaacgcggucauccuccagaaugcuuggaaagugucuuguacgacccuggccguugugagcgucuccccucuccugcuuacaagcucucaacagaaggccgacuggauuccccuggcucucaccaucaagggacugaacccuacagccauuuuucugaccacgcuuuccagaacaagcaaaaagcggucuuggccccugaaugaagcuaucauggccgugggcaugguuuccauucucgcgagcucucugcucaaaaacgauaucccgaugaccgggccucugguggccggaggccuucugaccgucugcuacgugcugacaggccgcuccgcugaccucgagcuggaaagagccgcugacguccggugggaggagcaggccgaaaucagcggguccagccccauucuuucuaucaccauuagcgaggauggauccaugucuaucaagaaugaagaggaggaacagacacugacgauucucauccgcaccggccugcucgugauuagcgggcuguucccuguuuccauccccaucacagccgcugcgugguaucuuugggaggugaaaaagcaaagagccggaguccugugggacgugccgucuccucccccuguuggcaaagcugaacuggaggauggggccuaccggauuaagcagaagggaauccucggcuauagccagauuggcgccgggguguacaaagaaggaaccuuucacacaauguggcaugucacccgcggcgcugugcugaugcacaaggggaaaagaaucgagcccuccugggccgacgugaagaaagaucuuauuucuuacggaggcggguggaagcuggagggagaauggaaggagggcgaagagguucagguccucgcgcuggaacccggcaaaaacccucgggcugugcaaacgaagccgggacucuucaaaaccaacacaggaaccaucggcgccgugagccuggacuuuucccccgggacaagcggaucuccuaucgucgauaagaaaggcaaggugguugggcuuuauggaaauggcguggucaccagauccggcacauacgugagcgccauugcucagacggagaagucuaucgaggacaaccccgaaauugaggaugacaucuuccgcaaaaagcggcugaccauuauggaucugcauccuggggccggaaaaacaaagagauaucuccccgcgaucguucgcgaagcuaucaaacggggccugagaacccuuauucuggccccuacccgcguggucgccgcugagauggaagaggcccuccgggggcugccgaucagauaccagacacccgcuauucgcgccgagcacacgggacgggaaaucguggaccucaugugucaugcgaccuucacaaugagacugcuuuccccuauucggguucccaauuauaaccugaucauuauggaugaggcccacuuuaccgacccugcuagcaucgccgcucgcggcuacaucuccacaagaguggaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggucacagacuucaaggggaaaaccgugugguuugugcccucuaucaaggccggaaaugauauugcugccugccugcgcaaaaacggcaagaaagucauccaacucucccggaagaccuucgacagcgaauauaucaagacaagaaccaaugauugggacuuuguugugacaaccgauauuucugagaugggggccaacuucaaagcugagcgcgugaucgacccucggagauguaugaagccggucauucugacggauggagaggaacgcgugauccuugccggccccaugccuguuacacauagcuccgcggcucagcggagagggcgcgugggccggaaucccaaaaacgaaaaugaccaguacauuuacaugggagagccucuggaaaacgaugaggacugcgcccacuggaaggaggccaaaaugcuccuggacaauaucaacacccccgaaggcaucauuccgucuauguuugagccugaaagagagaaggucgaugcuaucgacggggaauaucgccugagaggagaggcccggaaaacauucguggaucucaugcgcagaggcgaccuucccguuuggcuggcguaccggguggccgcugaggggauuaacuaugccgaucgcagaugguguuuugacggagucaagaauaaccaaauccuggaagagaauguggaagucgagauuuggaccaaggagggcgaacggaaaaagcucaaaccuagauggcuggaugcucgcaucuacagcgacccccuugcccugaaggaguucaaagaguucgcugccgggcggaagucccucacgcugaaccugauuaccgagaugggcagacucccuacauuuaugacccagaaggcgaaaaaugcccuugauaaccuggcugugcugcauacagccgaagcuggaggccgcgccuauaaucacgcccucucugagcugcccgagacccuugaaacacugcuccugcugacccuccuugcuacgguuacagggggaaucuuccuguuucugaugagcggcaaggggaucggaaaaaugacccucggcaugugcugcauuaucaccgcguccauucugcuuugguacgcccagauccagccgcacuggauugcugccagcaucauccuggaguucuuucucauugugcugcugaucccugaacccgagaagcaacggacaccccaggacaaccagcucaccuauguggucauugccauccuuacaguuguggcugccacgauggcgaaugaaaugggcuuccuggagaaaaccaagaaggauuuugggcugggaucuauuacaacccagcaaccugaguccaacauccucgacaucgaucugagaccggccagcgcuuggacacuuuacgccguggcuaccacguucauuacccccaugcugcggcauuccaucgaaaauucuagcgucaacgugucccucacagccauugcgaaucaggccaccguucugaugggccuggggaaaggauggccucucucuaagauggacaucggcgugccccuucuggcuauuggguguuacagccaggucaacccuaucacacugaccgccgcucuccugcuucugguggcccacuaugcuauuaucggacccggccuccaggccaaagcgacgcgcgaggcccaaaagagagcugccgcuggcaucaugaaaaauccuacagucgacgggaugaccgugauugaucuggacccgauccccuacgauccuaaguuugaaaagcagcugggacagguuaugcuccuugugcugugcgucacacaggugcugaugaugcggaccaccugggcccucugugaggcccugacacuugcgacgggccccauuuccacccugugggaagggaacccuggacgcuucuggaauacaaccaucgcuguuagcauggccaacauuuuuagaggcucuuaucucgcuggggccggacugcuguucuccaucaugaaaaacacagccaauacccggcgcggcacgggcaacacaggggagacccucggagagaaguggaaaaauagacuuaacgcucugggcaagagcgaauuucaaaucuacaaaaagucugggauucaggagguggaccggacccuggccaaagaaggaaucaagcgcggcgagacagaucaucacgcggucuccagagggagcgccaagcuccggugguucguggagagaaaucuggugacccccgaaggaaaaguugucgaccuuggcugcggccgcgggggauggucuuauuacuguggcgggcugaagaacgugaaagaggugaagggacucacaaaaggcgggccgggacaugaagaaccuauucccaugagcacguauggcuggaaucugguccggcugcaguccggcguugauguguucuuuacacccccugaaaagugcgacacacuccuuugugauaucggggagucuagccccaacccuaccguggaggcuggaagaacacugcgcguccugaaucucguggaaaacuggcugaauaacaauacccaauucugcauuaagguucuuaacccguacaugcccuccgugaucgagaaaauggaagcccugcagcggaaguacggcggggcucucgucagaaauccucugagccgcaacuccacgcacgagauguauugggugucuaacgccagcggaaauaucguuuccucugugaacaugauuagccggaugcugaucaauagauuuaccaugcgccacaaaaaggcgacauacgaacccgacgucgaucucggcuccgggacccggaacauuggaaucgagucugagacaccuaaucuugacauuaucggcaaaagaaucgaaaagauuaagcaggagcaugaaaccagcuggcacuaugaucaggaccaucccuacaaaacaugggccuaucacggcuccuacgagaccaagcaaacggggagcgcuucuuccauggugaacggagugguccgccugcugacaaaaccgugggacguuaucccuauggugacccagauggccaugaccgauacaacgcccuucggccagcagcggguguuuaaggaaaaagucgacaccagaacacaagagccuaaggaggggaccaagaaacucaugaagauuacagcugaauggcuguggaaagagcuuggaaagaaaaagacccccagaauguguacaagagaagaguucacccggaaagugcgcagcaaugccgcucugggcgccaucuuuacggaugagaacaaguggaagucugcgagagaagccguugaggacuccggguucugggaacucguggauaaagagcggaaucugcaccuggaaggaaagugcgagaccugugucuauaacaugaugggcaaaagagagaagaaacucggcgaauuugggaaggcuaagggaagccgggccauuugguacauguggcugggcgcucgcuuccuugaguuugaagcccugggguuccucaaugaggaccauugguuuucuagagaaaacucccugagcggaguggagggcgaggggcuucacaaacugggcuacauccuccgggauguuuccaagaaagaaggaggcgccauguaugcggacgauacagcugggugggacacccgcauuacacuggaggaucugaagaaugaagagauggugaccaaccauauggaaggagagcacaaaaagcucgccgaggccaucuucaagcugacguaccagaauaaagucgugagaguucagcggccuacaccccgcggcaccgugauggacaucauuagcagacgggaccagcgcgggucuggacaagucgugacauauggccuuaacaccuucacgaacauggaagcucagcugaucagacagauggagggggaaggcgucuuuaagagcauucaacagcucaccgugaaagaggagaucgccguuaagaauuggcugauucgggugggacgcgaaagacuuucccggauggcuaucucuggcgaugacugcgucgugaaaccgcuggaugaccgcuucgccagcgcgcucacagcccugaacgauauggggaaggugagaaaggacauccagcagugggagccuucccggggauggaaugauuggacccaaguucccuuuugcucucaucacuuccacgaacugauuaugaaagacggcagagugcucgucgugcccugucgcaaccaggaugagcugaucgggcgggcuagaauuagccagggagccggcuggucccuucgcgaaacagcuugccuggggaagucuuacgcccagauguggagccucauguauuuucaucggagagaccugcgccuugcggccaaugcuaucuguuccgccguuccuagccacuggauuccgaccucucggacaaccugguccauccaugcuacgcacgaguggaugacaaccgaggauaugcugaccguguggaacagagucuggauccaagaaaaucccuggauggaggacaaaacaccuguggaaagcugggaggaaauucccuaccucggcaagcgcgaggaucaguggugcggaucucugaucggccugaccucccgggccacaugggcuaaaaacauucagacggccaucaaucaggucagaagccucauugggaacgaggaauauaccgacuacaugccuuccaugaagcgcuuccggagagaggaagaggaagcgggagugcugugguga

SEQ ID NO: 20176 - RNA, 9876 nt, Artificial Sequence
  derived and/or modified CDS sequence (opt5) from DENV-2__KM279576__SS-prME
accgccggcaucauuaucaugaugauucccaccgugauggcuuuccaccugacgaccagaaacggggagccucauaugaucgucagccggcaggaaaagggaaaaucccuccuguuuaagaccgagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaagaucagacccacguucgcggcuggacuucugcuccggaaacugacauccaaggagcucaugaugaccacaaucggcauugugcugcuuucucaaagcaccaucccugaguccauucuggaacucaccgaugcccuggcccuggggaugauggugcuuaaaaucguccgcaauauggagaaguaucagcuggcuguuacaauuauggccauccucugcgugcccaacgcggugauccugcagaaugcuuggaaagucucuuguacgacccucgccgugguuagcguguccccucugcuucugacaagcucucaacagaaggccgacuggauuccccucgcucugaccaucaagggacugaacccuacagccauuuuucuuaccacgcuguccagaacaagcaaaaagcggucuuggccccucaaugaagcuaucauggccgucggcaugguguccauucuggcgagcucucuccugaaaaacgauaucccgaugaccgggccucuuguugccggaggccugcugaccgugugcuacguccucacaggccgcuccgcugaccuggagcuugaaagagccgcugacgugcggugggaggagcaggccgaaaucagcggguccagccccauucugucuaucaccauuagcgaggauggauccaugucuaucaagaaugaagaggaggaacagacacucacgauucugauccgcaccggccuccuggucauuagcgggcuuuucccuguguccauccccaucacagccgcugcgugguaucugugggagguuaaaaagcaaagagccggagugcugugggacgucccgucuccucccccugugggcaaagcugaacucgaggauggggccuaccggauuaagcagaagggaauccugggcuauagccagauuggcgccgggguuuacaaagaaggaaccuuucacacaauguggcaugugacccgcggcgcuguccuuaugcacaaggggaaaagaaucgagcccuccugggccgacgugaagaaagaucugauuucuuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugagccuugacuuuucccccgggacaagcggaucuccuaucguggauaagaaaggcaaggucguggggcuguauggaaauggcguugugaccagauccggcacauacgucagcgccauugcucagacggagaagucuaucgaggacaaccccgaaauugaggaugacaucuuccgcaaaaagcggcugaccauuauggaucuccauccuggggccggaaaaacaaagagauaucugcccgcgaucgugcgcgaagcuaucaaacggggccuuagaacccugauucucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucuguccccuauucgggugcccaauuauaaccugaucauuauggaugaggcccacuuuaccgacccugcuagcaucgccgcucgcggcuacaucuccacaagaguugaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggugacagacuucaaggggaaaaccgucugguuugugcccucuaucaaggccggaaaugauauugcugccugccuccgcaagaacggcaagaaagugauccaacugucccggaagaccuucgacagcgaauauaucaagacaagaaccaaugauugggacuuugucguuacaaccgauauuucugagaugggggccaacuucaaagcugagcgcgugaucgacccucggagauguaugaagccggugauucuuacggauggagaggaacgcgucauccuggccggccccaugccugugacacauagcuccgcggcucagcggagagggcgcguuggccggaaucccaaaaacgaaaaugaccaguacauuuacaugggagagccucucgaaaacgaugaggacugcgcccacuggaaggaggccaaaaugcugcuggacaauaucaacacccccgaaggcaucauuccgucuauguuugagccugaaagagagaagguggaugcuaucgacggggaauaucgccucagaggagaggcccggaaaacauucgucgaucuuaugcgcagaggcgaccugcccguguggcuggcguaccggguugccgcugaggggauuaacuaugccgaucgcagaugguguuuugacggagugaagaauaaccaaauccucgaagagaaugucgaaguggagauuuggaccaaggagggcgaacggaaaaagcugaaaccuagauggcuugaugcucgcacguacagcgacccccuggcccucaaggaguucaaagaguucgcugccgggcggaagucccugacccugaaccucaucacagagaugggcagacuuccuaccuuuaugacacagaaggcgaaaaaugcccuggauaaccuggcuguccuccauaccgccgaagcuggaggccgcgccuauaaucacgcccugucugagcuucccgagacacuggaaacccuccugcugcucacgcuucuggcuacagugaccgggggaauuuuccuguuucucaugagcggcaaggggaucggaaaaaugacccugggcaugugcugcaucauuacagcguccauccuucugugguacgcccagauucagccgcacuggaucgcugccagcauuauccucgaguucuuucugaucguucugcucauuccugaacccgagaagcaacggacaccccaggacaaccagcuuacauauguggugaucgccauucugacggucguugcugccaccauggcgaaugaaaugggcuuccuggagaaaacaaagaaggauuuugggcucggaucuaucaccacacagcaaccugaguccaacauucuggacaucgaucuuagaccggccagcgcuuggacccuguacgccguggcuacgaccuucaucacacccaugcuccggcauuccauugaaaauucuagcgugaacgucucccugaccgccaucgcgaaucaggccacagugcugaugggccucgggaaaggauggccucuuucuaagauggacauuggcguuccccugcuggcuaucggguguuacagccaggugaacccuauuacccucacggccgcucugcuucugcucgucgcccacuaugcuaucauuggacccggccugcaggccaaagcgacacgcgaggcccaaaagagagcugccgcuggcaucaugaaaaauccuaccguggacgggaugacagucaucgaucuggacccgauucccuacgauccuaaguuugaaaagcagcucggacaggugaugcuucugguucugugcgugacccagguccucaugaugcggaccacaugggcccugugugaggcccuuacgcuggcgaccggccccaucuccacacucugggaagggaacccuggacgcuucuggaauaccacaauugcugugagcauggccaacaucuuuagaggcucuuaucuggcuggggccggacuccuguucuccauuaugaaaaacaccgccaauacgcggcgcggcacaggcaacaccggggagacccuuggagagaaguggaaaaauagacugaacgcucugggcaagagcgaauuucaaaucuacaaaaagucugggauccaggagguugaccggacacucgccaaagaaggaauuaagcgcggcgagaccgaucaucacgcgguguccagagggagcgccaagcugcggugguucgucgagagaaaucuugugacacccgaaggaaaagugguugaccugggcugcggccgcgggggauggucuuauuacuguggcgggcucaagaacgucaaagaggugaagggacugacgaaaggcgggccgggacaugaagaaccuauccccaugagcaccuauggcuggaaucuggugcggcuccaguccggcgucgauguuuucuuuacacccccugaaaagugcgacacccuucugugugauauuggggagucuagccccaacccuacaguggaggcuggaagaacccugcgcgugcucaaucuggucgaaaacuggcuuaauaacaauacgcaauucugcaucaaggugcugaacccguacaugcccuccguuauugagaaaauggaagcccuccagcggaaguacggcggggcucuggugagaaauccucugagccgcaacuccacccacgagauguauugggucucuaacgccagcggaaauaucguguccucuguuaacaugaucagccggaugcucauuaauagauuuacaaugcgccacaaaaaggcgaccuacgaacccgacguggaucuuggcuccgggacacggaacaucggaauugagucugagaccccuaaucuggacaucauuggcaaaagaaucgaaaagaucaagcaggagcaugaaacaagcuggcacuaugaucaggaccaucccuacaaaaccugggccuaucacggcuccuacgagacgaagcaaacagggagcgcuucuuccauggucaacggaguggugcgccugcucaccaaaccgugggacgucauuccuaugguuacccagauggccaugacagauacgacccccuucggccagcagcggguguuuaaggaaaaaguggacacaagaacccaagagccuaaggaggggacaaagaaacugaugaagaucaccgcugaauggcuuuggaaagagcugggaaagaaaaagacaccccgcauguguaccagagaagaguucacgcggaaaguccgcagcaaugccgcucucggcgccauuuuuaccgaugagaacaaguggaagucugcgagagaagccguggaggacuccggguucugggaacugguugauaaagagcggaaucugcaccucgaaggaaagugcgagacauguguguauaacaugaugggcaaaagagagaagaaacugggcgaauuugggaaggcuaagggaagccgggccaucugguacauguggcuuggcgcucgcuuccuggaguuugaagcccucggguuccugaaugaggaccauugguuuucuagagaaaacucccuuagcggagucgagggcgaggggcugcacaaacucggcuacauucugcgggauguguccaagaaagaaggaggcgccauguaugcggacgauaccgcugggugggacacacgcaucacccuggaggaucucaagaaugaagagaugguuacgaaccauauggaaggagagcacaaaaagcuggccgaggccauuuucaaacuuacauaccagaauaaaguggucagagugcagcggccuacccccagaggcacaguuauggacaucaucagcagacgggaccagcgcgggucuggacaaguggucaccuauggccugaacacguucaccaacauggaagcucagcucauuagacagauggagggggaaggcguguuuaagagcauccaacagcugacagucaaagaggagauugccgugaagaauuggcuuauccggguuggacgcgaaagacugucccggauggcuauuucuggcgaugacugcguggucaaaccgcucgaugaccgcuucgccagcgcgcugaccgcccugaacgauauggggaaggugagaaaggacauccagcagugggagccuucccggggauggaaugauuggacacaagugcccuuuugcucucaucacuuccacgaacucaucaugaaagacggcagaguucuggugguccccugucgcaaccaggaugagcuuauugggcgggcuagaaucagccagggagccggcuggucccugcgcgaaaccgcuugccucgggaagucuuacgcccagauguggagccugauguauuuucaucggagagaccuucgccuggcggccaaugcuauuuguuccgccgugccuagccacuggaucccgacaucucggaccacgugguccauucaugcuacacacgaguggaugaccaccgaggauaugcucacaguuuggaacagaguguggauccaagaaaaucccuggauggaggacaaaaccccugucgaaagcugggaggaaauccccuaccugggcaagcgcgaggaucaguggugcggaucucugauuggccucacaucccgggccacgugggcuaaaaacauccagaccgccauuaaucaggugagaagccugaucgggaacgaggaauauacagacuacaugccuuccaugaagcgcuuccggagagaggaagaggaagcgggaguccuuugguga

SEQ ID NO: 20177 - RNA, 9876 nt, Artificial Sequence
  derived and/or modified CDS sequence (opt5) from DENV-2__KC964095__SS-prME
uccgccggcaugaucauuaugcucauccccaccgugauggcuuuccaccucaccacgcgcaauggggagccucauaugauugucuccauccaggaaaagggaaaaucucugcuuuuuaagaccgaggacggcguuaauaugugcacacugauggccauggaucucggggaacugugugaggacaccauuacauacaaaugcccccuucugcggcaaaaugaacccgaggauaucgaccgcugguguaauagcaccuccacaugggugaccuauggaacgugcaccacaaccggcgagcacagacgggaaaagcgcucuguggcgcucguuccucauguggggaugggacuggagacaagaaccgaaacguggaugagcuccgagggcgcuuggaaacacgcccagcggaucgagacauggauucugcgccaucccggcuucaccaucauggccgcuauucucgccuacacaaucgggaccacccacuuucagagagcucugauuuucauccuucugacagccguugcgccucccaugacgaugcgguguauuggaaucucuaaccgcgauuuuguggaaggcgucagcgggggauccuggguggacaucguucucgagcacggcagcugcgugaccacaauggccaagaauaagccuacccuggauuucgaacuuauuaaaacagaggcuaagcagcccgccacccugagaaaauauuguaucgaagcuaagcucacgaacacaaccaccgagucucggugccccacacaaggggagccuucccugaaagaggaacaggacaagcgcuuugucuguaagcauagcauuguggauagaggauggggcaauggcugcgggucuuucggaaaaggcgggaucgugaccugugccauguuuacaugcaagaaaaacauggaaggaaagauuguccagcccgagaaucuggaauacacgaucguugugaccccucacuccggcgaggagcaugcgaucgggaacgacacaggaaaacacggcaaggaaauuaaagugacaccccagagcucugucacagaggccgaacucaccggcuaugggacggugaccaucgagugcagcccccggacaggacuggauuucaaugaaaugguucuucugcaaaugggcaacaaggcuuggcucgugcaccgccagugguuucuggaccuuccucugcccuggcucccuggggccgauacccagggaagcaauuggauucagaaggagacacuggucaccuucaaaaacccccaugcuaagaaacaagacgugguugugcugggcucccaggagggggccaugcacacggcccucacaggcgcuaccgaaauccagaugucuagcggaaaucugcuuuuuacaggccaucugaagugugggcucagaauggacaaacugcaacuuaagggaauguccuacagcaugugcaccggcaaguucaaagucgugaaggagauugcggaaacccagcacgggacaaucgucauccgggugcaguaugagggagauggcucucccuguaaaauuccuuucgagaucauggaccuggaaaagagauacguucucgggcgccugauuacggugaacccgaucgucaccgagaaagauucccccgugaacauugaagccgagccucccuuuggcgacagcuacaucauuaucggaguugaaccuggccagcugaagcucaauugguucaagaaagggucuagcaucggacaaauguuugagacaaccaugcggggcgcuaagagaauggccauucugggggauacagccugggacuucggaucccuuggcgggguguuuaccucuaucggcaaagcucugcaucaggucuucggagccauuuauggcgcggcuuuuagcgggguguccuggacgaugaagauccucauuggagugaucaucacauggauuggcaugaacagccgcucuaccucccugagcguuucucugguccuuguggggaucgugacccucuaccugggagucauggugcaggccgauuccggcugcguugugagcuggaaaaauaaggagcugaaguguggguccggcauuuucaucacagacaacguccggaccuggacagaacaguauaaauuucaacccgagucuccgagcaagcucgccuccgcuauucagaaagcccaggaagagggaaucugcggcaucagaucugugacgcgccuggaaaaucuuauguggaagcagauuaccccugagcugaaccacauccucgcugagaaugaaguuaaacugacaauuaugaccggggauaucaagggaacaaugcaagccggcaaacggagccugagaccccagccuaccgagcuuaaguacuccuggaagacgugggggaaagcgaagaugcucagcaccgaaucucacaaccagacauuccugauugacggacccgagaccgccgaauguccuaauacaaaccgcgcuuggaacucccuggagguggaggauuauggcuuuggcauguucaccacaaacaucuggcuccagcugaaagaaaagcaagacgccuuuugcgacagcaaacuuaugucugcugccaucaaggauaaucgggcgguccaugccgacaugggguacuggauugaguccgcucugaacgauaccuggaagaucgaaaaagccagcuucauugaggugaagaauugucacuggcccaaaucucauacgcucuggagcaacggaguucuggaguccgaaaugaucauuccgaagaaccuggcuggcccugugagccagcacaauuauagacccggguaccacacacagaucgccggacccuggcaucaaggcaaaccugagauggacuucgauuuuugcgacgggaccaccgucguggugacagaagauuguggaaaccgcggcccgucucuucggaccacgacagccuccggcaagcucauuaccgaguggugcugcagaagcuguacacugcccccucugcgguaccgcggggaagacggaugcugguauggcauggagaucagaccccucaaggagaaagaagagaaucuggucaacucccuuguuaccgcugggcacggacagaucgauaauuucucucugggcgugcucgggauggcgcuguuucuggaagagaugcuucggacaagagugggaaccaagcaugccauucuccuggucgcugugagcuucguuacgcugaucaccggcaacauguccuuuaaagaccucggccgcguggucgugaugguuggggccacaaugaccgaugacauuggaaugggcgugacauaccuggcccuucuggcugccuucaagguccggccuaccuuugcggcugggcuccugcugagaaaacuuacgucuaaggaacugaugaugacaaccaucggaauugugcuccugagccaguccacaauccccgagaccguucucgagcugaccgaugcccuugcccugggcaugauggcucucaagaucgugcgcgacauggaaaaauaucagcuggccgucacaauuauggcgauccugugugugccuaaugcugugauucuucaaaacgccuggaaggucucuugcacgauccuggccguugugagcgugagcccccuccugcucaccagcucucagcagaaaacagacuggauuccgcuggcucuuaccaucaaggggcugaauccuacagccaucuuccucaccacgcuguccagaacaaacaaaaagcggagcuggccccugaaugaggcuauuauggccgucggaauggugucuauccuugcguccagccugcucaaaaacgauauuccuaugaccggcccccugguugccggcgggcuccugaccguguguuacguccuuacaggacgcucugcugaccuggaacuggagagagccaccgaugugaauugggaagaccaggcugagaucuccggcagcuccccgauucucagcaucacaauuucugaggaugggagcauguccaucaagaacgaagaggaggaacaaacgcugaccauccuuauucggacaggacugcucguuaucucuggccuguuuccugugagcauucccaucaccgccgccgcuugguaucucugggaggucaagaaacagcgcgcgggggugcugugggacgucccuagcccgcccccuaugggaaaggccgaacuugaggauggcgcuuacagaauuaaacagaagggcgugcugggguauucucagaucggagccggcguuuacaaagaagggacauuccacaccauguggcaugugacgcggggagccguccugaugcacaagggcaagcgcaucgagccgagcugggcugacgugaaaaaggaucucauuuccuacgggggaggcuggaaacugggcggggaauggaaggagggagaggaaguucaagugcuugcccuggagcccggcaaaaauccuagagcgguccagaccaagcccgggcucuuuaagacaaacaccggaacaaucggcgcugugucucuggacuucagcccugggaccuccggaagccccauuaucgauaaaaagggcaaaguggaaggccucuaugggaacggaguugucacacggucuggcacguacguguccgccauugcccagaccgaaaaguccaucgaagacaauccugagaucgaggaugacauuuuucgcaaaaagagacugacaaucauggaccuucacccgggggcuggaaagaccaaacgguaucugcccgccauugugagagaagcgaucaagcgcggccugcggacccucauucuggcuccuacaagagucguggccgccgagauggaagaggcucuuagagggcugcccauccgguaccaaacgccugccauuagagcugaacauaccggccgcgagaucguugaucucaugugccacgccacauucaccaugcggcugcucucucccgugagagucccgaacuauaaucugaucauuauggacgaggcgcauuucacagauccugccuccaucgcugcccgcggauacauuagcacccggguggaaaugggcgaggcugccgggaucuuuaugacggccacaccgcccggauccagagacccuuucccccagucuaacgcuccuauuaucgaugaggaacgggagaucccggaacgcagcuggaacuccggccacgaguggguuaccgacuuuaaagggaagaccgugugguucguccccagcauuaaagcgggaaacgauaucgccgcuugucuuagaaagaauggcaagaaagugauucagcugucucggaagacauuugacuccgaauauguuaaaacccgcacaaacgauugggacuucguggucaccacggauaucagcgagaugggggccaauuuuaaggccgaaagagugauugacccucggagaugcaugaaacccgugauccugacagacggcgaggagcgcgucauccucgcuggaccuaugcccguuacccauucuagcgccgcgcagcggagaggccgcauugggcggaacccgaagaaugaaaacgaucaauacaucuacaugggagagccucuggaaaaugacgaggauugugcucacuggaaagaagccaagaugcuucuggacaacauuaauacacccgagggcaucauuccuuccauguucgagcccgaaagagagaagguggaugccaucgacggggaauaucgccuccggggagaggcuagaaaaaccuuuguggaucugaugcgcagaggcgaccugccugucuggcucgccuacaagguggcggccgaagggauuaacuaugcugaucggcgcuggugcuucgacggcaucaaaaacaaucagauccuugaggagaacguugaaguggagauuuggacgaaggaaggagagcgcaaaaagcugaagccccgguggcuggaugcccgcaucuacucugacccgcucgcucugaaagaguuuaaggaguucgccgcuggcagaaaaagccuuacccugaaucucauuacagagauggggcggcugccuaccuucaugacacagaagaccagagaugcccuggacaaccucgcgguccuucacacagccgaagcuggaggccgcgccuauaaucaugcucuguccgagcugcccgaaacccucgagacgcugcuucugcucacacugcuggccaccgugaccgggggaaucuuucucuuccuuaugucuggccggggcauugggaaaaugacacugggaauguguugcaucaucaccgccagcauucugcucugguacgcucagauccaaccccacuggauugcggccuccaucauucuggaguuuuuccuuaucguucugcucaucccugaaccggagaagcagagaacaccccaggacaaccagcugacguauguggucauugcuauccugaccguggucgccgccacaauggcuaaugaaaugggcuuucucgagaagaccaaaaaggaucuugggcugggaagcauuacaacccaacagccugaaucuaacauccuggacauugaucugcccccugccuccgcguggacgcuguacgccguggcuaccacauucguuacccccaugcuucgccauagcaucgaaaauuccucugugaacgugagccugacagccauugcuaaucaggccaccguccucaugggccuggggaaaggauggccucuguccaagauggacaucggcguuccgcuccuugcgaucggcugcuacucucaggugaaccccauuacgcugacagccgcucugcuccugcuuguggcccacuaugcuaucauugggccuggacugcaagccaaagcuacccgggaggcccagaagagagcggccgcuggcaucaugaagaaucccacagucgaugggauuaccgugaucgaccucgauccuauccccuacgacccgaaauuugaaaagcagcugggacaaguuaugcugcucgugcuuugugucacccaggugcugaugaugcggacaacgugggcccugugcgaggcucucacccuggccacaggcccuauuagcacccuuugggaagggaaccccggacgcuucuggaauacaaccaucgccgucuccauggcgaacauuuuuagaggcagcuaucuggcuggcgccgggcuccuguucucuaucaugaaaaauacgacaaacacccggcgcggaaccggcaacauuggggagacacugggagaaaaguggaaauccagacucaaugcucuuggcaagagcgaguuucagaucuacaaaaagucugggauccaggagguggaucggacccuggccaaggaaggaauuaaacgcggcgagacagaccaccaugccguuuccagaggcagcgcuaagcugcggugguucguggaacgcaacauggucacgcccgaggggaaagugguugaucucggauguggcagagggggauggucuuauuacugcggcgggcugaagaaugugcgggaggucaaaggacuuaccaagggcggcccugggcacgaggagcccaucccuaugagcacauauggauggaaccuggugagacuccaauccggcguggacgucuuuuucauuccgcccgaaaagugugauacccugcugugcgacaucggggaguggucuccuaaucccacagucgaagccggacgcacccuccgggugcuuaaccugguggagaauuggcugaacaauaacacgcaguucuguauuaaaguccucaauccuuacaugcccagcguuaucgagaagauggaaacccugcagagaaaauacggcggggcgcuugugcgcaacccgcugucccggaauagcacacaugagauguauuggguguccaacgccucuggaaauaucgucagcuccgugaacaugauuucuagaaugcucaucaaccgcuuuaccaugcggcacaagaaagcuacauacgaaccugacguugaucugggcagcggcaccagaaauauugggaucgaguccgaaacacccaaccuggacauuaucggaaagcgcauuggcaagaucaaacaggagcaugagaccucuuggcacuaugaucaagaccacccuuacaagacgugggccuaucaugggagcuacgaaacaaaacagaccggauccgcuagcucuaugguggauggcgucgugcggcuccuuaccaagcccugggacguuaucccuauggugacacagauggccaugacggauaccacacccuucgggcagcaaagagucuuuaaagagaagguggacacccgcacacaggaaccgaaggagggaaccaaaaagcugaugaaaauuacagcggaauggcuguggaaggagcucggcaaaaaggagaccccucggaugugcacgagagaagaguucacccgcaaagugagauccaaugccgcucugggcgccaucuuuacagaugaaaacaaguggaaguccgcucgggaggccgucgaggacucuggguucugggaacuuguugauaaagagcgcaaucugcaccucgaaggaaagugugagaccugcguguauaacaugaugggcaaaagagaaaagaaacugggggaguuuggaaaggcuaagggcucccgggccauuugguacauguggcugggggcgagauuccucgaguuugaagcccugggcuuccuuaaugaggaccauugguuuagccgggaaaacucucuguccggaguggagggcgaagggcuccacaaacugggauacauccuucgcgacgucagcaagaaagagggcggggcuauguaugccgaugacacagcuggaugggauaccagaauuacgcuggaggaccucaagaaugaagagauggugacaaaccacauggaaggcgagcauaaaaagcuggccgaagccaucuucaagcugaccuaccagaauaaaguugugcggguccaaagaccgcccccuagagggacagugauggauaucauuucccggcgcgaccagagaggcagcggacagguugugaccuauggccucaacacguuuaccaauauggaggcgcagcugauccggcaaauggagggggaaggagucuucaagaacauucagcaccuuacagugaccgaggaaaucgcuguucagaauuggcuggcccgcgugggcagagagcggcucucucgcauggccauuagcggggaugacugugucgugaaaccgcuggaugacagauucgcuuccgcccuuacagcucugaacgaugucggaaagauccggaaagacauccagcaaugggagcccucucgcggcugggaugacuggacccaggugccuuuuugcagccaucacucccaugaacucauuaugaaggacgggagaguucuggugguccccugccggaaccaggaugagcugaucggcagagcccgcauuucucagggagcgggcuggagccuccgggaaacagccugucuggggaaguccuacgcucaaauguggucucuuauguauuuccacagacgcgaccugcggcucgccgcuaaugccaucugcagcgcggugccuucccacugggugcccaccagcagaacgacauggucuauucaugccaaacacgaguggaugaccaccgaagauaugcugacaguuuggaaccgcguguggauccaggagaauccuuggauggaggacaagacccccgucgaauccugggaggaaauuccguaccuuggaaaacgggagggccaguggugugggagccugaucggacucacaucuagagcuacgugggccaagaacauccagaccgcuauuaaucaagugcgcucccugaucggcaacgaagaguauacagauuacaugccuagcaugaaacgguuuagacgcgaggaagaggaagccgggguucugugguga

SEQ ID NO: 20178 - RNA, 9876 nt, Artificial Sequence
  derived and/or modified CDS sequence (opt5) from DENV-2__KC964094__SS-prME
agcgcgggcaugaucauuaugcugauccccacagugauggcuuuccaccucacaacgagaaauggggaaccucauaugauuguuuccauccaagaaaagggaaaaucucugcuuuuuaagaccgaagacggcguuaauaugugcacacugauggccauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggguucugcggcaucccggcuucaccauuauggccgcuauccucgccuacacaauugggaccaccuauuuucagcgcgugcugaucuucauucuucugacagcugucgccccuucuaugacgaugagaagcaucggaauuuccaaccgggauuuuguggaaggcguuagcgggggaucuuggguggacgucgugcucgagcacggcuccugcgugaccacaauggcgaagaauaagcccacccuggauuucgaacuuacaaaaaccgaggccaagcacccugcuacgcugcgcaaauacuguaucgaagccaagcucacaaacaccaccacagcuagcagaugcccgacccagggggagcccucucugaaugaggaacaagacaaacgguuugucuguaagcauuccaugguugaucgcggauggggcaacggcugcgggcuguucggaaagggcgggaucgugacaugugccauguuuacgugcaaaaagaauauggagggaaaagugguccagccugaaaaccucgaguauaccauugugaucacaccccacagcggcgaagagaaugcgguugggaacgacaccggaaagcauggcaaagagauuaaggugacaccucagucuuccgucaccgaagccgagcugacgggcuacgggaccgugacaauggaaugcagccccagaaccggacuugauuucaaugagaugguucugcuccagaugaaaaacaaggcuuggcuggugcaccggcaaugguuucuugaccugccgcucccuuggcugcccggcgccgauacacagggguccaauuggauccagaaggaaacccuggucacguucaaaaacccucacgcuaagaaacaggacguggucgugcucggaucucaagagggcgccaugcauacagcccugaccggggcuacagagauucagaugagcuccggcaaccuucuguuuaccggacaccucaagugucgccugagaaccgacaaacuucagcugaagggcaugagcuauucuaugugcacagggaaguucaaaguugugaaggaaaucgcggagacgcaacauggaaccaucgucauucgggugcaguacgaaggcgaugggucccccuguaaaauccccuucgagauuauggaccucgagaagagacacguucugggacgccugaucacagugaauccuauugucaccgaaaaagauagcccggugaacaucgaggccgaacccccuuuuggcgacucuuacaucauuaucgggguggagcccggccagcucaagcugagcugguucaagaaagaauccucuauuggacagauguuugagacaaccaugcggggcgcuaagagaauggccauccuuggggauacggccugggacuucggaagccugggcgggguuuuuacauccauuggaaaagcucuccaucaagucuucggcgccaucuauggggcggcuuuuagcggcgugucuuggaccaugaagauucugaucggaguggucaucaccuggauuggcaugaacucccgcagcacaucucuguccgugagccuuguucucgugggggucgugacccuguaccugggaguuauggugcaggccgauuccggcugcgucgugucuuggaaaaacaaggagcucaagugugggagcggaaucuucguuacagacaaugugcacacguggaccgaacaguauaaauuucagccugagucccccucuaagcuggccagcgcuauucaaaaagcccacgaagagggcaucugcgggauucgguccgucacaagacuugaaaaccugauguggaagcagaucaccccggagcucaaucauauccugagcgagaacgaagugaaacugacaauuaugaccggcgauaucaagggaauuaugcaggcuggcaaacgcucucuucggccucagcccacggagcucaaguacuccuggaaggccugggggaaagcgaagaugcugagcaccgaacugcacaaucauacauuccucaucgacggaccugagaccgccgaaagacccaacacaaaucgcgcuuggaacucucuggagguggaggauuauggcuuuggggucuucaccacaaauauuuggcuuaaacugaaggaacggcaagacgucuuuugugacuccaaacucaugagcgccgcuaucaaggauaacagagccgugcacgcggacaugggauacuggaucgagucugcccugaaugauaccuggaagauugaaaaagcuagcuucaucgaggugaaguccugccacuggccuaaaagccauacgcuguggucuaacggcguccuugaguccgaaaugauuauccccaagaacuucgccggcccggugagccagcacaauuaucgcccuggguaccauacacagaccgcuggacccuggcaccucggccggcuggagauggacuuugauuucugugaagggaccacaguuguggucaccgaggacugcggaaacagaggccccucccugcggacgacaaccgccucugggaaacucauuacagaaugguguugccgcagcugcacccugccuccgcuuagauaccggggagaggauggcuguugguauggcauggagaucagaccccugaaggaaaaggaggaaaaucucgugaacucccugguuacagccgggcauggacagaucgacaauuuuucucugggcgugcuugggauggcucucuuccuggaggaaaugcugcgcacccgggucggaacgaaacacgcgauucuccugguggccguuagcuuugugacccuuaucacaggcaacauguccuucagagaucuggggcgcgucauggugauggugggagcuaccaugacagacgauauuggcaugggcgucaccuaccucgcccugcuggccgcuuuuaagguuagaccuacguucgccgcggggcuucugcuccggaaacugacaucuaaggagcucaugaugaccacaaucggaauugugcugcuuagccaauccaccauccccgagaccauucuggaacucacagacgcucuggcccugggcaugauggugcuuaaaaucguccgcaauauggagaaguaucagcuggccgugacgaucauggcuauucucugcguuccuaacgccgugauccugcagaaugcguggaaggucagcuguaccacacucgcugugguuucugugagcccccugcuucugaccagcucucaacagaaagccgauuggauuccucucgcccugacaaucaaggggcugaaccccaccgcuauuuuucuuacgacacuguccagaaccagcaaaaagcggucuuggccgcucaaugaagccaucauggcugucggaaugguguccauccuggccagcucccuccugaaaaacgacauuccuaugaccggcccccuugucgccgggggacugcugacagugugcuacguucucgccggccgcagcgcugaccuggagcuugaaagagccgcugaugugcggugggaggagcaggccgaaaucucuggcagcuccccuauucugucuaucaccauuagcgaggacgggggaauguccaucaagaaugaagaggaggaacagacacucacgauccugauucgcaccggccuccuggucaucucugggcuuuuccccgugagcauuccgaucacagccgcugcgugguaucugugggagguuaaaaagcaaagagccggagugcugugggaugucccuucucccccucccgugggcaaggcugaacucgaggacggggccuaccggauuaaacagaagggaauccugggcuauagccagauuggcgccgggguguacaaagaaggaaccuuucacacaauguggcauguuacccgcggcgcuguccuuaugcacaaggggaaaagaaucgagcccagcugggccgaugugaagaaggaccugaucuccuacggaggcggguggaaacucgagggagaauggaaggagggcgaagagauucaggugcuggcgcucgaaccuggcaaaaacccgcgggcuguccaaacgaagcccgggcuguucaaaaccaauacaggaaccaucggcgccgugagccuugauuuuucuccugggacauccggaagccccauuguugacaagaagggcaaaguggucgggcuguauggaaacggcgugguuaccagaucuggcacauacguguccgccaucgcucagacggaaaaguccauugaggauaacccugaaaucgaggacgauaccuuccgcaaaaagcggcugacaaucauggaccuccaucccggggccggaaaaaccaagagauaucugccugcgauuguccgcgaagcuaucaagcggggccuuagaacccugauucucgccccgacacgcgugguugccgcugagauggaagaggcccugcgggggcuccccaucagauaccagacgccugcuauucgcgccgagcacaccggacgggaaaucguggaucugaugugucaugcgacauucaccaugagacuucugucccccauccgggucccuaauuauaaccugauuaucauggacgaggcccacuuuacagaccccgcuucuauugccgcucgcggcuacaucagcaccagaguggaaaugggggaggccgccggcauuuucaugacggcuacaccgccuggaucccgggaucccuuuccccagagcaaugcgccuaucauggacgaggaacgcgagauucccgaaagaucuuggaacuccggccacgagugggugaccgauuucaaagggaagaccgucugguuuguuccuagcaucaaagccggaaaugacaucgcugccugccuccggaagaacggcagaaaagugauucaacugucucgcaagacaagcgauuccgaauauaucaagacccggacaaaugacugggauuucguggucaccacggacauuucugagaugggggccaacuuuaaagcugagagagugaucgauccgcgccgguguaugaagcccguuauucuuacagacggagaagagagagugauccuggccggcccuaugcccgucacccauagcuccgcggcucagcgccgggggagagugggccgcaauccuaaaaacgaaaaugaucaguacaucuacaugggagagccccucgaaaacgacgaggacugcgcccacuggaaggaggccaaaaugcugcuggauaauauuaacacaccggaaggcaucauuccuucuauguucgagcccgaaagagagaagguugacgcuaucgauggggaauaucggcuccgcggagaggccagaaaaaccuuuguggaccuuaugcggcgcggcgaucugccugucuggcuggcguacagaguggccgcugaggggauuaauuaugccgaccggagaugguguuucgauggagucaagaacaaccaaauccucgaagagaauguggaaguugagaucuggacgaaggagggcgaacgcaaaaagcugaaaccccgguggcuugacgcuagaauuuacagcgauccucuggcccucaaggaguuuaaagaguucgcugccgggcgcaagucccugacccugaaccucaucacagagaugggccggcuucccaccuucaugacacagaaggcgagaaaugcccuggacaaccuggcugugcuccauaccgccgaagcuggaggccgggccuauaaucacgcccugagcgagcuuccggagacacuggaaacccuccugcugcucacgcuucuggcuacagugaccgggggaauuuuucuguuccucaugucuggcaaagggaucggaaagaugacccugggcaugugcuguauuaucacagcguccauucuucugugguacgcccagauccagccucacuggaucgcugccagcauuauccucgaguuuuuccugauuguccugcucauccccgaacccgagaaacaacgcaccccucaggauaaccagcuuacauauguugugauugccauccugacgguggucgcugccaccauggcgaaugaaaugggcuuucuggagaagaccaagaaggacuucgggcucggauccaucgccacccagcaaccggagucuaacauucuggauaucgaccuuagacccgcuagcgccuggacacuguacgcuguggccaccacguuuauuaccccuaugcuccggcauuccaucgaaaauucuagcguuaacgugucccugacagcgauugccaaucaggcuaccguccugaugggccucgggaagggauggccccuuagcaaaauggacaucggcgugccucugcuggccaucgggugcuacucucaggucaaccccauuacacucaccgcugcccugcuucugcucguggcucacuaugccaucauuggaccuggccugcaggcgaaggccacgcgcgaggcucagaaaagagccgcugccggcaucaugaagaauccgacaguugaugggauuaccgugaucgaccuggaucccauuccuuacgaccccaaauucgaaaagcagcucggacaggucaugcuucuggugcugugcguuacacaggugcucaugaugcggaccaccugggcccugugugaggcgcuuacacuggcuacgggcccuaucuccacccucugggaagggaaccccggacgcuuuuggaauacaaccaucgccgucagcauggcuaacauuuucagaggcucuuaucuggccggggccggacugcucuuuuccaucaugaagaauacagcuaacacccggcgcggcacgggcaacacaggggagacccuuggagagaaauggaagaauagacugaacgcccugggcaaaagcgaguuccaaauuuacaagaaaucugggauccaggagguggaucggacccucgcgaaggaaggaauuaaaagaggcgagacagaccaucacgccgugagccgcggguccgcuaagcugcggugguuuguugagagaaaucuugucaccccggaaggaaaggugguggaucugggcugcggccgcgggggauggucuuauuacuguggcgggcucaaaaacgucaaggagguuaaaggacugacaaagggcgggccuggacaugaagaacccauccccaugagcacguauggcuggaaucuggugcggcuccaguccggcguggacgucuucuucaccccucccgaaaaaugcgauacacuucugugugacaucggggagagcuccccuaacccgaccguggaggccggaagaacacugcgcguucucaaucugguggaaaacuggcuuaauaacaauacccaauuuugcauuaagguccugaaccccuacaugccuucugugaucgagaagauggaagcucuccagcggaaauacggcggggcccugguuggaaauccccugagcagaaacuccacgcacgagauguauugggcgucuaaugccagcggcaacauuguguccucugucaacaugaucagccgcaugcucauuaaucgguucaccaugagacacaagaaagcuacauacgaaccugauguggaccuuggguccggaacccgccauaucggcaucgagagcgagacacccaaccuggauauuaucggcaagcggauugagaaaaucaagcaggagcacgaaaccucuuggcauugugaccaggaccacccguauaagacaugggccuaccacggguccuaugaggcuaaacaaaccggaagcgccucuuccauggugaauggcgucguuagacugcucacgaagccuugggaugugauucccauggugacacagauggcuaugaccgacaccacaccuuuugggcagcagcgcgucuucaaagaaaagguggauacgagaacccaagagcccaaagagggaacaaagaagcugaugaaaaucaccgccgaauggcuuuggaaggagcugggcaaaaagaaagcgccucggaugugcacacgcgaagaguuuaccagaaagguucggagcaacgccgcucucggggccauguucacagacgagaauaaauggaagucugcuagagaagccguggaggauuccggauuuugggaacuggucgacaaggagcggaaccugcaucucgaaggcaaaugugagaccugcguguacaauaugaugggcaagcgcgagaaaaagcugggggaguucggaaaagccaagggcagcagagcgaucugguauauguggcuuggggcucgguuucuggaguucgaagcccucggauuucugaacgaggaucacugguucucccgcgaaaauagccuuucuggcguugagggggagggccugcauaagcucggauacauucugagagacgugagcaaaaaggaaggcggggccauguacgcugaugacacggccggaugggauacccggaucacacuggaggaccucaaaaacgaagagauggucaccaaucacauggaaggcgagcauaagaaacuggcugaggccauuuuuaaacuuacauaucagaacaaggugguucgcgugcagagacccaccccgcgggggacggucauggacaucauuucccgcagagaucagcggggaucuggccaaguggucacauacgggcugaauaccuucacaaacauggaagcgcagcucauccgccagauggagggcgaaggaguguucaaaagcauucaacaccugaccguuacggaggagaucgccgugaagaauuggcuugucagagugggccgggaacgccuguccagaauggcuaucucuggggacgauugugugguuaaaccucucgacgaucgguuugccagcgcucugaccgcccugaacgacaugggaaaggugagaaaagauauucagcagugggagcccucccgcggcuggaacgacuggacacagguccccuucugcucucaccauuuucacgaacucaucaugaaggaugggcgggugcugguugugccuugcagaaaucaagacgagcuuauuggacgcgcgcggaucagccagggcgccggguggucccugagagaaaccgcuugucucggcaagagcuaugcccagauguggucucugauguacuuccaucgccgggaucuuagacuggcugccaacgcuauuugcuccgccgucccgagccacugggugcccacaucucgcaccacaugguccauccacgcgacccaugaguggaugacgacagaggacaugcucaccgucuggaaucggguguggauccaggaaaacccuuggauggaggauaaaacccccguugaaagcugggaggaaauuccuuaucugggaaagagagaggaccaaugguguggcucccugaucgggcucacaucucgcgccaccugggcuaaaaauauucagacagccaucaaccaggugcggagccugauuggaaaugaggaauacacggacuauaugcccuccaugaagagauuucggagagaggaagaggaagccggcguccuuugguga

SEQ ID NO: 20179 - RNA, 9876 nt, Artificial Sequence
  derived and/or modified CDS sequence (opt5) from DENV-2__KC964093__SS-prME
accgccggcgugaucauuaugaugauccccacggucguugcuuuccaccugacgacccggaauggggagccucauaugauugugucccggcaggaaaagggaaaaucccuccuguuuaagacagagaauggcgugaauaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcaccggcgggaaaaacgcuccguggcucugguuccucauguggggaugggacucgagacacggaccgaaacguggaugucuuccgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugacaaagaccgaggcuaaacacccugccacgcuuagaaaguacugcaucgaagcuaaacugacaaacaccaccacagccucucgguguccgacccagggggagcccucccucaaugaggaacaagauaagcgcuuuguuugcaaacauagcaugguggacagaggauggggcaacggcugugggcuguucggaaagggcgggaucgugacaugcgcgauguuuacgugcaagaaaaauauggagggaaaggucgugcagccugaaaaccuggaguauaccauuguuaucacaccccacucuggcgaagagaauguggucgggaacgauaccggaaaacauggcaaggagauuaaagugacaccucaguccagcaucaccgaagccgagcucacgggcuacgggaccguuacaauggaauguucuccccggaccggacuggacuucaaugagauggugcuucugcagauggaagauaaggcuuggcucguccaccgccaaugguuucuggaccuuccgcugccuuggcuccccggcgccgauacacagggguccaacuggauucagaaagagacccuggugacguucaagaacccucacgcuaagaaacaggacgucgugguucugggaagccaagagggcgccaugcauacagcccucaccggggcuacagaaauccagauguccucuggcaaucugcuuuuuaccggacaccugaagugcagacuccggauggacaaacugcagcuuaagggcaugagcuauuccauguguaccgggaaauucaaggcggugaaggagaucgccgaaacacaacauggaacgauugucaucagagugcaguacgagggcgaugggagccccugcaaaauucccuucgagaucauggaccuggaaaagcgccacguucucggacggcugauuaccgugaacccuaucgucacagagaaagauucuccggugaauaucgaagcugagcccccuuuuggcgacuccuacauuaucauugggguggaacccggccagcugaagcucagcugguucaaaaagggaucuagcaucggccagauguuugagaccacaaugagaggggccaagcgcauggccauucugggagauaccgcuugggacuucggcucccuugggggaguuuuuacgucuaucggcaaagcccugcaucaagucuucggggcgauuuauggcgcugccuuuagcggaguguccuggacaaugaagauccucaucggcguggucauuaccuggaucgggaugaacagccggucuaccucccugagcgugucucugguucuugugggagucgugacacucuaccugggcguuauggugcaggccgauuccgggugugucgugagcuggaaaaauaaggagcugaaaugcggauccggcauuuucaucaccgacaacguucacacauggacggaacaguauaaguuucagccugagucucccagcaagcucgcuuccgccauucaaaaagcucacgaagaggggaucuguggcaucagaucugugacccgccuggaaaaucuuauguggaagcagauuacaccggagcugaaccauauccucagcgagaaugaagucaaacugaccauuaugacaggagauaucaagggcauuaugcaggccgggaaacggucccugagaccucagcccaccgagcuuaaguacagcuggaaagcguggggaaaggccaagaugcucucuacggaacugcacaaccauaccuuccugaucgacggcccugagacagcugaaugccccaauaccaaccgcgccuggaacucccucgagguggaggauuauggguuuggaguguucacaaccaacaucuggcugaaacuuaaggaacggcaagacgucuuuugugacagcaaacugaugucugcugccauuaaggauaauagagcgguucacgccgacaugggcuacuggaucgaguccgcucucaacgauacauggaaaauugaaaaggccagcuucaucgaggugaagucuugccacuggccuaaaagccauacccugugguccaacggcgugcuggagagcgaaaugauuauccccaagaauuucgcugggccggucucucagcacaacuaucgcccuggauaccauacgcagacagccggccccuggcaccuugggaaacucgagauggacuuugauuucugugaaggaaccaccgugguugugacagaggacugcggcaaucgggggcccucccugagaaccacgacagccagcggaaagcugaucaccgaauggugcugucgguccugcacacucccuccgcugcgcuacagaggcgaggauggcuguugguaugggauggagauucggccccuuaaagaaaaggaggaaaaccuggucaauucucucgugaccgcuggacauggccagaucgacaacuuuagccuggggguucugggaauggcgcuuuuccucgaggaaaugcugagaacacgcgugggcaccaagcacgccauucugcucgucgcuguguccuuuguuacgcugaucaccgggaauaugucuagccgggaucuuggaagagugauggucauggugggcgccacaaugaccgacgauauuggcaugggggugacauaccuggcccuccuggcugccuucaaaguccgcccuaccuuugcggcuggacugcuucugagaaagcucacguccaaagagcugaugaugacaaccaucggcauuguucuccugucucaaagcuccauccccgagacaauccuugaacugaccgacgcccucgcccuggggaugauggugcugaagauugugcggaacauggagaaauaucagcuugcugucaccaucauggccauucugugcgugccuaaugcgguuauccuccagaacgcuuggaaggugagcuguacaacgcuggccgucgugucuguuagcccccuccugcuuaccagcucucaacagaaggccgauuggauuccucuggcucucacaaucaaaggacugaaucccaccgccaucuuccugacaacccuuucccgcacgagcaagaaaagaucuuggccgcugaacgaagcuauuauggccgugggcauggucuccauccucgcgagcucccugcucaagaaugacauuccuaugacagggccccugguggccggaggccuucugaccgucugcuacgugcuggcuggccggagcgccgaccucgagcuggaacgcgcugccgauguuagaugggaggagcaggccgaaaucucugggagcuccccuauucuuucuaucaccaucagcgaggacggaggcauguccauuaaaaacgaagaggaggaacagacacugaccauccucauucggacagggcugcucgugaucucuggacuguuucccgucagcauuccgaucacggcugcggccugguaucuuugggaggugaagaaacaacgcgcuggcguucugugggaugugccuucucccccucccgucgggaaggccgaacuggaggacggagccuacagaauuaagcagaaaggcauccucggcuauagccagaucggggcuggaguguacaaggaaggcaccuuccacacaauguggcaugugaccagaggggccguucugaugcacaaaggaaagcgcauugagcccagcugggcggaugucaaaaaggaccuuaucuccuacggcgggggauggaagcuggagggcgaauggaaagagggcgaagagauucaggugcucgcucuggaaccugggaagaauccgagagccgugcaaacaaaacccggacucuuuaagaccaacacgggcaccaucggggccgucagccuggauuucucuccuggaacauccggcagccccauuguggacaaaaaggggaagguugugggacuuuauggcaacggcgucgugacccggucugggacauacguuuccgcuaucgcccagaccgagaaaagcaucgaggauaauccugaaauugaggacgauaucuuuagaaagaaacgccugacaauuauggaccugcaucccggagcgggcaagacgaaacgguaucucccugcuaucgugagagaagccauuaagcgcgggcugcggacccuuauccuggccccgacaagagucguggcugccgagauggaagaggcucuccgcggacugcccauccgguaccagaccccugccauuagagcggagcacaccggccgcgaaaucguugaucucaugugucaugccacauucacgaugcggcugcuuucccccauuagagugccuaacuauaaucugaucauuauggacgaggcucacuucaccgaccccgccucuaucgcugcccggggguacauuagcacacgcgucgaaaugggcgaggccgcuggaaucuuuaugaccgcgacaccgccuggcuccagagaucccuucccccagagcaacgccccuaucauggacgaggaacgggagauucccgaacgcucuuggaacuccgggcacgagugggugaccgauuuuaagggaaaaacggugugguucgucccuagcaucaaggcuggcaacgacauugccgccugccugcgcaaaaaugggaagaaaguuauccaacucucucggaagacauuugauagcgaauaugugaagaccagaaccaacgacugggauuucguggucacaaccgacauuuccgagaugggagcuaauuuuaaagccgagcgcgugaucgauccgcggagauguaugaagcccguuauccugacagacggcgaagaaagagugauucuugcggggccuaugcccgucacccauucuagcgcugcccagcggagaggccgcgugggacggaacccuaaaaaugaaaacgaucaguacaucuacaugggcgagccccuggaaaaugacgaggacugcgcccacuggaaggaggcuaaaaugcuccuggauaacauuaauacgccggaagggaucauuccuuccauguucgagcccgaaagagagcgcguugacgccaucgauggagaauauagacugcggggcgaggcgcgcaagacauuuguggaccucaugagaagaggggaucuuccugucuggcuggccuaccgcguggcugccgagggaaucaacuaugcugacagacggugguguuucgauggcgucaaaaacaaucaaauucuggaagagaacguggaaguugagaucuggaccaaggagggggaaagaaagaaacucaagccccgcuggcuggacgcccggauuuacucugauccucuugcucugaaagaguuuaaggaguucgccgcgggcagaaaaagccucacacugaaucugaucaccgagaugggacgccuccccacguucaugacccagaaggcccggaacgcucuugacgaucuggccgugcugcauacagcugaagccggcgggagagccuauaaucacgcucucuccgagcugccggagacccuugaaacacugcuccugcugacccuccuugcgacagugaccggaggcauuuuucuguuccugaugagcgggaagggaaucggcaaaaugacgcucggcaugugcugcauuaucacagccucuguccugcuuugguacgcucagauccagccucacuggauugccgccuccaucauucuggaguuuuuccucaucguucugcugauucccgaacccgagaagcaacggaccccucaggacaaccagcucaccuauguggcuaucgccauccuuacaguggucgcggccaccauggcuaaugaaaugggguuucuggagaaaacaaagaaagauuucggacugggcagcauugccacgcagcaaccggaguccaacauccucgaccuggaccuucgccccgcuucugccuggacccuguacgcgguggccacaaccuuuauuacaccuaugcucagacauagcaucgaaaauuccucuguuaacgugagccugaccgcuauugccaaucaggcuacgguccugauggggcucggaaagggcuggccccuuuccaagauggauaucggggugccucugcuggccaucggauguuacagccaggucaaccccauuacccucacagcugcccugcuucugcucguggcgcacuaugccaucauuggcccuggccugcaggcuaaagccacccgggaggcucaaaagcgcgccgccgcggggaucaugaaaaauccgacaguugacggaauuaccgugaucgaucuggaccccauuccuuacgaucccaaguucgaaaaacagcucggccaggucaugcuucuggugcugugcguuacacaggugcucaugaugagaacaaccugggcucugugugaggcccuuacacuggcuaccgggccuaucucuacccucugggaaggaaaccccggccgguuuuggaauacaacgaucgccgucuccauggccaacauuuuccgcgggagcuaucuggcuggagugggccugcucuuuucuaucaugaagaauaccgccaacacaagacggggcaccgggaacacaggagagacccuuggcgagaaguggaaaaaucgccugaacgcgcuggggaaguccgaguuccaaauuuacaaaaagagcggaauccaggagguggacagaacgcucgccaaagaaggcauuaagagaggggaaacagaucaucacgcuguuucuagaggaagcgccaaacugcgcugguuugucgagcggaaucuugugaccccggaaggcaaggugauggaccugggcugcgggagaggaggcugguccuauuacugugggggacucaagaacgucaaagagguuaagggccugaccaaagggggaccuggccaugaagaacccauccccaugucuacauauggcuggaaucuggugcgccuccagagcgggguggaugucuucuucgcuccucccgaaaagugcgacacccuucugugugauaucggagaguccagcccuaacccgacaguggaggccggccggacgcugagaguucucaaucugguggaaaacuggcuuaauaacaauacccaauuuugcauuaaaguccugaaccccuacaugccuuccgugaucgagaagauggaagcgcuccagcgcaaguacgggggagcccugguucggaauccccugucuagaaacagcacacacgagauguauuggguguccaaugcuucuggcaacauugucagcuccgugaacaugaucucucgcaugcucauuaaucgguucaccaugagacacaaaaaggccacauacgaaccugacguggaucuugggagcggaacccgcaacaucggcaucgaguccgagauucccaaucuggacaucauuggcaaacggaucgaaaagauuaaacaggagcaugaaacgagcuggcacuaugaccaggaucauccguacaagaccugggcuuaucacgggucuuacgagacaaagcaaaccggauccgccagcucuauggucaacggcguugugagacugcucacaaaaccuugggacgugauccccauggucacccagauggcuaugacagauaccacgccuuuugggcagcagcgcguguucaaggaaaaaguugacacaagaacccaagagcccaaggagggaaccaaaaagcugaugaagaucacagccgaauggcuuuggaaagagcugggcaagaaaaagacgccucggauguguacccgcgaagaguuuacaagaaaagugcgguccaaugcggcccucggggcuauuuucaccgaugagaacaaguggaaaagcgccagagaagcugucgaggacucuggauuuugggaacugguggauaaggagcggaaucugcaccucgaaggcaagugcgagacauguguuuauaacaugaugggcaaacgcgagaagaaacugggggaguucggaaaggccaaaggcuccagagccaucugguacauguggcuuggggcgcgguuucuggaguucgaagcucucggauuucugaaugaggaccauugguucagccgcgaaaacucccuuagcggcguggagggggagggccugcacaagcucggauacauucugagagaagucucuaagaaagagggcggggccauguaugccgaugacaccgcuggaugggauacacggaucacccuggaagaccucaagaaugaggaaauggugacgaaccauauggagggcgagcacaaaaagcuggccgaagcuauuuuuaaacuuaccuaccagaauaagguugugcgcguccagagacccacaccgcgggggaccgugauggacaucauuagccgcagagaucagcggggauccggccaagucgugacauaugggcugaacaccuucacgaauauggaggcccagcucauccgccagauggaaggcgagggaguuuucaagucuauccaacaucugacagugaccgaggaaauugcggucaaaaacuggcuuacaagagugggccgggagcgccugagcagaauggccaucuccggggacgauugcgugguuaagccucucgacgaucgguuugcuucugcccugaccgcucugaacgacaugggaaaagugagaaaggauauucagcagugggaacccagccgcggcuggaaugacuggacgcagguccccuucugcucccaccacuuucaugagcucaucaugaaagaugggcgggugcugguugugccuuguagaaaccaagacgaacuuauuggacgcgcccggaucucucagggcgcgggguggagccugagagagaccgccugccucggcaaguccuacgcucagauguggagccugauguauuuccaccgccgggaucuuagacuggccgcuaaugccaucuguucugcugucccgucccauugggugcccacaagccgcaccacauggucuauucacgccacccacgaguggaugacaaccgaagacaugcucacggucuggaaccggguguggauccaggagaauccuuggauggaagauaagacacccguugaguccugggaagagauuccuuaccugggaaaaagagaggaccaauggugcggcagccugaucgggcucaccucccgcgcgaccugggccaagaacauucagacagcuaucaaucaggugcggucucugaucggaaacgaagaguauaccgacuacaugcccagcaugaaaagauuucggagagaagagggcgaagccgggguccuuugguga

SEQ ID NO: 20180 - RNA, 9876 nt, Artificial Sequence
  derived and/or modified CDS sequence (opt5) from DENV-2__DQ448231__SS-prME
accgccggcgugaucauuaugcugauccccacagcuauggccuuccaccucacgaccagaaacggggagccucauaugauugucagccggcaggaaaagggaaaaucccugcuuuuuaagacagaggacggcguuaauaugugcacccugauggcgauggaucucggggaacugugugaggacacaaucaccuacaacugcccgcuucugcgccaaaaugaacccgaggauauugacuguuggugcaacucuacaagcaccugggugacguauggaaccuguacagcuaccggcgagcacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagaguucugaucuucauucuucugacagcgguggccccuuccaugacgaugcggugcaucggaauuucuaaucgcgauuuugucgaaggcgugagcgggggauccuggguugacaucgugcucgagcacggcagcugugucaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugugugcaaacacagcaugguggauagaggauggggcaauggcugugggcuguucggaaagggcgggaucgucaccugcgccauguuuacaugcaagaaaaacauggagggaaagauuguucagccugaaaaucucgaguauacgaucguggugaccccccauucuggcgaagagaacacagucgggaaugacaccggaaaacacggcaaggagauuaaagugacaccucaguccagcaucaccgaagcugagcugacgggcuacgggaccguuacaauggaauguucuccccggaccggacuugauuucaacgagauggugcugcuccaaauggaaaauaaggccuggcugguccaucgccagugguuucuugaccugccgcucccuuggcugcccggcgcugauacacagggguccaacuggauccagaaagagacccuggugacguucaagaacccucacgccaagaaacaagacguugugguccucggaagccaggagggcgccaugcacacagcucugaccggggcgacagaaauucagauguccucuggcaaucuucuguuuaccggacaucucaagugcagacugcggauggacaaacuucaacugaagggcaugagcuauuccauguguaccgggaaauucaagguggucaaggagaucgccgaaacacagcacggaacgauugugguuagagugcaguacgagggcgaugggagccccugcaaaauccccuucgagauuauggaccucgaaaagcgccauguccugggacggcugaucaccgugaacccuaucguuacagagaaagauucuccggugaauauugaagcugagcccccuuuuggcgacuccuacaucauuaucggggucgaacccggccagcucaagcugagcugguucaaaaagggaucuagcauuggccaaauguuugagaccacaaugagaggggccaagcgcauggccauccuuggagauaccgcuugggacuucggcucccuggggggaguguuuacgucuauuggcaaagcccuccaccagguguucggggcgaucuauggcgcugccuuuagcggaguuuccuggacaaugaagauccugauuggcgucgugaucaccuggauugggaugaacagccggucuaccucccugagcgugucucuuguccucgugggaguugugacacuguaccugggcgucauggugcaggccgauuccggguguguugugagcuggaaaaauaaggagcucaaaugcggauccggcaucuucauuaccgacaacguccauacauggacggaacaguauaaguuucaaccugagucucccagcaagcuggcuuccgccauccagaaagcucacgaagaggggaucuguggcauuagaucugugacccgccuugaaaaucugauguggaagcagaucacaccggagcucaaccacauucugagcgagaaugaaguuaaacugaccaucaugacaggagauauuaagggcaucaugcaggccgggaaacggucccuuagaccucaacccaccgagcucaaguacagcuggaaaacguggggaaaggcgaagauccugucuaccgaaccucauaaccagacauuccugauugacggccccgagaccgccgaaugcccuaauacaaaccgcgcuuggaauucccucgagguggaggauuauggguuuggagucuucaccacaaacaucuggcugaaacuuaaggaacggcaggacguguuuugugacagcaaacugaugucugccgcuauuaaggauaauagagccgugcacgcggacaugggcuacuggaucgaguccgcccucaacgauaccuggaaaauugaaaaggcuagcuucaucgaggucaagucuugccauuggcccaaaagccacacgcugugguccaacggcguucuggagagcgaaaugaucauuccgaagaauuucgccgggccugugucucagcacaacuaucgccccggauaccauacacaaaccgcuggccccuggcaccuugggaaacucgagauggacuuugauuucugugaaggaaccacaguggucgugaccgaggacugcggcaaucgggggccuucccugagaacgacaaccgccagcggaaagcugaucacagaauggugcugucgguccugcacccucccgccccugcgcuacagaggcgaggauggcuguugguaugggauggagauucggccucuuaaagaaaaggaggaaaaccugguuaauucucucgugacagccggacauggccagaucgacaacuuuagccuggggguccugggaauggcucuuuuccucgaggaaaugcugagaacccgcgugggcacgaagcacgcgguucugcucguggccgucuccuuuaugacccugauuacagggaauaugucuuuccgggaucuuggaagagugaugguuauggugggcgcugccaugaccgacgauaucggcaugggggucacauaccuggcccuccuggcugccuuuaaagugcgccccaccuucgcggcuggacugcuucugagaaagcucacgagcaaagagcugaugaugacaaccauuggcaucgugcuccugucccagucuacaaucccugagaccauucuugaacugaccgacgcccucgcccuggggaugaugauccugaagauuguccggaacauggagaaauaucaacuugcuguuacaaucauggccauucugugcgugcccaaugcggugauccuccagaacgcuuggaaggucagcuguacgauccuggccgugguuuccgugagcccucuccugcuuaccucuucccagcagaaggccgauuggauuccccuggcucucacaaucaaaggacugaauccgaccgccauuuuucugacaacccuuagccgcacgaacaagaaaagaucuuggccucugaaugaagcuaucauggccgucggcaugguguccauucucgcgagcucucugcucaagaacgacauccccaugacagggccucugguugccggaggccuucugaccgugugcuacguccugaccggccgguccgcugaccucgagcuggaacgcgccgcugaugugagaugggaggaccaagccgagaucagcggguccagccccauucuuucuaucacaauuagcgaagauggauccaugucuaucaaaaaugaggaagaggagcagacccugacaauucucauccggacgggccugcucgucauuagcgggcuguucccgguguccaucccuaucaccgccgcugcgugguaucuuugggaaguuaagaaacagcgcgccggagugcugugggacguccccucuccuccccccgugggcaaggcugagcuggaagauggggccuacagaauuaagcagaaaggaauccucggcuauagccaaauuggcgccgggguuuacaaggagggaacauuucauaccauguggcacgugacacggggcgcuguccugaugcacaaagggaagcgcaucgaaccuuccugggccgacgugagaaaagaucuuauuucuuacggaggcggguggaagcuggagggagaguggaaggaaggcgaggaagugcagguucucgcgcuggagccgggcaaaaacccccgggcuguccagaccaagccugggcucuucaaaacgaacaccggaacaaucggcgccgugagccuggacuuuucccccgggaccagcggaucuccuaucguggauaagaaaggcaaggucguggggcuuuauggaaauggcguugugacaagauccggcaccuacgucagcgccauugcucagacagaaaagucuaucgaggacaaccccgagauugaagaugacaucuuccgcaaaaagcggcugacgauuauggaucugcauccuggggccggaaaaaccaagagauaucucccggcgaucgugcgcgaggcuaucaaacggggccugagaacacuuauucuggcccccacccgcguuguggccgcugaaauggaggaagcccuccgggggcugccuaucagauaccaaacccccgcuauucgcgccgagcacacaggacgggagaucgucgaccucaugugucaugcgacguucaccaugagacugcuuuccccugugcggguucccaauuauaaccugauuaucauggacgaagcccacuuuacagauccggcuagcauugccgcucgcggcuacaucuccaccagaguggagaugggggaagccgccggcaucuucaugacagcuaccccucccggaucucgggaccccuuuccucagagcaaugcgcccauuauggaugaggagcgcgaaaucccugagagauccuggaacagcggccaugaaugggucacggacuucaaggggaagacagugugguuugugccgucuauuaaagccggaaaugauaucgcugccugccugcggaagaacggcaaaaaggucauucagcucuccagaaaaaccuucgacagcgaguauaucaagacccgcacaaaugauugggacuuuguugugaccacagauaucucugaaaugggggccaacuucaaggcugagcgggugauugaccccagacgcuguaugaaaccugucauccugaccgauggagaggaacgggugauucuugccggccccaugccuguuacgcacagcuccgcggcucaaagacgcgggcggaucggcagaaaucccaagaacgagaaugaccaguacauuuacaugggagaaccgcuggagaacgacgaagauugcgcccacuggaaagaggccaagaugcuccuggacaauaucaacacaccugagggcaucauucccucuauguuugaaccugagcgcgaaaaaguggaugcuaucgacggggaguauagacugcggggagaagcccgcaagaccuucgucgaucucaugagacggggcgaccuucccguguggcuggcguaccgcguugccgcugaggggauuaacuaugccgauagacggugguguuuugacggaaucaaaaauaaccagauucuggaggaaaauguggaggucgaaaucuggacaaaggagggcgagagaaagaaacucaagccucgcuggcuggaugcucggauuuacagcgacccccuugcccugaaagaauucaaggaguucgcugccgggagaaaaucccucacccugaaccugaucacggaaaugggccgccucccgaccuuuaugacacagaaggcgcggaaugcccuugauaaccuggcugugcugcauaccgccgaggcuggaggcagagccuauaaucacgcccucucugaacugccugagacacuugagacccugcuccugcugacacuccuugcuaccgucacggggggaaucuuccuguuucugaugagcggcaaggggauuggaaaaaugacacucggcaugugcugcaucauuaccgcguccauccugcuuugguacgcccaaauucagccccauuggaucgcugccagcaucauucuggaauucuuucucaucgugcugcugauucccgagccugaaaagcagcggaccccgcaggacaaccaacucacauauguugugaucgccauucuuaccguggucgcugccacaauggcgaaugagaugggcuuccuggaaaaaacgaagaaagauuuugggcugggaucuaucgccacccagcagcccgaguccaacauccucgacauugaccugcgcccugcuagcgccuggacacuuuacgcuguugccaccacauucaucacccccaugcugagacacuccauugagaauucuagcgugaacgugucccucacggcgaucgccaaucaggcuaccguccugaugggccuggggaagggauggccucucucuaagauggauauuggcgugccccuucuggccaucggguguuacagccaaguuaacccuauuacacugaccgcugcccuccugcuucugguggcucacuaugccaucaucggaccgggccuccaggcgaaagccacacgggaagcucagaagcgcgccgcugccggcauuaugaaaaaucccaccgucgacgggaucacggugauugaucuggacccuauccccuacgauccuaaguuugagaaacagcugggacaagucaugcuccuugugcugugcguuacacaggugcugaugaugagaaccacaugggcccucugugaagcgcugacccuugcuaccggccccauuuccacacugugggaggggaacccgggacgguucuggaauacgaccaucgccgucagcauggcuaacaucuuucgcggcucuuaucucgccggggccggacugcuguucuccauuaugaagaacacaaccaauacaagacggggcaccggcaacacgggggaaacacucggagagaaguggaaaaaucgccuuaacagccugggcaagucugaguuucagaucuacaaaagauccgggauucaagaaguggaccggacccuggcuaaggagggaaucaaaagaggcgaaaccgaucaucacgccguuagccgcgggucugcgaagcuccggugguucguggagagaaaucuggucacaccugagggaaaagugguggaccuuggcugcggccgcgggggauggagcuauuacuguggcgggcugaagaacguucgggaagucaagggacucaccaaaggcgggcccggacaugaggaacccauuccuauguccacauauggcuggaaucuggugagacugcagucuggcguggaugucuucuuuacgcccccugagaagugcgacacccuccuuugugauaucggggaaagcuccccgaaccccacaguugaggccggacgcacccugcgggugcugaaucucguggagaacuggcugaauaacaauacacaguucugcaucaaaguccuuaacccuuacaugcccagcgugauugaaaagauggagacccugcagagaaaauacggcggggcucucguucgcaauccucugucccggaacucuacgcacgaaauguauugggugagcaacgccuccggaaauaucgucucuagcgugaacaugauuuccagaaugcugaucaaucgcuuuaccaugcggcauaagaaggcuacauacgagcccgacguugaucucggcucugggaccagaaacauuggaaucgaaagcgagacaccgaaucuugacaucauuggcaaacgcaucgagaagauuaaacaagaacacgagaccuccuggcacuaugaccaggaucauccuuacaagacaugggccuaucacggcagcuacgaaaccaaacagacggggucugcguccagcauggugaacggagucgugagacugcugacaaagcccugggacgugaucccuauggucacccagauggccaugaccgauacaacgcccuucggccaacagcggguuuuuaaggagaaaguggacacccgcacacaggaaccuaaggaggggaccaaaaagcucaugaaaauuacagcugaguggcuguggaaggaacuuggaaagaaaaagacccccagaauguguacacgggaggaauucaccagaaaagugcggucuaaugccgcucugggcgccaucuuuacggaugagaacaaguggaaauccgcucgcgaggccgucgaagacagcagauucugggagcucguggauaaggaacggaaucugcaucuggaggggaaaugcgaaaccuguguuuauaacaugaugggaaagcgcgagaagaaaauuggcgaguuuggcaaggcgaaagggucuagagccaucugguacauguggcucggagcucgguuccuggaauuugaggcccuuggcuuccugaaugaagaccacugguuuucccgcgagaacagccucuccgggguggaaggagagggccugcacaagcuuggguacauccugagagaggucagcaaaaaggaaggcggagcuauguaugccgaugacacagccggcugggauacccggauuacacucgaggaccugaagaaugaagagauggugaccaaccauauggaaggggagcacaaaaagcuggcggaggcuaucuucaaacucacguaccagaauaagguugugcgcguccaaagaccgacaccucggggaaccgugauggacauuaucucucgcagagaucagcggggcagcgggcagguuggaacauauggccugaacaccuucacgaacaugggggcccaacuuauucgccagauggaaggcgagggaguguuuaaaggcauccagcaucugaccgccacagaagaggucgcugugcaggacuggcucgccagagucgggcgggagagacugucccgcauggcuaucucuggagaugacugcgugguuaagccccuugaugaccgguucgccagcgcgcugaccgcccucaaugauaugggcaagauuagaaaagacauccaacagugggaacccucccgcggguggaacgauuggacacaggugccuuuuugcucucaccauuuccacgagcugauuaugaaggacggacggguccugguggugccguguagaaaucaggaugaacucaucggccgcgcucggauuagccaaggggccggcuggucccugagagagaccgcuugccuuggaaaaucuuacgcccagauguggagccugauguauuuucaccgccgggaccucagacuggcggccaacgcuaucuguuccgccguucccagccauugggugccuacaucucgcaccacgugguccauccacgcucggcaugaauggaugacaaccgaggauaugcuuaccgucuggaauagaguguggauucaggagaaccccuggauggaagacaagacaccuguugagagcugggaagagauccccuaccugggcaaacgggaagaccaguggugcgggucucucauuggacugaccuccagagccacaugggcuaagaauauccaaacggccauuaaccaggugcgcagccugaucggcuccgaggaguauaccgauuacaugccuucuaugaagcgguucagacgcgaagaggaagaggcggggguccucugguga

SEQ ID NO: 20181 - RNA, 9876 nt, Artificial Sequence
  derived and/or modified CDS sequence (opt5) from DENV-2__JX470186__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuaccccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucgcucaccgccaaugguuucuggaucuuccgcugccuuggcuccccggcgccgacacccagggguccaacuggauucagaaagagacacuggucaccuucaagaauccucacgccaagaaacaggaugugguugugcugggaagccaagagggcgcuaugcauacggcgcucacaggggccaccgaaauccagauguccucuggcaaccugcuuuuuacaggacaccugaagugcagacuccggauggacaaacugcagcuuaagggcaugagcuauuccauguguaccgggaaauucaaggucgugaaggagauugcugaaacccaacauggaacaaucgucauuagagugcaguacgagggcgacgggagccccugcaaaauccccuucgagaucauggaucuggaaaagcgccacguucucggacggcugauuacggugaauccuaucgucaccgagaaagacucuccggugaacauugaagccgagcccccuuuuggcgauuccuacaucauuaucgggguugaacccggccagcugaagcucagcugguucaaaaagggaucuagcauuggccagauguuugagacaaccaugagaggggccaagcgcauggcuauccugggagacacagccugggauuucggcucccuugggggaguguuuaccucuaucggcaaagcgcugcaucaagucuucggggcuauuuauggcgccgccuuuagcggaguguccuggacgaugaagauccucauuggcgugguuaucacauggauugggaugaauagccggucuaccucccugagcgucucucuggugcuugugggagucgugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaaaugaaggaacggcaagauguguuuugugacagcaaacuuaugucugccgcgaucaaggacuccagagccguccacgcugauaugggcuacuggauugagagcgcccugaacgacaccuggaaaaucgaaaaggcuucuuucaucgaggugaagagcugccacuggccuaaaucccauacacucuggagcaacggcgugcuggagucugaaaugauuauccccaagaauuucgccgggccggucucccagcacaacuaucgcccuggauaccauacccagacggccggccccuggcaccuggggcggcuugagauggauuuugacuucugugaaggaacaaccguuguggugaccgaggauugcggcaauagagggcccagccuccggacaaccacggcuuccggaaaacugauuacagaauggugcugucgcucuugcacccugccuccgcucagauaccggggcgaggacggcuguugguaugggauggagaucagaccccugaaggaaaaagaggaaaaccuugucaauagccuggugacagcgggacauggccagauugauaacuuuucccucgggguucugggaauggcccuguuccuugaggaaaugcuccgcacccgggugggcacaaagcacgcuauccugcuggucgccgugucuuuuguuacccucauuacggggaauaugagcuucagagaccugggacgcgugauggucauggugggcgccaccaugacagaugacaucggcauggggguuaccuaccuugcucugcucgccgcguuuaaggugagaccuacauucgcugccggacugcugcuucggaaacugaccuccaaggagcucaugaugacgacaaucggcauuguccugcucucucaagccaccauccccgagacaauucuggaacuuaccgaugcucuggcccucgggaugauggugcugaaaaucgugcgcaacauggagaaguaucagcuggcggucaccauuauggcuauccuuugcguuccuaaugccgugauccugcagaacgccuggaaagugagcuguacaacgcucgcugucguguccguuagcccccugcuccugaccucuucccaacagaaggccgacuggauuccucuugcucugacaaucaagggacucaaucccaccgccauuuuucugacaacccugagcagaacgaacaaaaagcggucuuggccgcuuaaugaagcgaucauggccgugggcauggucuccauucuggcuagcucucuccugaaaaacgauaucccuaugacagggccccucguggccggaggccugcuuaccguuugcuacgugcugaccggccgcuccgcugaccuggagcucgaaagagccgccgacguccggugggaggagcaggcugaaaucagcggguccagcccuauucugucuaucacaauuagcgaggauggauccaugucuaucaagaaugaagaggaggaacagacccuuacaauucugauccgcacgggccuccugguggucagcgggcucuuccccguguccaccccgauuacagcggccgcuugguaucugugggagguuaaaaagcaaagagccggagugcuuugggacgucccuucucccccucccgugggcaaagccgaacuggaggauggggcuuaccggaucaagcagaagggaauccugggcuauagccagauuggcgccgggguuuacaaagaaggaaccuuucacacaauguggcaugugacccgcggcgcgguccucaugcacaaggggaaaagaaucgagcccuccugggcugacgugaagaaagaucugauuucuuacggaggcggguggaagcuugagggagaauggaaggagggcgaagaggugcagguucuggcccucgaaccuggcaaaaacccgcgggccguccaaacgaagcccgggcuguucaaaaccaacacaggaaccaucggcgcugugagccucgacuuuuccccugggacaagcggaucucccauuguggauaagaaaggcaaggucguggggcuguauggaaauggcguugugaccagauccggcacauacgucagcgccaucgcgcagacggagaagucuaucgaggacaacccugaaauugaggaugacaucuuccgcaaaaagcggcuuaccauuauggaucugcaucccggggcuggaaaaacaaagagauaucugccugccaucgugcgcgaagccauuaaacggggccucagaacccugauccuugcuccgacccgcguuguggccgcugagauggaagaggcccugcgggggcuccccaucagauaccagacaccugcgauucgcgccgagcacacgggacgggaaaucgucgaccugaugugucaugcuaccuucacaaugagacuccugucccccauucgggugccuaauuauaaccuuaucauuauggaugaggcccacuuuaccgaccccgcuagcaucgccgcccgcggcuacauuuccacaagaguugaaaugggggaggcugcgggcaucuucaugaccgccacgccgccuggaucucgggaccccuuuccccagagcaaugcuccuaucauggaugaggaacgcgagauucccgaaagauccuggaacagcggccacgagugggugacagacuucaaggggaagaccgucugguuugugccuucuaucaaagccggaaaugauauugccgcuugccugcggaagaacggcaaaaaggugauccaacuguccagaaaaaccuucgacagcgaauauauuaagacacgcaccaaugauugggacuuugucguuacaaccgauaucucugagaugggggccaacuucaaggcggagcgggugaucgacccgagacgcuguaugaaacccgugauucucacggauggagaagagcgggucauccuggcuggcccuaugcccgugacacauagcuccgccgcccagagacgcgggcggguuggcagaaauccuaagaacgaaaaugaccaguacauuuacaugggagagccccuugaaaacgaugaggacugcgcucacuggaaagaggccaagaugcugcucgacaauaucaacaccccggaaggcauuaucccuucuauguuugagcccgaacgcgagaaaguggaugcgaucgacggggaauauagacugcggggagaggcccgcaagacauucgucgaucugaugagacggggcgaccucccuguguggcuugcuuaccgcguugccgcugaggggauuaacuaugccgauagacggugguguuuugacggagugaaaaauaaccaaauccuggaagagaaugucgaaguggagauuuggaccaaggagggcgaaagaaagaaacugaagccccgcuggcucgaugcucggaucuacagcgacccucuggcccuuaaagaguucaaggaauucgcggccgggagaaaaucccugacgcucaaccugauuaccgagaugggccgccugcccacauuuaugacccagaaggcucggaaugcccucgauaaccuugcuguccugcauacagccgaagccggaggcagagcuuauaaucacgcgcugucugagcucccggagacccuggaaacacuucugcuccugacccugcucgccacggugacagggggaaucuuccuuuuucugaugagcggcaaggggauuggaaaaaugacccugggcaugugcugcaucaucaccgcuuccauucuccugugguacgcccagauccagccucacuggauugccgcuagcaucauucuugaguucuuucugaucguucuccugauccccgaacccgagaagcaacggacaccucaggacaaccagcugaccuauguggugauugccauccucacagucguugcggccacgauggcuaaugaaaugggcuuccuugagaaaaccaagaaagauuuugggcugggaucuauuacaacccagcaaccggagaacaauauccuggacauugaucuccgccccgccuccgcuuggacacuguacgccguggcgaccacguucaucaccccuaugcuuagacauagcaucgaaaacuccucugugaaugucagccugacagccauugcuaaccaggccaccgugcucaugggccuggggaagggauggccccuguccaagauggacaucggcguuccucuccuugcuauuggguguuacucucaggugaaucccaucacacugaccgccgcucugcuccugcuugucgcccacuaugcgauuaucggaccuggccugcaggccaaagcuacgcgggaggcccaaaagcgcgcugccgccggcauuaugaaaaacccgacaguggacgggaucaccgucaucgaucucgaccccauuccuuacgaucccaaguuugaaaaacagcugggacaggugaugcugcucguucuuugcgugacacagguccugaugaugagaaccaccugggcgcugugugaggcucucacacuggccacgggcccuaucagcacccuuugggaagggaaucccggacgguucuggaacacaaccauugcuguguccauggccaacaucuuucgcggcagcuaucuggccggggcuggacuccuguucucuauuaugaagaauacagccaacaccagacggggcacgggcaauacaggggagacccugggagagaaguggaaaaaccgccucaaugcgcuuggcaaguccgaauuucaaaucuacaaaaagagcgggauccaggagguugacagaacccuggccaaagaaggaauuaagcggggcgagacagaucaucacgcugugucuagaggguccgccaaacugcgcugguucgucgagcggaaccucgugaccccggaaggaaaggugguugaccugggcugcggcagagggggauggagcuauuacuguggcgggcuuaagaaugucaaagaggugaagggacugacaaaaggcgggccuggacaugaagagcccauccccaugucuacguauggcuggaaccucgugcgccugcagagcggcgucgauguuuucuuuaccccucccgaaaagugcgacacacugcucugugauauuggggaguccucuccuaauccgaccguggaggcuggacggacacuuagagugcugaaccuggucgaaaauuggcucaacaauaacacccaauucugcaucaaagugcugaaucccuacaugccuagcguuauugagaagauggaagcccuucagcgcaaguacggcggggcgcuggugcggaacccccucuccagaaacagcacgcacgagauguauugggucuccaaugccucuggaaacaucgugagcuccguuaauaugaucucucgcaugcugauuaaccgguuuaccaugagacacaaaaaggcuacauacgaaccugacguggaucugggcagcgggacccgcaauaucggaauugaguccgagacacccaaccucgacaucauuggcaaacggaucgaaaagaucaaacaggagcaugaaaccucuuggcacuaugaucaggaccauccguacaagacaugggccuaucacggcagcuacgagaccaagcaaacgggguccgcuagcucuauggucaauggaguggugagacuucugacaaaaccuugggacgucauucccaugguuacccagauggccaugaccgauacaacgccuuucggccagcagcgcguguuuaaggaaaaaguggacaccagaacacaagagcccaaggaggggaccaaaaagcugaugaagaucacagcugaauggcucuggaaagagcugggaaagaaaaagaccccucggauguguacacgcgaagaguucaccagaaaaguccgguccaacgccgcgcuuggcgccauuuuuacggaugagaauaaguggaaaagcgcuagagaagccguggaggacucuggguucugggaacugguugauaaggagcggaaccuccaccuggaaggaaagugcgagaccuguguguauaauaugaugggcaaacgcgagaagaaacugggcgaauuugggaaggcuaaaggauccagagccaucugguacauguggcucggcgcccgguuccuggaguuugaagcgcuuggguuccugaacgaggaccauugguuuagccgcgaaaauucucucuccggagucgagggcgaggggcugcacaagcuuggcuacauucugagagaugugagcaagaaagaaggaggcgcuauguaugccgacgauacagccgggugggacacccggaucacacucgaggaucugaagaacgaagagaugguuaccaaucauauggaaggagagcacaaaaagcuggcugaggccauuuucaaacucacguaccagaacaaggugguccgcgugcagagacccacaccgcggggcaccguuauggacaucaucucccgcagagaccagcgggggagcggacaaguggucacauauggccugaacaccuucacgaauauggaagcucagcuuauucgccagauggagggggaaggcguguuuaagucuauccaacagcugaccgucacagaggagauugccgugaaaaacuggcucguuagagugggacgggaacgccugagcagaauggcgaucuccggcgaugacugcgucgugaagccucuugaugaccgguucgccucugcucugaccgcccucaaugauauggggaaagugagaaaggacauucagcagugggagcccagccgcggauggaacgauuggacacaaguucccuuuugcucccaucacuuccacgaacugaucaugaaagacggccgggugcuggucgugccuuguagaaaucaggaugagcucaucgggcgcgcucggauuucucagggagccggcuggagccugagagaaaccgcgugccuugggaaguccuacgcccagauguggucucugauguauuuucaucgccgggaccucagacuggcugccaacgcuaucuguagcgccguuccgucccacugggugcccacaagccgcaccacguggucuauucaugcuacacacgaguggaugaccaccgaggauaugcuuacagucuggaaucggguguggauccaagaaaacccuuggauggaggacaagacccccgucgaauccugggaggaaauuccuuaccugggcaaaagagaggaucaguggugcggaagccucaucggccugacaucucgcgccacgugggcgaagaauauccagaccgccauuaaccaggugcggucccugaucgggaaugaggaauauacagacuacaugcccagcaugaaaagauuccggagagaggaagaggaagcuggaguucucugguga

SEQ ID NO: 20182 - RNA, 9876 nt, Artificial Sequence
  derived and/or modified CDS sequence (opt5) from DENV-2__KU517846__SS-prME
accgccggcaucauuaucaugaugauucccaccgugauggcuuuccaccugacgaccagaaacggggagccucauaugaucgucagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggaaucgugacccucuaccugggcguuauggugcaggccgacuccgggugugucgugagcuggaaaaacaaggagcugaaaugcggauccggcaucuucauuacagauaauguucacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucagcgagaacgaagucaaacugacaaucaugaccggagacauuaagggcaucaugcaggccgggaaacggucccugagaccucagcccacagagcuuaaguacagcuggaaagcguggggaaaggccaagaugcucucuaccgaacugcacaaucauacguuccugauugauggcccugagaccgcugaaugccccaacacaaaucgcgccuggaacucccucgagguggaggacuauggguuuggaguuuucaccacaaauaucuggcugaaacuuaaggaacggcaagauguguuuugugacagcaaacugaugucugcugccauuaaggacaacagagcgguccacgccgauaugggcuacuggaucgaguccgcucucaacgacaccuggaaaaucgaaaaggccagcuucauugaggugaagucuugccacuggccuaaaagccauacacugugguccaauggcgugcuggagagcgaaaugaucauucccaagaacuucgcugggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggccagcggaaaacugaucacagaauggugcugucgcuccugcacccucccuccgcugagauaccggggcgaggacggcuguugguaugggauggagauuagaccccuuaaggaaaaagaggaaaaucuggucaacucucucgugacagcuggacauggccagaucgauaauuuuagccuggggguucugggaauggcgcuuuuccucgaggaaaugcugcgcacccgggugggcacaaagcacgccauucugcucgucgcuguguccuuuaugacccugaucacggggaacaugucuuucagagaccuuggacgcguuauggugauggucggcgccaccaugacagaugacaucggcaugggggugaccuaccuggcccuccuggcugccuuuaagguuagaccuacauucgcggcuggacugcuucugcggaaacucaccagcaaggagcugaugaugacgacaauuggcaucgugcuccugucccaaucuaccauucccgagacaauccuugaacugaccgaugcccucgcccuggggaugaugguccugaaaauugugcgcaauauggagaaguaucagcuugcugugaccaucauggccauccugugcgucccuaacgcgguuauucuccagaaugcuuggaaagugagcuguacaauccuggccguggucuccgugagcccccuccugcuuacgucuucccaacagaaggccgacuggauuccucuggcucucaccaucaagggacugaaccccacagccauuuuucugaccacacuuagcagaaccucuaaaaagcgguccuggccgcugaaugaagcuaucauggccguuggcauggugagcauccucgcgucuucccugcucaaaaacgauauuccuaugacggggccccuggucgccggaggccuucugacagugugcuacguucugaccggccgcagcgcugaccucgagcuggaaagagccgcugacgugcggugggaggagcaggccgaaaucuccgggagcucuccuauucuuagcaucaccauuuccgaggauggaucuaugagcaucaagaaugaagaggaggaacugacacucaccauucugauccgcacaggccuccuggucaucuccgggcuuuuccccgugucuauuccgaucacggccgcugcgugguaucugugggaggucaaaaagcagagagccggagugcugugggacguuccuucucccccucccgugggcaaagcugaacucgaggauggggccuaccggauuaagcaaaagggaauccugggcuauucccagauuggcgccggggucuacaaagaaggaaccuuucacacaauguggcaugugacccgcggcgcuguucuuaugcacaaggggaaaagaaucgagcccuccugggccgacgugaagaaagaucugaucagcuacggaggcggguggaagcucgagggagaauggaaggagggcgaagagguccaggugcuggcgcucgaaccuggcaaaaacccgcgggcugugcagacaaagcccgggcuguucaaaaccaacacgggaaccauuggcgccguuucccuugacuuuagcccugggacaucuggaucccccaucgucgauaagaaaggcaaggugguggggcuguauggaaauggcgucgugaccagaagcggcacauacguuucugccauugcucaaaccgagaaguccaucgaggacaacccugaaauugaggaugacaucuuccgcaaaaagcggcugacaaucauggaucuccaucccggggccggaaaaacgaagagauaucugccugcgauugugcgcgaagcuaucaaacggggccuuagaacccugauucucgccccgacacgcgucguggccgcugagauggaagaggcccugcgggggcuccccaucagauaccagaccccugcuauucgcgccgagcacaccggacgggaaaucguugaccugaugugucaugcgacauucacgaugagacuucugagccccauucgggugccuaauuauaaccugaucaucauggaugaggcccacuuuaccgaccccgcuuccauugccgcucgcggcuacaucucuacaagagucgaaaugggggaggccgccggcauuuucaugaccgcuacaccgccuggaagccgggaccccuuuccccaguccaaugcgccuaucauggaugaggaacgcgagauucccgaaagaagcuggaacucuggccacgagugggugaccgacuucaaggggaagacgguuugguuugugccuuccaucaaagccggaaaugauaucgcugccugccuccggaagaacggcaaaaaggucauucagcugagcagaaaaacauucgacucugaauauaucaagacccgcaccaaugauugggacuuuguggugacaaccgauauuagcgagaugggggccaacuucaaggcugagcgggucaucgacccgagacgcuguaugaaacccguuauucuuacagauggagaagaacgggugauccuggccggcccuaugcccgugacccauuccucugcggcucaaagacgcgggcgggucggcagaaauccuaagaacgaaaaugaccaguacaucuacaugggagagccccucgaaaacgaugaggacugcgcccacuggaaagaggccaagaugcugcuggacaauauuaacacgccggaaggcaucauuccuagcauguuugagcccgaacgcgagaaaguggaugcuaucgacggggaauauagacuccggggagaggcccgcaagacauucguugaucuuaugagacggggcgaccugccuguguggcuggcguaccgcgucgccgcugaggggauuaacuaugccgauagacggugguguuuugacggagugaaaaauaaccagauccucgaagagaauguugaaguggagauuuggaccaaggagggcgaaagaaagaaacugaagccccgcuggcuugaugcucggaucuacuccgacccucuggcccucaaagaguucaaggaguucgcugccgggagaaaaucucugacacugaaccucaucaccgagaugggccgccuucccacguuuaugacccaaaaggcgcggaaugcccuggauaaccuggcuguccuccauacagccgaagcuggaggcagagccuauaaucacgcccugagcgagcuuccggagacccuggaaacacuccugcugcucacccuucuggcuacagugaccgggggaauuuuccuguuucucauguccggcaaggggaucggaaaaaugacgcugggcaugugcugcauuaucacagcgagcauucuucugugguacgcccagauccagccucacuggaucgcugccucuauuauccucgaguucuuucugauuguccugcucauccccgaacccgagaagcagcggaccccucaagacaaccagcuuaccuaugugguuauugccauccugacagugguggcugccaccauggcgaaugaaaugggcuuccuggagaaaacaaagaaagauuuugggcucggauccaucacgacccagcagccggagagcaacauucuggacaucgaucuucgccccgccuccgcuuggacacuguacgccgucgcuaccacauucauuaccccuaugcucagacauucuaucgaaaauagcuccguuaacgugucucugacggccauugcgaaucaagccaccgugcugaugggccucgggaagggauggccccuuagcaagauggacaucggcgucccucugcuggcuauuggguguuacucccaggugaaccccaucacacucaccgccgcucugcuucugcucguugcccacuaugcuaucauuggaccuggccugcaggccaaagcgacacgggaggcccagaagcgcgcugccgcuggcaucaugaaaaauccgaccguggacgggauuacggucaucgaucuggaccccauuccuuacgaucccaaguuugaaaaacaacucggacaggugaugcuucugguccugugcgugacacagguucucaugaugagaaccacaugggcccugugugaggcccuuacccuggcgaccggcccuaucagcacacucugggaagggaaccccggacgguucuggaauacgaccaucgcugugucuauggccaacauuuuucgcggcuccuaucuggcuggggccggacuccuguucagcaucaugaagaacacagccaauaccagacggggcacaggcaacaccggggagacgcuuggagagaaguggaaaaaucgccugaacgcucugggcaagucugaauuucagauuuacaaaaaguccgggauccaagaggucgacagaacacucgccaaagaaggaauuaagcggggcgagaccgaucaucacgcggugagcagagggucugccaaacugcgcugguucguugagcggaaucuugugaccccggaaggaaaggucguggaccugggcugcggcagagggggauggagcuauuacuguggcgggcucaagaacgugaaagagguuaagggacugacaaaaggcgggccuggacaugaggaacccauccccauguccaccuauggcuggaaucugguccgccuccagucuggcguggauguguucuuuacaccucccgaaaagugcgacacgcuucugugugauaucggggagagcuccccuaacccgaccgucgaggcuggacggacacugagaguucucaaucugguggaaaacuggcuuaauaacaauacccaguucugcauuaaagugcugagccccuacaugccuuccgucaucgagaagauggaagcccuccaacgcaaguacggcggggcucuggugcggaacccccugucuagaaauagcacacacgagauguauuggguuuccaacgccucuggaaacauugugagcuccgucaauaugaucucucgcaugcucauuaaccgguuuaccaugagacacaaaaaggcgacguacgaaccugacguggaucuuggcagcgggacccgcaauaucggaaucgaguccgagacacccaaccuggacauuaucggcaaacggauugaaaagaucaaacaggagcaugaaaccagcuggcacuaugaucaggaccauccguacaagacaugggccuaucacggcucuuacgagaccaagcagacaggguccgcuagcucuaugguuaauggaguggucagacugcucaccaaaccuugggacgugauucccauggugacgcaaauggccaugacagauaccaccccuuucggccagcagcgcgucuuuaaggaaaaaguugacacaagaacgcaggagcccaaggaggggaccaaaaagcugaugaagaucacagcugaauggcuuuggaaagagcugggaaagaaaaagaccccucggauguguacacgcgaagaguucaccagaaaagugcgguccaacgccgcucucggcgccauuuuuacagaugagaauaaguggaaaagcgcgagagaagccguggaggacucuggguucugggaacuggucgauaaggagcggaaccugcaccucgaaggaaagugcgagaccuguguguauaauaugaugggcaaacgcgagaagaaacugggcgaauuugggaaggcuaaaggauccagagccaucugguacauguggcuuggcgcucgguuccuggaguuugaagcccucggguuccugaacgaggaccauugguuuagccgcgaaaauucccuuagcggaguugagggcgaggggcugcacaagcucggcuacauccugagagaugugucuaagaaagaaggaggcgccauguaugcggacgauacggcugggugggacacccggauuacacuggaggaucucaagaacgaagagauggucaccaaucauauggaaggagagcacaaaaagcuggccgaggccaucuuccgccuuacauaccaaaacaaagugguuagagugcagcggcccaccccgcgcggcacggucauggacauuaucagcagacgggaccagcgcggguccggacaggugguuacauauggccugaauaccuucacaaacauggaagcucaacucauuagacagauggagggggaaggcguguuuaagucuauccagcaucugaccgucacggaggagaucgccgugaagaacuggcuugaacgggucggacgcgagagacugagccggauggcuauuuccggcgaugacugcgugguuaaaccucucgaugacagauucgccucugcgcugaccgcccugaaugauauggggaagauccgcaaagacauucaacagugggaacccagccggggauggaacgauuggacacaggugcccuuuugcucccaccacuuccaugagcucaucaugaaggacggcagaguccugguggugccuugucgcaaucaggaugaacuuauugggcgggcuagaaucucucaaggagccggcuggagccugcgcgagaccgcuugccucgggaaauccuacgcccagauguggagccugauguauuuucaccggagagaccuucgccuggcggccaacgcuaucuguucugccguuccgucccauugggugcccacaagccggaccacauggucuauucacgcuacccacgaguggaugacgacagaagauaugcucaccgucuggaauagaguguggauccaggagaacccuuggauggaagacaagacccccguugaguccugggaagagauuccuuaccugggcaagcgcgaggaucaguggugcggaagccugaucggccucacaucccgggccaccugggcuaaaaauauucaaacagccaucaaccaggugagaucucugauugggaaugaagaguauacggacuacaugcccagcaugaagcgguucagacgcgaagaggaagaggcgggaguccuuugguga

SEQ ID NO: 20183 - RNA, 9876 nt, Artificial Sequence
  derived and/or modified CDS sequence (opt5) from DENV-2__KJ830750__SS-prME
accgccggcgugaucauuaugcugauccccaccgcuauggccuuccaccucacgaccagaaacggggagccucauaugauugucagcaagcaggaaaaaggaaagucccugcuuuuuaaaaccgaggacggcguuaauaugugcacccugauggcgauggaucucggggaacugugugaggacacaaucaccuacaacugcccccuucugcggcaaaaugaacccgaggauauugacuguuggugcaacucuacaagcaccugggugacguauggaaccuguacagcuaccggcgagcaccgcagagaaaagcgguccguggcccucgucccucauguggggaugggacuggagacacgcaccgaaacguggaugucuagcgagggcgccuggaaacacgcucagagaaucgagacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggauuuugucgaaggcgugagcgggggauccuggguugacaucgugcucgagcacggcagcugugucaccacaauggcuaagaacaagcccacccuggauuucgaacuuaucaaaacagaggccaagcagccugcuacccugcgcaaauacugcauugaagccaagcucacgaauacaaccaccgcgucuagauguccgacacaaggggagcccucccugaacgaggaacaggacaaacgguuugugugcaagcacagcaugguggaucgcggauggggcaauggcugugggcuguucggaaagggcgggaucgugacaugcgccauguuuacaugcaaaaagaacauggagggaaaaauuguucagccugaaaaucucgaguauacgaucguggugacaccccauucuggcgaagagaacgcugucgggaaugacacaggaaagcacggcaaagagauuaaggugaccccucaguccagcaucacagaagccgagcugaccggcuacgggacgguuaccauggaauguucucccagaacaggacuugauuucaacgagauggugcugcuccaaauggaaaauaaggcuuggcugguccaucggcagugguuucuugaccugccgcucccuuggcugcccggcgccgauauccagggguccaacuggauucagaaggagacccuggugacauucaagaacccucacgccaaaaagcaagacguugugguccucggaagccaggagggcgcuaugcacaccgcgcugacgggggccacagaaauccagauguccucuggcaaucuucuguuuaccggacaucucaaaugccgccugagaauggacaaacuucaacugaaaggcaugagcuauuccauguguacagggaaguucaagguggucaaagagauugcugaaacccagcacggaaccaucgugguucgggugcaguacgagggcgaugggagccccugcaagauucccuucgagaucauggaccucgagaagagacauguccugggacgccugaucacagugaacccuauuguuacgggcaaggauucuccggugaauaucgaggccgaacccccuuuuggggacuccuacauuaucauuggcgucgagcccggacagcucaaacugagcugguucaagaagggcucuagcaucgggcaaauguuugaaaccacaaugcggggagccaaaagaauggcuauucuuggcgauaccgccugggacuucgggucccugggaggcguguuuacaucuaucgggaaggcgcuccaccagguguucggcgcuaucuauggagccgccuuuagcggcguuuccuggaccaugaaaauucugaucggggucgugauuacguggaucggaaugaacagccgcucuacaucccugagcgugucucuuguccucgugggcguugugacccuguaccugggggucauggugcaggcugauuccggauguguugugagcuggaagaauaaagagcucaagugcggcuccgggauuuucaucaccgacaacguccauacauggaccgagcaguauaaguuucaaccugaaucucccagcaaacuggccuccgcuauccagaaggcccacgaggaaggcauuuguggaauccggucugugacaagacuugagaaucugauguggaaacagauuacgccggaacucaaccacauccugagcgagaaugagguuaagcuguccauuaugaccggcgauaucaaagggaucaugcaggcgggaaagcgcagccuucggccucaacccacagaacucaaauacucuuggaagaccuggggcaaggccaaaaugcuguccacagagccucauaaccagaccuuccugauugacgggcccgaaacggcugagugcccuaauaccaacagagccuggaauagccucgaaguggaggauuauggauuuggcgucuucacaaccaacaucuggcugaaacuuaaagagcgccaggacgugucuugugacuccaagcugaugagcgcugccauuaaagauaaucgggcggugcacgccgacaugggcuacuggaucgaaucugcucucaacgauacauggaagauugagaaggccagcuuuaucgaagucaaauccugccauuggcccaagagccacacccuguggucuaacgggguucuggaguccgagaugaucauuccgaaaaauuucgcuggaccugugagccagcacaacuauagacccggcuaccauacacaaaccgccgggcccuggcaccuuggaaagcucgaaauggacuucgauuuuugugagggcacgacaguggucgugaccgaagacugcgggaaucgcggaccuucccugcggaccacaaccgccucuggcaaacugaucacggaguggugcuguagaagcugcacacucccgccccugcgguaccgcggcgaagauggguguugguauggaauggagauuagaccucuuaaggagaaggaagagaaccugguuaauucccucgugaccgcuggccaugggcagaucgacaacuucucucugggaguccugggcauggcgcuuuuucucgaagagaugcugcggacaagaguggggaccaaacacgccguucugcucguggcugucagcuucaugacacugauuaccggaaauauguccuuucgcgaucuuggccgggugaugguuauggugggcgccgccaugacggacgauaucgggaugggagucaccuaccuggcucuccuggccgcguucaaggugagacccacauuugcugccggccugcuucugcgcaaacucaccucuaaggaacugaugaugacaaccauugggaucgugcuccugagccaguccacgacaccugagagcauccuugagcugaccgacgcccucgcucugggaaugaugauucugaaaaucgucagaaacauggaaaaguaucaacuugccguuacaauuauggcgauccugugcgugcccaaugcugugauucuccagaacgccuggaaggucucuuguaccauccuggccgcuguguccguuagcccucuccugcuuaccucuucccagcagaaagccgauuggaucccccuggcucucacaauuaagggccugaauccgacggccaucuuccugaccacacuuagccggaccaacaaaaagcgcucuuggccucugaaugaggcgauuauggccguggggauggucuccauccucgcuagcucccugcucaaaaacgacauucccaugacaggaccucugguggccggcggccuucugaccguuugcuacgugcugacggggagaagcgcugaccucgaacuggagaaggccgccgauguccggugggaagaccaagcugagaucucuggaagcucccccauccuuucuauuacaaucagcgaggauggcuccaugucuauuaaaaaugaagaggaagaacagacccugaccauccucauucgcacagggcugcucgugaucagcggacuguuuccggucuccauuccuaucaccgcggccgcuugguaucuuugggaggugaagaagcagagagccggcguucugugggacgugcccucuccuccgcccgucgggaaagccgaacuggaggauggagcuuaccggaucaagcagaaaggcauucucggcuauagccaaaucggggccggaguguacaaggaaggcacauuccauacgauguggcacguuacccgcggggcggugcugaugcacaaaggaaagagaauugagccuuccugggcugacguccggaaggaucuuaucagcuacggcgggggauggaaacuggaaggcgaguggaaggagggcgaagagguccaggugcucgcccuggaaccggggaaaaacccccgcgccguucagacaaagccuggacucuuuaaaaccaacacaggcaccauuggggcugucucucuggacuucucccccggaacgagcggcucuccuaucguggauaagaaggggaaaguggucggacuuuauggcaauggcgugguuaccagauccgggacauacgugagcgccaucgcgcagaccgagaaguccauugaagacaaccccgagaucgaggaugacauuuuucggaaaaagagacugacaaucauggaucugcauccuggagcuggcaaaaccaagcgcuaucucccggccauuguccgggaagccaucaagagagggcugcgcacacuuauccuggcucccacgcgggugguugccgcugagauggaagaggcccucagaggacugccuauucgcuaccaaacccccgcgauccgggccgaacacacaggcagagagauuguggaccucaugugucaugcuaccuucaccaugcgccugcuuucuccuguccgggugcccaauuauaaccugaucauuauggacgaggcccacuucacagauccggcuagcaucgccgccagaggguacauuuccacgcggguugaaaugggcgaggcugcgggaaucuuuaugaccgccacaccucccggcagccgcgaccccuucccucagucuaaugcucccaucauggaugaagagagagagauuccugaacgguccuggaacagcgggcaugagugggugaccgacuuuaaaggaaagacagucugguucgugccgucuaucaaagccggcaaugauauugccgcuugccugcgcaagaacgggaaaaaggugauccagcucagcagaaagaccuuugacuccgaauauauuaaaacgcggacaaaugauugggacuucgucguuaccaccgauaucucugagaugggagccaacuuuaaggcggaaagagugaucgacccccgccgguguaugaaaccugugauucugacagauggcgaggagagagucauccuugcugggcccaugccugugacccacagcuccgccgcccaacgccggggcagaauuggacgcaaucccaagaacgaaaaugaccaguacaucuacaugggcgagccgcuggaaaacgacgaggauugcgcucacuggaaagaagccaagaugcuccuggacaauauuaacacaccugaggggaucauccccucuauguucgagccugaacgggagaaaguugaugcgauugacggagaauauagacugcgcggcgaggccagaaagaccuuuguggaucucaugcggcgcggggaccuucccgucuggcuggcuuacagaguggccgcugaaggaaucaacuaugccgaucggcgcugguguuucgacggcauuaagaauaaccagauccuggaggagaauguugaaguggagauuuggacgaaagaaggggagagaaagaaacucaagccucgguggcuggaugcuagaaucuacagcgacccccuugcccugaaagaguuuaaggaguucgcggccggccgcaagucccucacacugaaccugauuaccgagaugggacggcucccgacauucaugacccagaaagcuagaaaugcccuugauaaccuggcuguccugcauacggccgaagccggcgggcgcgcuuauaaucacgcgcucagcgagcugccugaaacccuugagacacugcuccugcugacccuccuugccacagugaccggaggcaucuuucuguuccugaugucugggaagggaaucggcaaaaugacacucggcaugugcugcauuaucaccgcuuccauucugcuuugguacgcccaaauccagccccauuggauugccgcuagcaucauccuggaguuuuuccucauuguccugcugauccccgaaccugagaagcagcggacgccgcaggacaaccaacucacauaugugguuauugccauccuuaccgugguggcggccaccauggcuaaugaaaugggguuucuggagaaaacaaagaaggauuucggacugggcuccauugccauccagcagcccgaaucuaacauccucgacauugaccugagaccugcuagcgccuggacccuuuacgcggucgccacaacguuuaucacccccaugcugcggcacuccauugaaaauucuagcguuaacgugucccucacagcuaucgccaaucaggcuaccgugcugauggggcugggaaaaggcuggccucucagcaagauggauauuggggucccccuucuggccaucggauguuacucucaagugaacccuauuacacugaccgcugcccuccugcuucugguugcgcacuaugccaucaucggcccgggccuccaggcuaaagccacgcgcgaggcucagaagagagccgccgcggggauuaugaaaaaucccaccguggacggagucacagugaucgaucuggacccuauucccuacgauccuaaguucgaaaagcagcugggccaagucaugcuccuugugcugugcguuacccaggugcugaugaugcggacaaccugggcucucugugaggcccugacgcuugcuacagggcccaucuccacccugugggaaggaaacccgggccgcuuuuggaauacaaccauugccgucagcauggccaacaucuucagagggucuuaucucgcuggagccggccugcuguuuuccaucaugaaaaacaccacaaauacgcggcgcggcaccgggaacacaggagagacccucggcgaaaaguggaaaaauagacuuaacagccuggggaagucugaguuccagauuuacaaacggagcggaauccaagagguggaccgcacacuggcgaaggaaggcauuaaaagaggggagaccgaucaucacgccguuucccggggaucugcuaagcucagaugguuuguggaacgcaaucuggucacgccugagggcaaggugguggaccuuggcugcgggcggggaggcuggagcuauuacugugggggacugaaaaacguuagagaggucaagggccucacaaaagggggacccggccaugaggaacccaucccuauguccaccuauggcuggaaucuggugcgccugcagagcgggguggaugucuucuucacacccccugaaaagugcgacacccuccuuugugauauuggagaguccucuccgaaccccaccguugaagccggccggacacugagagugcugaaucucguggagaacuggcugaauaacaauacgcaguuuugcaucaaaguccuuaacccuuacaugcccagcgugaucgagaagauggaaacccugcagcgcaaguacgggggagcucucguucggaauccucuguccagaaacucuacacacgagauguauugggugagcaacgccuccggcaauauugucucuagcgugaacaugaucucccgcaugcugauuaaucgguucaccaugagacauaaaaaggcgacauacgaacccgacguugaucucgggagcggaacccgcaacaucggcauugagucugaaacgccgaaucuugacaucaucggcaaacggauugagaagaucaaacaagagcacgaaaccuccuggcacuaugaccaggaucauccuuacaagacaugggccuaucacgggagcuacgagaccaagcagacaggaucugcuuccagcauggugaacggcgucgugagacugcugaccaaacccugggacgugauuccuauggucacacagauggccaugaccgauacgacacccuuugggcaacagcgcguuuucaaggaaaaaguggacaccagaacccaggagccuaaggaaggaaccaagaagcucaugaagaucacggcugaguggcuguggaaagagcuuggcaagaaaaagacaccccggauguguacacgcgaagaguuugccagaaaagugcggucuaaugcugcccugggggcgauuuucaccgaugaaaacaaguggaaauccgccagagaggcugucgaggacagccgguuuugggaacucguggauaaggagcgcaaucugcaucuggaaggaaagugcgagacauguguuuauaacaugaugggcaaaagagaaaagaaaaucggcgaguucgggaaggccaaaggaucccgggcuauuugguacauguggcucggcgcccgcuuucuggaguucgaagcccuuggguuucugaaugaggaccacugguucagcagagaaaacucucucagcggaguggagggcgaagggcugcacaaacuuggcuacauccugcgggaggucuccaagaaagagggaggcgcgauguaugcugaugacaccgccgggugggauacacgcaucacccucgaagaccugaagaaugaggaaauggugacgaaccauauggagggagaacacaaaaagcuggccgaggcuauuuuuaaacucaccuaccagaauaagguugugagaguccaacggccgacaccucgcggcaccgugauggacaucauuucuagacgggaucagcgcgggagcggacagguuggcacauaugggcugaacaccuucacgaacaugggcgcccaacuuaucagacagauggagggagaaggcguguucaaggggauucagcaucugacagcuaccgaggaagucgccgugcaggacuggcucgcgcgggucggacgcgagagacugucccggauggccaucucuggcgaugacugcgugguuaaaccccuugaugacagauuugcuagcgcccugacagcucucaaugauauggggaaggugcgcaaagacauccaacagugggagcccucccggggauggaacgauuggacccaggucccuuucugcucucaccauuuucacgaacugauuaugaaggacggcagagugcuggugguuccgugucgcaaucaggaugagcucaucgggcgggccagaauuagccaaggcgcgggauggucccugcgcgaaacggccugccuuggcaaaagcuacgcucagauguggucucugauguauuuccaccggagagaccuccgccuggccgcuaacgccaucuguuccgcugugcccagccauugggucccuaccucucggacaaccugguccauucacgccgggcaugaguggaugacaaccgaagauaugcuuacaguguggaauagaguuuggauccaggagaaccccuggauggaggacaagaccccuguggaaagcugggaggaaauccccuaccugggaaagcgcgaggaccaguggugcggcucccucauugggcugacgucucgggcgacaugggccagaaauauccaaaccgcuauuaaccagguccggagccugaucggauccgaagaguauaccgauuacaugccuagcaugaaaagauuucgccgggaggaagaggaagccggcgugcucugguga

SEQ ID NO: 20184 - RNA, 9876 nt, Artificial Sequence
  derived and/or modified CDS sequence (opt5) from DENV-2__FM210231__SS-prME
agcgccggcaugaucauuaugcugauccccaccgugauggcuuuccaccugacaacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcgguggugcugcagaaugcuuggaaggucuccuguaccauccucgccgugguuucugugagcccccugcuucugaccuccagccagcagaagaccgacuggauuccucucgcccugacgaucaagggacugaaccccaccgcuauuuuccuuacaacccugucucgcacaaauaaaaagagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauucugaucagaacaggccuccuggucaucuccgggcuuuuucccauuucuaucccgauuacggcugccgccugguaccugugggaggugaaaaagcagcgggcuggaguucugugggaugugccuucucccccucccaugggcaaagcggaacucgaggacggggccuaucgcaucaagcaaaagggcauucugggauacucccagaucggcgcuggggucuacaaagaaggaaccuuccacacaauguggcaugugaccagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccgugcagacaaagcccgggcuguuuaaaaccaacacgggaaccaucggcgcgguuucccuugauuucucuccugggacaagcggaucccccauuaucgacaagaaaggcaaggucguggggcuguacggaaacggcguggucaccagaagcggcgcuuaugugucugccauugcccaaacagagaaguccaucgaggauaauccugaaaucgaggacgauauuuuucggaaacgcagacugaccaucauggaccuccaccccggggcuggaaagacaaaacgguaccugccugccauuguuagagaagcgaucaagcgcggccuucggacgcugauucucgcuccgaccagaguggucgccgccgagauggaagaggcucugcgcgggcuccccauccgguaucagaccccugccauuaaagcugagcauaccggaagagaaaucguggaccugaugugucacgccaccuucacaaugcgccuucugagccccguucgggugccuaacuacaaucugaucauuauggaugaggcgcauuucacggaccccgccucuaucgcugccagaggcuauauuuccacccgcgucgaaaugggggaggcugccggcaucuuuaugacagccaccccgccuggaagccgggaucccuucccccaguccaacgcuccuauuaucgacgaggaaagagagauccccgaacggucuuggaauagcggccacgagugggugacagauuuuaaggggaagaccguuugguucgugccuuccauuaaagcgggaaacgacaucgccgcuugccuccgcaagaauggcaaaaaggucauucaacugagcagaaaaacguuugauucugaauacgugaagacacggaccaacgacugggauuucguggucaccacagacaucuccgagaugggggccaauuuuaaagccgagcgcguuauugauccgagacgguguaugaagcccgugauccuuaccgacggagaagagagagugauccuggcuggcccuaugcccgucacacauagcucugccgcgcagcgccgggggagaauuggccgcaacccuaagaaugaaaacgaccaguacaucuauaugggagagccccucgaaaaugaugaggacugcgcucacuggaaagaggccaagaugcugcuggauaacauuaauaccccggaaggcaucauuccuagcauguucgagcccgaacgggagaaaguggacgccaucgauggggaauacagacuccgcggagaggcucggaagacguuuguugaccuuaugagacgcggcgaucugccuguguggcuggccuauaaagucgcggccgaggggauuaacuacgcugacagacggugguguuucgauggaaucaagaacaaucagauccucgaagagaacguggaaguugagauuuggacaaaggagggcgaacgcaaaaagcugaaacccagauggcuugacgcccggaucuauuccgauccucuggcucucaaggaguuuaaagaguucgccgcugggcgcaagucucugacccugaaucucauuacagagaugggcagacuucccaccuucaugacgcaaaagacccgggacgcccuggauaaccuggcggugcuccacacagccgaagcuggaggcagagccuacaaucaugcucugagcgagcuuccggagacccuggaaacacuccugcugcucacccuucuggccacagucaccgggggaaucuuucuguuccucauguccggccgcgggauuggaaaaaugacgcugggcaugugcugcaucaucacagccucuauucuucugugguaugcucagauccagccucacuggauugcggccagcaucauucucgaguuuuuccugaucgugcugcucauccccgaacccgagaagcagcggaccccucaagacaaccagcuuaccuacgucgugauugcuauccugacaguuguggccgccaccauggcuaaugaaaugggcuuucuggagaaaacaaagaaagaccucgggcugggauccauugugacgcagcagccggagagcaacauccuugauauugaccugagacccgccucugcguggacccucuacgccgucgcuacaaccuucguuacaccuaugcugcgccauuccaucgaaaauagcuccgugaacgugucucugaccgccauugcuaaucaagccacgguccucaugggccuugggaagggauggccccugagcaagauggauaucggcgugccucugcucgcgaucggguguuauucccagguuaaccccauuacccugacagccgcccuucugcuccugguggcccacuacgcuaucauuggaccuggccugcaggccaaagcuacccgggaggcccagaagagagcggccgcuggcaucaugaaaaauccgacagucgacgggauuaccgugaucgaucucgaccccaucccuuaugaucccaaguuugaaaaacaacuuggacaggucaugcugcugauucucugcgugacgcagguucugaugaugcggacaaccugggcccuuugugaggcucugacacucgccaccggcccuaucucuacccugugggaagggaaccccggacgcuucuggaauacaacgauugccgugagcauggcgaacaucuuuagaggcuccuaccuggcuggggccggacuccuuuucagcauuaugaagaauaccacaaacacccggcgcggcacaggcaacaucggggagacccugggagagaaauggaagucuagacugaaugcucucggcaaguccgaauuucaaaucuauaaaaagagcgggauucaggaggucgaccggacgcuggccaaagaaggaaucaagcgcggcgagacagaucaccaugccgugucuagaggguccgcuaaacuucggugguucguugagcgcaacauggugaccccggaaggaaaggucguggaccugggcugcggcagagggggauggagcuacuauuguggcgggcucaagucugugcgggagguuaaaggacugaccaagggcgggccuggacacgaagaacccauucccaugagcacauacggcuggaaucuggucagacuccaguccggcguggauguguuuuucaucccucccgaaaaaugcgacacccuucugugugauauuggggagucuagcccuaacccgacagucgaggccggacgcacgcugcggguucucaaucugguggaaaacuggcuuaauaacaauacccaguucugcaucaaggugcugaaccccuacaugccuuccgucaucgagaaaauggaagcgcuccaaagaaaguauggcggggcccuggugcgcaauccccugagccggaacuccacacaugagauguacuggguuucuaaugcuagcggaaacauuguguccucugucaauaugaucagcagaaugcucauuaaccgcuuuaccaugcggcacaagaaagccacauaugaaccugacguggaccuuggcuccgggaccagaaacaucggaauugagucugagauccccaaucuggauauuaucggcaagcgcaucgagaaaauuaagcaggagcaugaaacgagcuggcacuacgaccaggaucacccguauaaaaccugggcuuaccauggcuccuaugagacaaagcagaccgggagcgccucuuccaugguuaacggagugguccggcugcucacaaagccuugggacgugcugcccaccgugacacaaauggcgaugaccgauacgacaccuuucggccagcagagagucuuuaaagaaaagguugacacccgcacccaggagcccaaagaggggacaaagaaacuuaugaagaucacggccgaauggcuguggaaagagcucggaaagaagaaaaccccucggauguguacaagagaagaguucacccgcaaggugagaagcaaugcugcccugggcgcuauuuuuacagaugagaacaaauggaagucugcccgggaagcuguggaggacucccgcuucugggaacuggucgauaaagagagaaaucuccaccuggaagggaagugcgagaccuguguguacaacaugaugggaaagcgggagaagaaacuuggcgaauuuggcaaagccaaagggagcagagcgaucugguacauguggcugggagcccgguuccucgaguuugaagcucugggcuuccuuaaugaggaccauugguuuucucgcgaaaacucccugagcgggguugagggagagggccuccacaaacugggguauauucugagagauguguccaagaaggaaggcggagccauguacgcugacgacacagccggcugggauacccggaucacgcucgaggaccugaaaaaugaagagauggucaccaaccacauggaaggggagcauaagaaacuugccgaggcgaucuucaagcugacauaucaaaauaaagugguucgcgugcagagacccaccccgcggggaacagucauggauauuaucagccgcagagaccagcggggcucugggcaagugggaaccuacggccucaacacguuuacaaauauggaagcucagcugauucgccagauggagggggaaggcguuuucaagaacauccagcaccuuaccgugacagaggaggucgccgugcaaaauuggcuggccagagucggacgggaacgccucagcagaauggcuauuuccggcgaugacugcgugguuaagccucuggaugaccgguucgccaacgcucugaccgcccucaacgauauggggaaaauccgcaaggacauccagcagugggagcccucuaaaggauggaaugauuggacgcagguccccuuuugcagccaucacuuccaugaacugauuaugaaggacggcagaguccuuguggugccuugucggaaccaagaugagcugaucgggagagcgcgcauuucccagggagccggcuggucucuccgggaaaccgcuugccuggggaaaagcuaugcccagauguggucccuuauguacuuucacagacgcgaccugcggcucgcugccaaugcgaucuguucugccguuccgagccacugggugcccacauccagaaccacauggagcauucaugcuaagcacgaguggaugaccacagaggacaugcugaccgucuggaaccgcguguggauccgggaaaauccuuggauggaggauaagacgcccguugaaucuugggaggaaauuccuuaucugggcaaaagagaggaccaguggugcggaucccucaucggccugacaagccgcgccaccugggcuaagaacauccaagccgcuauuaaucaggugcggucucuuaucgggaacgaggaauacaccgauuacaugcccuccaugaaaagauuccgccgggaggaagaggaagccggaguccugugguga

SEQ ID NO: 20185 - RNA, 9876 nt, Artificial Sequence
  derived and/or modified CDS sequence (opt5) from DENV-2__FM210239__SS-prME
accgccggcgugaucauuaugcugauccccaccgcuauggccuuccaccucacgaccagaaacggggaaccucauaugauugucggacggcaggaaaagggcaagagccugcuuuuuaagaccgaggacgggguuaauaugugcacccugauggcgaucgaucucggagaacugugugaggacacaauuaccuacaagugcccccuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuaccugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgaauaccggcacaauuggggcggugagccucgauuuuucccccggaaccagcggcucuccuaucguugaccggaaggggaagguggucggacuguauggcaacggcguggugacaagauccggggcuuacguuagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccuguccccugugcggguucccaacuauaaccuuaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccugcggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucucacagacggcgaagaacgggugauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaaggucgacgccauugauggagaauauagacugcggggcgaggcucgcagaacauucguugaccugaugcggcgcggggaucuccccguguggcuugccuacagaguggcugccgagggaaucaauuaugcggaccggagaugguguuuugauggcgucaaaaacaaucagauucuggaagagaacguggaaguugagaucuggaccaaggagggggaacgcaagaaacugaagccucgguggcucgacgccagaaucuacagcgauccccuggcucuuaaagaguucaaggaguucgccgcuggccgcaaaucccugacacucaaccugauuaccgagaugggacggcugccgacguuuaugacccagaaggccagagacgcccucgauaaucuugcugugcugcacacagcggaagccggcgggcgggcuuauaaccaugcccugucugagcucccugagacccuggaaacacuucugcuccugacccugcucgccacagucaccggaggcaucuuccuuuuucugaugagcgggaagggagugggcaaaaugacgcugggcaugugcugcauuaucacagcuuccauucuccugugguacgcccaaauccagccccacuggaucgcggccagcauuauccuugaguucuuucugauuguucuccugauccccgaaccugagaagcagcgcaccccgcaggacaaucaacugaccuauguggucauugcuauccucacaguggucgccgcuaccauggccaacgaaaugggguuccuugagaaaacaaagaaagaccugggacugggcucuaucgcgacgcaggagcccgaauccaauauucucgauaucgaccugagaccugccagcgcuuggacccuuuacgccguggcuacaaccuuuguuacacccaugcugcggcacuccauugagaacucuagcgugaaugugucccucaccgccaucgcuaaccaggccacgguccugauggggcugggaaagggcuggccucucucuaagauggauauugggguuccccuucuggcgaucggauguuacagccaggugaauccuauuacccugacagccgcucuccugcuucugguggcccauuaugcuaucaucggcccgggccuccaagccaaagccacccgcgaagcgcagaagagagcugccgcugggauuaugaaaaaccccacagucgacggagugaccguuaucgaucuggacccuauucccuacgauccuaaguucgagaaacagcugggccaggugaugcuccuuauccugugcgucacgcaagugcugaugaugcggacaaccugggcccucugugaagcccugacacuugcuaccgggcccauuuccacccugugggagggaaauccgggccgcuuuuggaacacaacgaucgccgucagcauggcgaauaucuucagagggucuuaucucgccggagcuggccugcuguuuuccauuaugaagaacaccacaaauacccggcgcggcacagggaacaucggagagacccucggcgaaaaguggaaaagcagacuuaaugcccuggggaagucugaguuccagauuuacaaaaaguccggaauccaggaaguggaccggacgcuggcuaaagagggcauuaagagaggggagacagaucaccaugccguuagccgcggaucugcgaaacuccggugguuuguggaaagaaacauggucaccccugagggcaaggugguugaccugggcugcgggcgcggaggcuggagcuauuacugugggggacuuaaggaugugcgggaagucaaaggccugaccaaagggggacccggccacgaggaacccaucccuauguccacauauggcuggaaccucgugagacugcaaucugggguggacguuuucuucacacccccugagaaaugcgauacccugcucugugacaucggagagagcuccccgaaucccacgauugaagccggccgcacccuucggguccugagccugguggagaacuggcucaauaacgacacacaguuuugcaucaaggugcugaauccuuacaugcccuccgucauugagaagauggagacccuucagagaaaguacgggggagcucugguucgcaacccucucucucggaauagcacacaugaaauguauuggguguccaacgccaccggcaauaucgugucuagcgucaacaugauuuccagaaugcugaucaaucgcuucacgaugaagcacaaaaaggcuaccuacgagcccgauguggaccuggggucuggaacacggaacaucggcauugagagcgaaaucccgaaucucgauauuaucggcaaaagaauugagaagaucaaacaggaacacgagaccuccuggcauuaugaccaagaucacccuuacaagacaugggccuaucaugggagcuacgaaaccaagcagacaggaucugcuuccagcaugguuaacggcgugguccgccuucugaccaaacccugggacgugguuccuauggugacgcagauggccaugacagauaccacccccuuugggcagcaaagagucuucaaggagaaaguggacacacggacgcaggagccuaaggaaggaaccaaaaagcugaugaagauuacagcggaguggcucuggaaagaacugggcaagaaaaagacaccccgcauguguacaagagaggaguuuacccggaaagugagaucuaaugccgcucuuggggccaucuucacagaugaaaacaaguggaaauccgcucgggaggccgucgaagacagccgcuuuugggagcugguugauaaggaaagaaaccuccaccuggagggaaagugcgagaccuguguguauaauaugaugggcaaacgggaaaagaaacugggcgaguucgggaaggccaaaggaucucgcgcgaucugguacauguggcucggcgcuagauuucuggaguucgaggcccuuggguuucugaacgaagaccacugguucucccgggagaauagccucuccggaguggagggcgaagggcugcauaaacuuggcuacauucugcgcgacgucagcaagaaagagggaggcgccauguaugcugaugacacggccgggugggauaccagaaucacacucgaagaccugaagaacgaggaaauggugaccaaucacauggagggagagcauaaaaagcuggcugaagccauuuuuaaacucacauaccagaacaagguugugcggguccagcgcccgaccccuagaggcacggugauggauaucauuucucggcgcgaccaaagagggagcggacagguuggcacauaugggcugaauaccuucacaaacauggaggcgcagcuuauccggcaaauggaaggcgagggaguguucaaguccauccagcgccugaccgucacggaggaaauugccgugcagaauuggcucgcuagaguuggccgggagagacugucucgcauggccaucagcggggaugacugcguggucaaaccccuugaugaccgguuugcuuccgcccugaccgcgcucaacgauaugggaaaggugagaaaagacauucagcaaugggaacccucucgcggcuggaaugauuggacacaggucccuuucugcagccaccauuuucacgagcugaucaugaaggacgggcgggugcugguugugccguguagaaaccaggacgaacucauuggacgcgcccggaucucccagggcgcuggguggucucugaaagagaccgccugccuuggcaagagcuacgcucaaauguggucccugauguauuuccacagacgcgaucuccggcuggccgcuaaugccaucuguagcgcgguccccucucauugggugccuacauccagaaccacauggagcauucacgccaagcaugaguggaugaccacggaagacaugcuuacaguguggaaccgcguuuggauccaggagaaucccuggauggaagauaaaaccccuguggagucuugggaagagguccccuaccugggaaagcgggaggaccaguggugcggcucccucauugggcugaccagcagagcuacaugggccaaaaacauccagaccgccauuaaccaagugcggucccugaucggaaaugaagaguauacagauuacaugccuucuaugaagagauuucgccgggaagaggaagaggcuggcguucucugguga

SEQ ID NO: 20186 - RNA, 9876 nt, Artificial Sequence
  derived and/or modified CDS sequence (opt5) from DENV-2__FM210232__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaggcuugcgggaaccggggaccuucucugagaaccacgacagcguccggcaaacugaucaccgaauggugcugucggagcugcacacucccgccccugcgcuacagaggcgaggauggguguugguauggaauggaaauucggccucuuaaggagaaggaagagaaucuggugaacucccucgucaccgccggccacgggcagaucgacaauuuuucucugggaguucugggcauggcucuuuuccucgaagagaugcugagaacacgcguggggaccaaacaugccauccugcucgugacggucagcuuugugacccugauuacaggaaacauguccuuccgggaucuuggcagaguuauggugauggucggcgccgcuaugaccgacgauaucgggaugggagugacauaccuggcccuccuggcggcuuuuaagguucgccccaccuucgccgccggccugcuucugagaaaacucacgucuaaggagcugaugauggcuacaauugggaucgcccuccugagccaguccaccauuccugaaacaauccuugagcugaccgacgcgcucgcucugggaaugauggugcugaaaaucguccggaauauggaaaaguaucaacuugccgugaccauuauggccaucucuugcguucccaacgcugugauucugcagaaugccuggaaggucagcuguacaauccucgcugccguguccgugagcccucugcuccugacgucuucccagcagaaagcggauuggauuccccuugcccugaccaucaagggccucaacccgacagcuaucuuucugaccacacugagccgcaccucuaaaaagagauccuggccucuuaaugaggccauuauggcugucgggaugguuagcauccuggccucuucccuccugaaaaacgacauucccaugacgggaccucucguggccggcggccugcuuacagugugcuacguccugaccgggcggagcgcugaccuggaacucgagcgcgcgaccgaugugaagugggaggaccaagccgaaaucuccggaagcucucccauucugagcaucacaauugcugaggauggcuccaugucuaucaaaaaugaagaggaggaacagacccuuacaauccugauuagaacggggcuccugguuaucagcggacucuucccgguguccauuccuaucaccgccgccgcuugguaucugugggaggucaagaagcagcgggccggcgugcuuugggacguucccucuccuccgcccguggggaaagcggaacuggaggauggagcuuaccgcauuaagcagaaaggcauccugggcuauagccaaaucggggccggagucuacaaggaaggcacauuucacaccauguggcacgugacaagaggggccguccucaugcaucggggaaaacgcauugagccuuccugggcugacgugaagaaggaucugaucucuuacggcgggggauggaaacuugagggcgaauggaaggagggcgaagagguucaggugcuggcccucgaaccggggaaaaaccccagagcgguccagaccaagccuggacuguucaaaacgaauaccggcacaauuggggcugugagccucgacuuuucccccggaaccagcggcucuccuaucguugaucggaaggggaagguggucggacuguauggcaacggcguggugacaagauccggggccuacguuagcgccauugcucagaccgagaaaucuaucgaggacaaucccgaaaucgaggaugacauuuuccgcaagaaacggcuuacaaucauggaucugcacccuggagccggcaagacgaaaagauaucugccggcuauuguccgcgaagccaucaagcgggggcucagaacccugauucuugcgcccacacgcgugguggccgcugagauggaagaggcccugcggggacucccuaucagauaccaaacccccgcuauucgcgccgagcauaccggccgggaaaucgucgaccugaugugucacgccacauucacgaugagacuccuguccccugugcggguucccaacuauaaccuuaucauuauggacgaggcucauuuuaccgauccggcgagcaucgccgcucgcggguacauuuccacaagaguggaaaugggcgaggccgccggaaucuucaugaccgcuacaccucccggcucucgggaccccuuuccucagagcaaugcccccauuauggaugaggaacgcgagaucccugaaagauccuggaacagcgggcacgagugggucaccgacuucaagggaaaaacggugugguuuguuccgucuaucaaggcgggcaaugauauugcugccugccugcggaaaaacgggaagaaagugauccagcuguccagaaagacauucgacagcgaauaugucaagacccgcaccaaugauugggacuuugugguuacaaccgauauuucugagaugggagccaacuucaaagcugagcgggugaucgaccccagacgcuguaugaagccugucauucucacagauggcgaagaacgggugauccuggccgggcccaugccugugacccacagcuccgcggcccaaagacgcggccggaucggaagaaaucccaaaaacgaaaaugaccaguacauuuacaugggcgagccgcuugaaaacgacgaggauugcgcucauuggaaggaggccaaaaugcugcucgacaauaucaacacgccugaagggauuauccccucuauguuugagccugaacgcgagaaggucgaugcuauugacggagaauauagacugcggggcgaggcccgcaaaacauucguugaucugaugagaagaggggaccuccccguguggcuugcuuaccgcguggccgcggagggaaucaauuaugccgauagacggugguguuuugacggcgucaagaacaaucagauucuggaagagaacguggaaguugagaucuggaccaaggagggggaacgcaagaagcugaaaccucgcuggcucgaugcucggaucuacagcgacccccuggcccuuaaggaguucaaagaguucgcugccggcagaaagucccugacacucaaccugauuaccgagaugggacgccugccgacguuuaugacccagaaggcccgggaugcucucgacaaucuugcggugcugcacacagccgaagcuggcgggagagccuauaaccaugcccugucugagcucccugagacccuggaaacacuucugcuccugacccugcucgcuacagucaccggaggcaucuuccuuuuucugaugagcgggaaaggagugggcaagaugacgcugggcaugugcugcauuaucacagccuccauucuccugugguacgcgcaaauccagccccacuggaucgccgcuagcauuauccuugaguucuuucugauuguucuccugauccccgaaccugagaaacagcggaccccgcaggauaaucaacugaccuauguggucauugccauccucacaguggucgcugccaccauggcgaacgaaaugggguuccuugagaagaccaagaaggaccugggacugggcucuaucgccacgcaggagcccgaauccaauauucucgacaucgaucugcgcccugcuagcgccuggacccuuuacgcuguggccacaaccuuuguuacacccaugcugagacacuccauugagaacucuagcgugaaugugucccucaccgcuaucgccaaccaggcgacgguccugauggggcugggaaagggcuggccucucucuaaaauggacauugggguuccccuucuggccaucggauguuacagccaggugaauccuauuacccugacagcugcccuccugcuucugguggcucauuaugccaucaucggcccgggccuccaagccaaggcgacccgggaagcucagaaacgcgccgcugccgggauuaugaagaaccccacagucgauggagugaccguuaucgaccuggauccuauucccuacgacccuaaauucgagaagcagcugggccaggugaugcuccuuauccugugcgucacgcaagugcugaugaugagaacaaccugggcccucugugaagcucugacacuugccaccgggcccauuuccacccugugggagggaaauccgggccgguuuuggaacacaacgaucgcggucagcauggccaauaucuuccgcgggucuuaucucgcuggagccggccugcuguuuuccauuaugaagaacaccacaaauaccagacggggcacagggaacaucggagagacccucggcgaaaaauggaaaagccgccuuaaugcucuggggaaaucugaguuccagauuuacaagaaauccggaauccaggaaguggauagaacgcuggccaaggagggcauuaaaagaggggaaacagaccaccaugcgguuagcagaggaucugccaagcuccgcugguuuguggaacggaacauggucaccccugagggcaaggugguugaucugggcugcgggagaggaggcuggagcuauuacugugggggacuuaaagacgugcgcgaagucaagggccugaccaaagggggacccggccacgaggaacccaucccuauguccacauauggcuggaaccucgugcggcugcaaucugggguggauguuuucuucacacccccugagaagugcgacacccugcucugugauaucggagagagcuccccgaaucccacgauugaagcuggcagaacccuucgcguccugagccugguggagaacuggcucaauaacgacacacaguuuugcaucaaagugcugaauccuuacaugcccuccgucauugaaaagauggagacccuucagcggaaguacgggggagcccugguuagaaacccucucucucgcaauagcacacaugaaauguauuggguguccaacgcuaccggcaauaucgugucuagcgucaacaugauuucccggaugcugaucaauagauucacgaugaaacacaagaaagccaccuacgagcccgacguggaucuggggucuggaacacgcaacaucggcauugagagcgaaaucccgaaucucgacauuaucggcaagcggauugagaaaaucaagcaggaacacgagaccuccuggcauuaugaucaagaccacccuuacaagacaugggcuuaucaugggagcuacgaaaccaaacagacaggaucugccuccagcaugguuaacggcguggucagacuucugaccaagcccugggaugugguuccuauggugacgcagauggcgaugacagacaccacccccuuugggcagcaacgcgucuucaaagagaagguggauacaagaacgcaggagccuaaagaaggaaccaagaagcugaugaaaauuacagccgaguggcucuggaaggaacugggcaaaaagaaaacaccccggauguguacacgcgaggaguuuaccagaaaggugcggucuaaugcugcccuuggggcuaucuucacagacgaaaacaaauggaaguccgccagagaggccgucgaagauagccgguuuugggagcugguugacaaggaacgcaaccuccaccuggagggaaaaugcgagaccuguguguauaauaugaugggcaagagagagaagaagcugggcgaguucgggaaagcgaagggaucucgggcuaucugguacauguggcucggcgcccgcuuucuggaguucgaggcccuuggguuucugaacgaagaucacugguucuccagagagaauagccucuccggaguggagggcgaagggcugcauaaacuuggcuacauucugcgggacgucagcaaaaaggagggaggcgcuauguaugccgacgauacggcugggugggacacccgcaucacacucgaagaucugaaaaacgaggaaauggugaccaaucacauggagggagagcauaagaaacuggccgaagcgauuuuuaagcucacauaccagaacaagguugugagaguccagcggccgaccccucgcggcacggugauggacaucauuucuagacgggaucaacgcgggagcggacagguuggcacauaugggcugaauaccuucacaaacauggaggcccagcuuaucagacaaauggaaggcgagggaguguucaaauccauccagcaccugaccgucacggaggaaauugcugugcagaauuggcucgcccggguuggccgcgagagacugucucggauggcuaucagcggggacgauugcguggucaagccccuugacgauagauuugccuccgcgcugaccgcccucaacgacaugggaaaagugcgcaaggauauucagcaaugggaacccucucggggcuggaaugacuggacacaggucccuuucugcagccaucacuuucacgagcugaucaugaaagaugggagagugcugguugugccgugucgcaaccaggacgaacucauuggacgggcuagaaucucccagggcgccggguggucucugaaggagaccgcuugccuuggcaagagcuacgcccaaauguggucccugauguauuuccaucgccgggaccucagacuggcugccaaugcgaucuguagcgccguccccucucacugggugccuacaucccgcaccacauggagcauucaugcuaaacacgaguggaugaccacggaagauaugcuuacaguguggaaccggguuuggauccaggagaaucccuggauggaagacaagaccccuguggagucuugggaagagguccccuaccugggaaaaagagaggaucaguggugcggcucccucauugggcugaccagccgcgccacaugggccaagaacauccagaccgcuauuaaccaagugcggucccugaucggaaaugaagaguauacagacuacaugccuucuaugaaaagauuucggagagaagaggaagaggccggcguucucugguga

SEQ ID NO: 20187 - RNA, 9876 nt, Artificial Sequence
  derived and/or modified CDS sequence (opt5) from DENV-2__FM210233__SS-prME
agcgccggaaugaucauuaugcugauccccaccgugauggcuuuccaccugacgacgagaaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauauccgcggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggauggagucugcccucaacgauaccuggaaaaucgagaaggcuuccuucauugaagugaaaaauugccacuggccuaagagccauacacuguggucuaacggcguccuggagagcgaaaugaucauucccaaaaaccuugccgggccggugucccaacacaauuacagaccuggauaccacacccagaucgcuggccccuggcaucucgggaagcuggagauggacuucgauuuuugugacggaacgacagugauugucaccgaagauugcggcaaccgcgggcccagccugcggaccacaaccgccucuggaaagcucaucacggaguggugcuguagauccugcacacugccuccgcuucgguaucgcggcgaggacggcuguugguacgggauggaaauuagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuaucaccgggaacaugagcuuuaaggaccugggacgcgugguugugauggucggcgcuacgauggccgaugacauuggcaugggggugaccuaucucgcccugcuggcugccuucaaaguucggccuacauuugcggcuggacuucugcucagaaagcugaccuccaaggagcucaugaugacaaccaucggcauugugcugcuuucucaaagcacgauccccgaaacaguccuggagcucaccgaugcccuggcccuggggaugauggugcuuaaaauugugcgcaauauggaaaaguaccagcuggcugucacaaucauggccauccucugcguuccuaacgcggugauucugcagaaugcuuggaaaguguccuguaccauccucgccgucgugucuguuagcccccugcuucugaccuccagccagcaaaagacagacuggauuccucucgcccugacgaucaaaggacugaaccccaccgcuauuuuccuuacaacccugucuagaacaaauaagaaacgguccuggccgcucaacgaggccaucauggcugugggcauggucagcauccuggccucuucccuccugaagaaugacauuccuaugaccgggccccuuguggcgggaggccugcugacgguuugcuaugugcucacaggccgcagcgccgaucuggaacuugagagagcuaccgacgucaagugggaggaucaggccgaaaucucuggguccagcccuauucuguccaucaccauuagcgaggacggaucuaugagcaucaaaaacgaagaggaggaacagacacucaccauucugauccggacaggccuccuggugaucuccgggcuuuuucccauuucuaucccgauuacggcugccgccugguaccugugggaggucaagaaacagcgcgcuggagugcugugggauguuccuucucccccucccaugggcaaggcggaacucgaggacggggccuauagaaucaaacaaaagggcauucugggauacucccagaucggcgcugggguguacaaggaaggaaccuuccacacaauguggcaugucacccggggcgccgugcuuaugcacaaagggaagcgcaucgagcccuccugggccgauguuaaaaaggaccugauuagcuauggaggcggguggaaacucgagggagaauggaaggagggcgaagaggugcagguccuggcucucgaaccuggcaagaauccgagagccgugcagacaaaacccgggcuguuuaagaccaacacgggaaccaucggcgcggugucccuugauuucucuccugggacaagcggaucccccauuaucgacaaaaagggcaaaguugucgggcuguacggaaacggcguggugacccggagcggcgcuuaugucucugccauugcccaaacagagaaguccaucgaggauaauccugaaaucgaggacgauauuuuucgcaagagacggcugaccaucauggaccuccaccccggggcuggaaaaacaaagagauaccugccugccauugugcgcgaagcgaucaaacggggccuuagaacgcugauucucgcuccgacccgcguuguggccgccgagauggaagaggcucugcgggggcuccccaucagauaucagaccccugccauucgcgcugagcauaccggacgggaaaucgucgaccugaugugucacgccaccuucacaaugagacuucugagccccgugcgcguuccuaacuacaaucugaucauuauggaugaggcgcauuucacggaccccgccucuaucgcugcccggggcuauauuuccaccagaguggaaaugggggaggcugccggcaucuuuaugacagccaccccgccuggaagccgggaucccuucccccaguccaacgcuccuauuaucgacgaggaacgcgagauccccgaaagaucuuggaauagcggccacgagugggucacagauuuuaaggggaaaaccgugugguucguuccuuccauuaaggcgggaaacgacaucgccgcuugccuccggaagaauggcaaaaaggugauucaacugagccgcaaaacguuugauucugaauacgucaagacaagaaccaacgacugggauuucguggugaccacagacaucuccgagaugggggccaauuuuaaagccgagcgggucauugauccgagacgcuguaugaagcccguuauccuuaccgacggagaggaacgggugauccuggcuggcccuaugcccgugacacauagcucugccgcgcagagacgcgggcggauuggcagaaacccuaaaaaugaaaacgaccaguacaucuauaugggagagccccucgaaaaugaugaggacugcgcucacuggaaggaggccaagaugcugcuggauaacauuaauaccccggaaggcaucauuccuagcauguucgagcccgaacgcgagaaagucgacgccaucgauggggaauaccggcucagaggagaggcucgcaagacguuuguggaccuuaugagacggggcgaucugccuguuuggcuggccuauaaaguggcggccgaggggauuaacuacgcugaccgcagaugguguuucgauggaaucaagaacaaucagauccucgaagagaacgucgaaguggagauuuggacaaaagagggcgaacggaagaagcugaaaccccgcuggcuugacgccagaaucuauuccgauccucuggcucucaaggaguuuaaagaguucgccgcugggcggaagucucugacccugaaucucauuacagagaugggcagacuucccaccuucaugacgcagaagacccgcgacgcccuggauaaccuggcgguucuccacacagccgaagcuggaggccgggccuacaaucaugcucugagcgagcuuccggagacccuggaaacacuccugcugcucacccuucuggccacagugaccgggggaaucuuucuguuccucauguccggcagagggauuggaaagaugacgcugggcaugugcugcaucaucacagccucuauucuucugugguaugcucagauccagccucacuggauugcggccagcaucauucucgaguuuuuccugaucguccugcucauccccgaacccgagaagcagcgcaccccucaagacaaccagcuuaccuacguggucauugcuauccugacagugguugccgccaccauggcuaaugaaaugggcuuucuggagaaaacaaagcgggaccucgggcugggauccauugccacgcagcagccggagagcaacauccuugauauugaccugagacccgcgucugccuggacccucuacgcuguggccacaaccuucgugacaccuaugcugcggcauuccaucgaaaauagcuccgucaacguuucucugaccgcuauugccaaucaagcgacggugcucaugggccuugggaaaggauggccccugagcaagauggauaucggcgugccucugcucgccaucggguguuauucccaggucaaccccauuacccugacagcugcccuucugcuccugguggcucacuacgccaucauuggaccuggccugcaggcuaaagccacccgcgaggcgcagaagagagccgcugccggcaucaugaagaauccgacaguugacgggauuaccgugaucgaucucgaccccaucccuuaugaucccaaauuugaaaagcaacuuggacaggucaugcugcugauucucugcgugacgcagguccugaugaugcggacaaccugggcucuuugugaggcccugacacucgccaccggcccuaucucuacccugugggaagggaaccccggacgcuucuggaauacaacgauugcggugagcauggcuaacaucuuuagaggcuccuaccuggccggggcuggacuccuuuucagcauuaugaaaaauaccacaaacacccggcgcggcacaggcaacaucggggagacccugggagagaaguggaaaucuagacugaaugcccucggcaaguccgaauuucaaaucuauaaaaagagcgggauucaggagguugaccggacgcuggccaaggaaggaaucaaacgcggcgagacagaucaccaugcugugucuagaggguccgccaaacuucggugguucgucgagagaaacauggugaccccggaaggaaaaguuguggaccugggcugcggccgcgggggauggagcuacuauuguggcgggcucaagaauguccgggaggugaaaggacugaccaagggcgggccuggacacgaagaacccauucccaugucuacauacggcuggaaccuggugagacuccagagcggcguugaugucuuuuucaucccucccgaaaagugcgacacccuucugugugauauuggggaguccucuccuaauccgacaguggaggcgggacgcacgcugcgggugcucaaccuggucgaaaauuggcuuaacaauaacacccaguucugcaucaaaguucugaaucccuacaugccuagcgugaucgagaagauggaagcccuccaaagaaaauauggcggggcucuggugcgcaacccccugucccggaauagcacacaugagauguacugggucuccaacgccucuggaaauauugugagcuccguuaacaugaucucuagaaugcucauuaaccgcuuuaccaugcggcacaagaaagcuacauaugaaccugacguggaccuuggcagcgggaccagaaauaucggaauugaguccgagauccccaaccuggauauuaucggcaagcgcaucgaaaagauuaaacaggagcaugaaacgucuuggcacuacgaccaggaucacccguauaagaccugggccuaccauggcagcuaugagacaaaacagaccggguccgcgagcucuauggucaauggagugguucggcugcucacaaagccuugggacgugcugcccaccgucacacaaauggccaugaccgauacgacaccuuucggccagcagagaguguuuaaagaaaagguggacacccgcacccaggagcccaaggaggggaccaagaaacuuaugaaaaucacggcugaauggcuguggaaggagcucggcaagaagaaaaccccuagaauguguacacgggaagaguucacccgcaaggucagauccaacgccgcucugggcgccauuuuuacagaugagaauaaguggaaaagcgcucgggaagccguugaggacucuagauucugggaacugguggauaaggagcggaaccuccaccuggaagggaaaugcgagaccuguguguacaauaugaugggaaagcgcgagaagaaacuuggcgaauuuggcaaagcgaaaggguccagagccaucugguacauguggcugggagcucgguuccucgaguuugaagcccugggcuuccuuaacgaggaccauugguuuagccgcgaaaauucucuguccggggucgagggagagggccuccacaagcugggguauauucugagagaugugagcaaaaaggaaggcggagcuauguacgccgacgacacagccggcugggauacccggaucacgcucgaggaccugaaaaacgaagagaugguuaccaaucacauggaaggggagcauaagaaacuugcggaggcuaucuucaaacugacauaucaaaacaaggugguccgcgugcagagacccaccccgcggggaacaguuauggauauuaucucccgcagagaccagcggggcagcgggcaagugggaaccuacggccucaauacguuuacaaacauggaagcccagcugauucgccagauggagggggaaggcgucuucaaaaauauccagcaccuuaccgugacagaggagguugccgugcauaacuggcuggcuagagucggacgggaacgccucucuagaauggccauuagcggcgaugacugcguggucaagccucuggaugaccgguucgcuaacgcccugaccgcgcucaaugauauggggaaaaucagaaaggacauccaacagugggagcccuccaagggauggaacgauuggacacaggugcccuuuugcucucaccauuuccacgaacugauuaugaaagacggccgcguucuuguggucccuugucggaaucaggaugagcugaucgggagagcccgcauuagccaaggagcuggcuggucccuccgggaaaccgccugccuggggaagucuuaugcucagauguggagccuuauguacuuucacagacgcgaccugcggcucgccgcgaacgccaucuguuccgcugugccgucucauugggugcccacaagcagaaccacaugguccauucacgccaaacaugaguggaugaccacagaggacaugcugaccguuuggaaucgcguguggauccgggaaaacccuuggauggaggauaagacgcccgucgaaagcugggaggaaauuccuuaucugggcaaaagagaggaccaguggugcggaucucucaucggccugacaucccgcgcuaccugggccaagaauauccaggcugccauuaaccaagugcggagccuuaucgggaaugaggaauacaccgauuacaugcccucuaugaagagauuccggagagaggaagaggaagcgggaguucugugguga

SEQ ID NO: 20188 - RNA, 9876 nt, Artificial Sequence
  derived and/or modified CDS sequence (opt5) from DENV-2__FM210241__SS-prME
accgccggagugaucauuaugcugauccccacagcuauggccuuccaccucacgacccggaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguauggaauggaaauccggccccuuaaggagaaggaagagaaucuggucaacucucucgugacagcgggccacgggcagaucgauaauuuuagccugggagugcugggcauggcccuuuuccucgaagagaugcugagaacccgcgucgggacgaaacaugcuauucugcucguugccguguccuuugugacccugaucacaggaaacaugucuuuccgggaccuuggcagagucauggugaugguuggcgccaccaugacagaugacauugggaugggagugaccuaccuggcucuccuggccgcguuuaagguccgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugauggugcugaaaauuguucggaauauggaaaaguaucaacuugcugugacaaucauggccauuagcugcgucccuaacgccgugauccugcagaaugcuuggaagguuuccuguacgauucucgccgcugugagcgucucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccguggggauggugucuauucuggcuuccagccuccugaaaaacgacaucccuaugacaggaccccucgucgccggcggccugcuuaccguuugcuacgugcugaccgggcgguccgccgaucuggaacucgagcgcgcuacagacgugaagugggaggaucaagcggaaauuagcggaucuagcccuauccuguccauuaccaucucugaggacggcagcauguccaucaaaaaugaagaggaggaacagacacuuacgauucugaucagaaccgggcuccuggucauuucuggacucuuccccgugagcaucccgauuacagccgcugccugguaucugugggagguuaagaagcagcgggccggcgugcuuugggaugucccuucucccccucccguggggaaagcugaacuggaggacggagccuaccgcaucaagcagaaaggcauccugggcuauagccaaauuggggcgggaguuuacaaggaaggcaccuuucacacaauguggcacgugaccagaggggcuguccucaugcaucggggaaaacgcaucgagcccagcugggccgaugugaagaaggaccugauuuccuacggcgggggauggaaacuugagggcgaauggaaggagggcgaagagguccaggugcuggcccucgaaccugggaaaaacccgagagcuguucagacgaagcccggacuguucaaaaccaauacaggcaccaucggggccgugagccucgauuuuucuccuggaacauccggcagccccauugucgaccggaaggggaaggugguuggacuguauggcaacggcguggucaccagaucuggggcguacguguccgcuaucgcccagacagagaaaagcaucgaggauaauccugaaauugaggacgauaucuuccgcaagaaacggcuuacgauuauggaccugcaccccggagccggcaagaccaaaagauaucugccugcuaucgugcgcgaagccauuaagcgggggcucagaacacugauccuugcuccgacccgcguugucgccgcggagauggaagaggcccugcggggacuccccauuagauaccaaaccccugcuauccgcgccgagcauacaggccgggaaaucguggaccugaugugucacgcuacguucaccaugagacuccugucccccgugcgggucccuaacuauaaccuuauuaucauggaugaggcccauuuuacagaccccgccucuauugcugcgcgcggguacaucagcaccagaguggaaaugggcgaggccgcuggaauuuucaugacagccaccccgccuggcucccgggaucccuuuccccagagcaaugccccuaucaucgacgaggaacgcgagauucccgaaagaucuuggaacuccgggcacgaguggguuacggauuucaagggaaaaacagugugguuugucccuagcaucaaggcuggcaaugacauugccgcgugccugcggaaaaacgggaagaaagugauccagcugucuagaaagaccuucgauagcgaauauguuaagacccgcacaaaugacugggauuuuguggucaccacagacauuuccgagaugggagcuaacuucaaagccgagcgggugaucgauccgagacgcuguaugaagcccguuauccucaccgacggcgaagaacgggugauucuggccgggccuaugcccgucacgcacucuagcgcugcccaaagacgcggccggaucggaagaaauccuaaaaacgaaaaugaccaguacauuuacaugggcgagccccuugaaaacgaugaggacugcgcgcauuggaaggaggccaaaaugcugcucgauaauaucaacacaccggaagggauuaucccuuccauguuugagcccgaacgcgagaagguggacgcuauugauggagaauauagacugcggggcgaggcccgcaaaaccuucguggaccugaugagaagaggggaucucccugucuggcuugcuuaccgcguugccgcugagggaaucaauuaugccgacagacggugguguuuugauggcgugaagaacaaucagauccuggaagagaacguggaagucgagauuuggacaaaggagggggaacgcaagaagcugaaaccccgcuggcucgacgcgcggaucuacucugauccucuggcccuuaaggaguucaaagaguucgcugccggcagaaagagccugacccucaaccugauuacggagaugggacgccugcccaccuuuaugacacagaaggcucgggacgcccucgauaaucuugccgugcugcacaccgcugaagcgggcgggagagccuauaaccaugcucuguccgagcucccggagacacuggaaacccuucugcuccugacacugcucgccaccguuacgggaggcaucuuccuuuuucugaugagcgggaaaggagugggcaagaugacacugggcaugugcugcauuaucaccgccucuauccuccugugguacgcucaaauucagccucacuggaucgccgcguccauuauccuugaguucuuucugauuguccuccugauccccgaacccgagaaacagcggaccccucaggacaaucaacugacauaugugguuaucgccauucucaccguggucgcugccacaauggcuaacgaaaugggguuccuugagaagacgaaaaaggaccugggacugggcagcaucgccacccaggagccggaauccaauauucucgauaucgaccugcgccccgcgucugccuggacacuuuacgcuguggccaccacauuugucaccccuaugcugagacacagcauugagaacuccucugugaauguuagccucacggcuaucgccaaccaggcuaccgugcugauggggcugggaaagggcuggccccucuccaaaauggauauuggggugccucuucuggccaucggauguuacagccaggucaaucccaucacacugaccgcggcccuccugucucuuauugcucauuaugccaucauuggcccuggccugcaagcuaaggccacacgggaagcccagaaacgcgcggcugccgggaucaugaagaacccgaccguugacggaauuacggugaucgaucucgaccccaucccuuacgaucccaaauucgagaagcagcugggccaggugaugcugcucauucuuugcgucacacaagugcugaugaugagaaccacaugggcucugugugaagcccucacccuggccaccgggccuaucuccacacuuugggagggaaaucccggccgguuuuggaacacgaccauugcuguuagcauggccaauaucuuccgcgggucuuaucuggcgggagccggccuccuguuuuccauuaugaagaacacaaccaauacaagacggggcaccgggaacaucggagagacgcugggcgaaaaauggaagucccgccucaaugcucuugggaaaucugaguuccagaucuacaagaaaagcggcauucaggaaguggacagaacacuggccaaggagggcaucaaaagaggggaaaccgaucaccaugcugucuccagaggaucugccaagcugcgcugguuuguggaacggaacauggucaccccggagggcaaggugguugaccucggcugcgggagaggaggcuggagcuauuacugugggggacugaaaaacgugcgcgaagucaagggccuuacaaaagggggaccuggccacgaggaacccauucccauguccaccuauggcuggaaucuggugcggcuccaaagcgggguugauguguucuucacaccucccgagaagugcgacacgcugcugugugauaucggagaguccucuccuaacccgaccauugaagcgggcagaacacuccgcguccuuagccugguggagaauuggcugaacaaugacacccaguuuugcaucaaagugcucaaccccuacaugccuuccguuaucgaaaagauggagacacugcagcggaaguacgggggagcccuugucagaaauccccugucucgcaacagcacccaugaaauguauuggguguccaaugcuacgggcaacauugugucuagcgucaauaugaucucccggaugcucauuaacagauucaccaugaaacacaagaaagccacauacgagccugacguugaucuggggagcggaacccgcaauaucggcauugagucugaaauccccaaccuggacauuaucggcaagcggaucgagaaaauuaagcaggaacacgagacauccuggcauuaugaucaagaccacccguacaagaccugggcuuaucaugggagcuacgaaacaaaacagaccggaucugccuccagcauggugaauggcguggucagacuccuuacgaagccuugggaugugguucccauggugacacagauggcuaugaccgacaccacaccuuuugggcagcaacgcgucuucaaagagaagguggauacgagaacccaggagcccaaagaaggaacaaagaagcugaugaaaaucaccgccgaguggcuguggaaggaacucggcaaaaagaaaacaccucggauguguacccgcgaggaguuuacaagaaagguucggucuaacgcggcccugggggcuauuuucaccgacgaaaacaaauggaaguccgccagagaggcuguggaagauagccgguuuugggagcuugucgacaaggaacgcaaucugcaccucgagggaaaaugcgagacguguguguauaacaugaugggcaagagagagaagaagcugggcgaguucgggaaagccaagggaucccgggccaucugguacauguggcugggcgcgcgcuuucucgaguucgaggcucugggguuucuuaaugaagaucacugguucagcagagagaacucucugagcggaguggagggcgaagggcuccauaagcugggcuacauucuucgggacgucuccaaaaaggagggaggcgccauguaugccgacgauaccgcugggugggacacacgcaucacccuggaagaucucaaaaaugaggaaaugguuacaaaccacauggagggagagcauaagagacuggccgaagcuaucuuuaaacugaccuaccagaauaagguggugcggguccagcgccccacgccgagaggcacagugauggacauuaucucucggcgcgaucaaagagggagcggacagguuggcaccuaugggcucaacacauucaccaauauggaggcccaguucauucggcaaauggaaggcgagggaaucuuuaaguccauucagcaccugacggugaccgaggaaaucgcgguccagaacuggcuugcccgcgugggcagagagcggcugucuagaauggcuaucagcggggacgauugcguugugaaaccucucgacgaucgcuucgccuccgcucugacagcccuuaaugacaugggaaagguccggaaagauauucagcaaugggaacccucuaagggcuggaacgacuggacccaggugcccuuuugcagccaucacuuccacgagcugaucaugaaagaugggagaguucucguggucccuugucgcaaucaggacgaacugauuggacgggcgagaaucucccagggcgccggguggagccugaaggagacagcuugccucggcaagucuuacgcccaaauguggucccugauguauuuucaucgccgggaccuuagacuggcugccaacgcuauuuguagcgccgugccgucucacuggguccccaccucccgcacaaccuggagcauccaugcgaaacacgaguggaugacgacagaagauaugcucaccguguggaaucggguuuggauucaggagaacccuuggauggaagacaagacccccguggaguccugggaagaggucccuuaccugggaaaaagagaggaucaguggugcggcucucuuaucgggcugacaagccgcgccaccugggcuaagaacauccagacagccauuaaucaagugcggucccucaucggaaacgaagaguauacggacuacaugcccagcaugaaaagauuccggagagaagaggaagaggccggcgugcugugguga

SEQ ID NO: 20189 - RNA, 9876 nt, Artificial Sequence
  derived and/or modified CDS sequence (opt5) from DENV-2__FM210242__SS-prME
agcgccggcaugaucauuaugcugauccccaccgugauggcuuuccaccugacaacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcgguggugcugcagaaugcuuggaaggucuccuguaccauccucgccgugguuucugugagcccccugcuucugaccuccagccagcagaagaccgacuggauuccucucgcccugacgaucaagggacugaaccccaccgcuauuuuccuuacaacccugucucgcacaaauaaaaagagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauucugaucagaacaggccuccuggucaucuccgggcuuuuucccauuucuaucccgauuacggcugccgccugguaccugugggaggugaaaaagcagcgggcuggaguucugugggaugugccuucucccccucccaugggcaaagcggaacucgaggacggggccuaucgcaucaagcaaaagggcauucugggauacucccagaucggcgcuggggucuacaaagaaggaaccuuccacacaauguggcaugugaccagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccgugcagacaaagcccgggcuguuuaaaaccaacacgggaaccaucggcgcgguuucccuugauuucucuccugggacaagcggaucccccauuaucgacaagaaaggcaaggucguggggcuguacggaaacggcguggucaccagaagcggcgcuuaugugucugccauugcccaaacagagaaguccaucgaggauaauccugaaaucgaggacgauauuuuucggaaacgcagacugaccaucauggaccuccaccccggggcuggaaagacaaaacgguaccugccugccauuguuagagaagcgaucaagcgcggccuucggacgcugauucucgcuccgaccagaguggucgccgccgagauggaagaggcucugcgcgggcuccccauccgguaucagaccccugccauuaaagcugagcauaccggaagagaaaucguggaccugaugugucacgccaccuucacaaugcgccuucugagccccguucgggugccuaacuacaaucugaucauuauggaugaggcgcauuucacggaccccgccucuaucgcugccagaggcuauauuuccacccgcgucgaaaugggggaggcugccggcaucuuuaugacagccaccccgccuggaagccgggaucccuucccccaguccaacgcuccuauuaucgacgaggaaagagagauccccgaacggucuuggaauagcggccacgagugggugacagauuuuaaggggaagaccguuugguucgugccuuccauuaaagcgggaaacgacaucgccgcuugccuccgcaagaauggcaaaaaggucauucaacugagcagaaaaacguuugauucugaauacgugaagacacggaccaacgacugggauuucguggucaccacagacaucuccgagaugggggccaauuuuaaagccgagcgcguuauugauccgagacgguguaugaagcccgugauccuuaccgacggagaagagagagugauccuggcuggcccuaugcccgucacacauagcucugccgcgcagcgccgggggagaauuggccgcaacccuaagaaugaaaacgaccaguacaucuauaugggagagccccucgaaaaugaugaggacugcgcucacuggaaagaggccaagaugcugcuggauaacauuaauaccccggaaggcaucauuccuagcauguucgagcccgaacgggagaaaguggacgccaucgauggggaauacagacuccgcggagaggcucggaagacguuuguugaccuuaugagacgcggcgaucugccuguguggcuggccuauaaagucgcggccgaggggauuaacuacgcugacagacggugguguuucgauggaaucaagaacaaucagauccucgaagagaacguggaaguugagauuuggacaaaggagggcgaacgcaaaaagcugaaacccagauggcuugacgcccggaucuauuccgauccucuggcucucaaggaguuuaaagaguucgccgcugggcgcaagucucugacccugaaucucauuacagagaugggcagacuucccaccuucaugacgcaaaagacccgggacgcccuggauaaccuggcggugcuccacacagccgaagcuggaggcagagccuacaaucaugcucugagcgagcuuccggagacccuggaaacacuccugcugcucacccuucuggccacagucaccgggggaaucuuucuguuccucauguccggccgcgggauuggaaaaaugacgcugggcaugugcugcaucaucacagccucuauucuucugugguaugcucagauccagccucacuggauugcggccagcaucauucucgaguuuuuccugaucgugcugcucauccccgaacccgagaagcagcggaccccucaagacaaccagcuuaccuacgucgugauugcuauccugacaguuguggccgccaccauggcuaaugaaaugggcuuucuggagaaaacaaagaaagaccucgggcugggauccauugccacgcagcagccggagagcaacauccuugauauugaccugagacccgcgucugccuggacccucuacgcuguggccacaaccuucgucacaccuaugcugcgccauuccaucgaaaauagcuccguuaacgugucucugaccgcuauugccaaucaagcgacggugcucaugggccuugggaagggauggccccugagcaagauggauaucggcgucccucugcucgccaucggguguuauucccaggugaaccccauuacccugacagcugcccuucugcuccugguugcucacuacgccaucauuggaccuggccugcaggcuaaagccacccgggaggcgcagaagagagccgcugccggcaucaugaaaaauccgacaguggacgggauuaccgucaucgaucucgaccccaucccuuaugaucccaaguuugaaaaacaacuuggacaggugaugcugcugauucucugcgucacgcagguccugaugaugcggacaaccugggcucuuugugaggcccugacacucgccaccggcccuaucucuacccugugggaagggaaccccggacgcuucuggaauacaacgauugcgguuagcauggcuaacaucuuuagaggcuccuaccuggccggggcuggacuccuuuucagcauuaugaagaauaccacaaacacccggcgcggcacaggcaacaucggggagacccugggagagaaauggaagucuagacugaaugcccucggcaaguccgaauuucaaaucuauaaaaagagcgggauucaggagguggaccggacgcuggccaaagaaggaaucaagcgcggcgagacagaucaccaugcugucucuagaggguccgccaaacuucggugguucguggagcgcaacaugguuaccccggaaggaaagguggucgaccugggcugcggcagagggggauggagcuacuauuguggcgggcucaagucugugcgggaggugaaaggacugaccaagggcgggccuggacacgaagaacccauucccaugagcacauacggcuggaaucugguuagacuccaguccggcgucgauguguuuuucaucccucccgaaaaaugcgacacccuucugugugauauuggggagucuagcccuaacccgacaguggaggcgggacgcacgcugcggguccucaaucugguugaaaacuggcuuaauaacaauacccaguucugcaucaaggugcugaaccccuacaugccuuccgugaucgagaaaauggaagcccuccaaagaaaguauggcggggcucugguccgcaauccccugagccggaacuccacacaugagauguacugggugucuaaugccagcggaaacauuguuuccucugugaauaugaucagcagaaugcucauuaaccgcuuuaccaugcggcacaagaaagcuacauaugaaccugacgucgaccuuggcuccgggaccagaaacaucggaauugagucugagauccccaaucuggauauuaucggcaagcgcaucgagaaaauuaagcaggagcaugaaacgagcuggcacuacgaccaggaucacccguauaaaaccugggccuaccauggcuccuaugagacaaagcagaccgggagcgcgucuuccauggugaacggaguugugcggcugcucacaaagccuugggacguccugcccaccgugacacaaauggccaugaccgauacgacaccuuucggccagcagagaguguuuaaagaaaaggucgacacccgcacccaggagcccaaagaggggacaaagaaacuuaugaagaucacggcugaauggcuguggaaagagcucggaaagaagaaaaccccucggauguguacaagagaagaguucacccgcaagguuagaagcaaugccgcucugggcgccauuuuuacagaugagaacaaauggaagucugcucgggaagccguggaggacucccgcuucugggaacugguggauaaagagagaaaucuccaccuggaagggaagugcgagaccugugucuacaacaugaugggaaagcgggagaagaaacuuggcgaauuuggcaaagcgaaagggagcagagccaucugguacauguggcugggagcucgguuccucgaguuugaagcccugggcuuccuuaaugaggaccauugguuuucucgcgaaaacucccugagcgggguggagggagagggccuccacaaacugggguauauucugagagauguuuccaagaaggaaggcggagcuauguacgccgacgacacagccggcugggauacccggaucacgcucgaggaccugaaaaaugaagagauggugaccaaccacauggaaggggagcauaagaaacuugcggaggcuaucuucaagcugacauaucaaaauaaagucgugcgcguucagagacccaccccgcggggaacagugauggauauuaucagccgcagagaccagcggggcucugggcaagucggaaccuacggccucaacacguuuacaaauauggaagcccagcugauucgccagauggagggggaaggcguguucaagaacauccagcaccuuaccguuacagaggagguggccguccaaaauuggcuggcuagagugggacgggaacgccucagcagaauggccauuuccggcgaugacugcgucgugaagccucuggaugaccgguucgcuaacgcccugaccgcgcucaacgauauggggaaaauccgcaaggacauccagcagugggagcccucuaaaggauggaaugauuggacgcagguucccuuuugcagccaucacuuccaugaacugauuaugaaggacggcagagugcuugucgugccuugucggaaccaagaugagcugaucgggagagcccgcauuucccagggagcuggcuggucucuccgggaaaccgccugccuggggaaaagcuaugcucagauguggucccuuauguacuuucacagacgcgaccugcggcucgccgcgaaugccaucuguucugcugugccgagccacuggguucccacauccagaaccacauggagcauucaugccaagcacgaguggaugaccacagaggacaugcugaccguguggaaccgcgucuggauccgggaaaauccuuggauggaggauaagacgcccguggaaucuugggaggaaauuccuuaucugggcaaaagagaggaccaguggugcggaucccucaucggccugacaagccgcgcuaccugggccaagaacauccaagcugccauuaaucagguucggucucuuaucgggaacgaggaauacaccgauuacaugcccuccaugaaaagauuccgccgggaggaagaggaagcgggagugcugugguga

SEQ ID NO: 20190 - RNA, 9876 nt, Artificial Sequence
  derived and/or modified CDS sequence (opt5) from DENV-2__FM210243__SS-prME
accgccggcgugaucauuaugcugauccccaccgcuauggccuuccaccucacgacccggaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaggaacaggacaaacgcuuugugugcaagcauuccaugguggauagaggcuggggcaacggguguggacuguucggcaaagggggaaucgucacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucuuccauuacagaggccgaacugaccggguauggaacggucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacacuggugaccuucaagaacccucaugccaaaaagcaagacgucgugguucucggcucccaggaaggggcuaugcacacggcgcugacaggcgccaccgagauucagaugagcuccggaaaucuucuguuuacaggccaucucaaaugcagacugcggauggauaaacuucaacugaaagggaugucuuacagcauguguaccggaaaguucaagaucgugaaagaaauugcugagacccagcacggcacaaucgucaucagagugcaguaugagggggacggaucccccugcaagauucccuucgaaaucauggaucucgagaaacgccauguccugggccggcugauuacggugaacccuaucguuaccgaaaaggacagcccggugaacauugaggccgaacccccuuuuggggauucuuacaucauuaucggcgucgagcccggacagcucaaacugaauugguucaagaagggcuccagcaucgggcaaauguuugagacaaccaugagaggagccaaacgcauggcuauucuuggcgacacagccugggauuucgggucucugggaggcguguuuaccagcaucgggaaggcgcuccaccagguuuucggcgcuauuuacggagccgccuuuuccggcgugucuuggacgaugaaaauccugauuggggucaucaucacauggauuggaaugaacagccgguccaccagccugucugugucccuugugcucguuggcaucauuacccuguaucugggggcuaugguccaggccgacagcggauguguggugucuuggaagaauaaagaacucaagugcggcuccgggaucuucauuacagauaacguccacaccuggacagagcaguacaaguuucaaccugaaagccccuccaaacuggcuucugccauccagaaggcgcaugaggaaggcaucuguggaauuagaagcgugacgcgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacagaacucaaauauagcuggaagaccuggggcaaggcuaaaaugcuguccacggagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcgaucaaagacaauagagccguucacgcugauaugggcuauuggauugaaucugcccucaacgacacauggaagauggagaaggcuuccuucaucgaggugaaaagcugccacuggccuaagucucauacccuguggagcaaugggguccuggaauccgagaugauuauccccaagagcuucgccggaccggugucucagcacaacuaccgcccuggcuauuacacgcaaacagccgggcccuggcaucuuggaaagcucgaaauggauuuugacuucugugagggcaccaccguuguggucacagaagauugcgggaaccggggacccucccugagaaccacgacagcuagcggcaaacugauuaccgaguggugcugucgguccugcacacucccuccgcugcgcuacagaggcgaggacggguguugguauggaauggaaauccggccccuuaaggagaaggaagagaaucuggugaacucucucgugaccgcgggccacgggcagaucgauaauuuuagccugggaguccugggcauggcccuuuuccucgaagagaugcugagaacacgcguugggaccaaacaugcuauucugcucgugacgguguccuuugucacccugaucacaggaaacaugucuuuccgggaccuuggcagagugaugguuauggugggcgccgccaugaccgaugacauugggaugggagucacauaccuggcucuccuggccgcguuuaaggugcgcccuaccuucgcugccggccugcuucugagaaaacucacgagcaaggagcugaugauggccacaaucgggauugcucuccugucccagucuaccauccccgaaacaauccuugagcugaccgaugcccucgcgcugggaaugaugguucugaaaauugugcggaauauggaaaaguaucaacuugcugucaccaucauggccauuagcugcgugccuaacgccguuauccugcagaaugcuuggaagguguccuguacaauucucgccgcugucagcguguuuccccugcuccugacgucuucccagcagaaagccgacuggaucccucuugcgcugaccaucaagggccucaaccccacagccauuuuccugaccacacugagccgcaccucuaaaaagagauccuggccgcuuaaugaggcuaucauggccguggggauggucagcauucuggcuucuucccuccugaaaaacgacaucccuaugacgggaccccucguugccggcggccugcuuacagugugcuacgugcugaccgggcggagcgccgaucuggaacucgagcgcgcuaccgacgucaagugggaggaucaagcggaaauuuccggaagcucuccuauccugagcauuacaaucgccgaggacggcuccaugucuaucaaaaaugaagaggaggaacagacccuuacaauucugaucagaacggggcuccuggugauuagcggacucuuucccguuuccaucccgauuaccgcugccgccugguaucugugggaggugaagaagcagcgggcuggcguccuuugggaugugccuucucccccucccguugggaaagccgaacuggaggacggagcguaccgcaucaagcagaaaggcauccugggcuauagccaaauuggggcuggaguguacaaggaaggcacauuccacaccauguggcacgucacaagaggggccgugcucaugcaucggggaaaacgcaucgagcccuccugggccgaugucaagaaggaccugauuucuuacggcgggggauggaaacuugagggcgaauggaaggagggcgaagaggugcagguucuggcucucgaaccugggaaaaacccgagagccgugcagaccaagcccggacuguuuaaaacgaauaccggcacaaucggggcggucagccucgauuucuccccuggaaccagcggcucucccauuguggaccggaaggggaagguugugggacuguauggcaacggcgucgugacaagauccggggcuuacgugagcgccaucgcccagaccgagaaaucuaucgaggauaauccugaaauugaggacgauaucuuccgcaagaaacggcuuacaauuauggaccugcaccccggagcuggcaagacgaaaagauaucugccugccaucguucgcgaagcuauuaagcgggggcucagaacccugauccuugccccgacacgcgucguggcggccgagauggaagaggcucugcggggacuccccauuagauaccaaaccccugccauccgcgcugagcauaccggccgggaaaucguggaccugaugugucacgccacauuuacgaugagacuccugucccccguccgggugccuaacuauaaccuuauuaucauggaugaggcccauuucaccgaccccgcuagcauugcggcccgcggguacaucuccacaagaguugaaaugggcgaggcugccggaauuuuuaugaccgccacaccgccuggcucucgggaucccuucccccagagcaaugcuccuaucauggacgaggaacgcgagauccccgaaagauccuggaacagcgggcacgagugggugaccgauuuuaagggaaaaacggucugguucgugccuucuauuaaggccggcaaugacaucgcggcuugccugcggaaaaacgggaagaaaguuauucagcuguccagaaagacauuugauagcgaauaugugaagacccgcaccaaugacugggauuucgucgugacaaccgacaucucugagaugggagccaacuuuaaagccgagcggguuauugauccgagacgcuguaugaagcccgugauccucacagacggcgaagaacgggucauccuggcugggccuaugcccgugacccacagcuccgccgcgcaaagacgcggccggauuggaagaaauccuaaaaacgaaaaugaccaguacaucuacaugggcgagccccuugaaaacgaugaggacugcgcccauuggaaggaggcuaaaaugcugcucgauaauauuaacacgccggaagggaucauuccuucuauguucgagcccgaacgcgagaagguggacgccaucgauggagaauauagacugcggggcgaggcucgcaaaacauuugucgaccugaugagaagaggggaucucccuguuuggcuugccuaccgcguggcugccgagggaauuaauuaugcggacagacggugguguuucgauggcgugaagaacaaucagauccuggaagagaacgucgaaguggagaucuggaccaaggagggggaacgcaagaagcugaaaccccgcuggcucgacgcccggauuuacagcgauccucuggcucuuaaggaguucaaagaauuugccgcuggcagaaagucccugacacucaaccugaucaccgagaugggacgccugcccacguucaugacccagaaggcccgggacgcccucgauaaucuugcuguucugcacacagcggaagccggcgggagagcuuauaaccaugcccugucugagcucccggagacccuggaaacacuucugcuccugacccugcucgccacagugaccggaggcauuuuucuuuuccugaugagcgggaaaggagucggcaagaugacgcugggcaugugcugcaucauuacagcuuccauccuccugugguacgcccaaauccagccucacuggauugcggccagcaucauucuugaguuuuuccugaucgugcuccugauucccgaacccgagaaacagcggaccccucaggacaaucaacugaccuauguugugaucgcuauccucacagucguggccgcuaccauggccaacgaaaugggguuucuugagaagaccaagaaggaccugggacugggcucuauugcgacgcaggagccggaauccaauauccucgauauugaccugcgccccgccagcgcuuggacccuuuacgccgucgcuacaaccuucgugacaccuaugcugagacacuccaucgagaacucuagcguuaaugugucccucaccgccauugcuaaccaggccacggugcugauggggcugggaaagggcuggccccucucuaaaauggauaucggggucccucuucuggcgauuggauguuacagccagguuaaucccaucacccugacagccgcucuccugcuucugguggcccauuaugcuaucauuggcccuggccuccaagccaaggccacccgggaagcgcagaaacgcgcugccgcugggaucaugaagaacccgacaguggacggaauuaccgucaucgaucuggaccccauuccuuacgaucccaaauuugagaagcagcugggccaggugaugcuccuuauccugugcguuacgcaagugcugaugaugagaacaaccugggcccucugugaagcccugacacuugcuaccgggccuaucuccacccugugggagggaaaucccggccgguucuggaacacaacgauugccgucagcauggcgaauaucuuucgcgggucuuaucucgccggagcuggccugcuguucuccauuaugaagaacaccacaaauaccagacggggcacagggaacaucggagagacccucggcgaaaaauggaaaagccgccuuaaugcccuggggaaaucugaguuucagauuuacaagaaauccggaauccaggaaguggacagaacgcuggcuaaggagggcaucaaaagaggggagacagaucaccaugccgucagcagaggaucugcgaagcuccgcugguucguggaacggaacaugguuaccccggagggcaagguggucgaccugggcugcgggagaggaggcuggagcuauuacugugggggacuuaaaaacgugcgcgaaguuaagggccugaccaaagggggaccuggccacgaggaacccauucccauguccacauauggcuggaaucucgugcggcugcaaucuggggucgauguguucuuuaccccucccgagaagugcgacacacugcucugugauaucggagagagcuccccuaacccgacgauugaagccggcagaacccuucgcgugcugagccugguugagaauuggcucaacaaugacacacaguucugcaucaaaguccugaaccccuacaugccuuccgugauugaaaagauggagacccuucagcggaaguacgggggagcucuggugagaaauccccucucucgcaacagcacacaugaaauguauugggucuccaaugccaccggcaacaucguuucuagcgugaauaugaucucccggaugcugauuaacagauuuacgaugaaacacaagaaagcuaccuacgagccugacguggaucuggggucuggaacacgcaauaucggcauugagagcgaaauccccaaccucgacauuaucggcaagcggauugagaaaaucaagcaggaacacgagaccuccuggcauuaugaucaagaccacccguacaagacaugggccuaucaugggagcuacgaaaccaaacagacaggaucugcuuccagcauggucaauggcgugguuagacuucugaccaagccuugggaugugguccccauggugacgcagauggccaugacagacaccaccccuuucgggcagcaacgcguuuuuaaagagaagguggauacaagaacgcaggagcccaaagaaggaaccaagaagcugaugaaaaucacagcggaguggcucuggaaggaacugggcaaaaagaaaaccccucggauguguacacgcgaggaguucaccagaaagguccggucuaacgccgcucuuggggccauuuuuacagacgaaaacaaauggaaguccgcuagagaggccguggaagauagccgguucugggagcugguggacaaggaacgcaaucuccaccuggagggaaaaugcgagaccugugucuauaacaugaugggcaagagagagaagaagcugggcgaguuugggaaagccaagggaucucgggcgaucugguacauguggcucggcgcucgcuuccuggaauuugaggcccuuggguuccugaaugaagaucacugguuuuccagagagaacagccucuccggaguugagggcgaagggcugcauaaacuuggcuacauucugcgggacgugagcaaaaaggagggaggcgccauguaugcugacgauacggccgggugggacacccgcaucacacucgaagaucugaaaaaugaggaaauggugaccaaccacauggagggagagcauaagaaacuggcugaagccauuuucaagcucacauaccagaauaaggucgugagaguucagcggcccaccccgcgcggcacggugauggacaucaucucuagacgggaucaacgcgggagcggacaggucggcacauaugggcugaacaccuucacaaauauggaggcgcagcuuauuagacaaauggaaggcgagggaaucuuuaaauccauucagcaccugaccgugacggaggaaaucgccguucagaacuggcucgcucgggugggccgcgagagacugucucggauggccauuagcggggacgauugcgucgugaagccucuugacgauagauucgcuuccgcccugaccgcgcucaaugacaugggaaaaguucgcaaggauauccagcaaugggaacccucucggggcuggaacgacuggacacaggugcccuuuugcagccaucacuuccacgagcugaucaugaaagaugggagaguccugguggucccuugucgcaaucaggacgaacucauuggacgggccagaaucucccagggcgcuggguggucucugaaggagaccgccugccuuggcaagagcuacgcucaaauguggucccugauguauuuucaucgccgggaccucagacuggccgcuaacgccauuuguagcgcggugccgucucacuggguucccacaucccgcaccacauggagcauccaugccaaacacgaguggaugaccacggaagauaugcuuacaguguggaaucgggucuggauucaggagaacccuuggauggaagacaagacccccguggagucuugggaagaggugccuuaccugggaaaaagagaggaucaguggugcggcucccucaucgggcugaccagccgcgcuacaugggccaagaacauucagaccgccaucaaucaaguucggucccugaucggaaacgaagaguauacagacuacaugcccucuaugaaaagauuccggagagaagaggaagaggcuggcgugcucugguga

SEQ ID NO: 20191 - RNA, 9876 nt, Artificial Sequence
  derived and/or modified CDS sequence (opt5) from DENV-2__FM210244__SS-prME
accgccggagugaucauuaugcugauccccaccgcuauggccuuccaccucacgaccagaaacggggaaccucauaugauugucggacggcaggaaaagggcaagagccugcuuuuuaagaccgaagacgggguuaauaugugcacccugauggcgaucgaucucggagaacugugugaggacacaauuaccuacaagugcccccuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuaccugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucguggccgucagcuuugugacgcugauuaccggaaacauguccuuccgggaccuuggcagaguuauggugauggucggcgccgcuaugacagaugacaucgggauuggagugaccuaccuggcccuccuggcggcuuuuaagguucgccccacauucgccgccggccugcuucugagaaaacucaccucuaaggagcugaugauggcuacgaucgggauugcccuccugagccaguccacaaucccugaaaccauccuugagcugacagaugcgcucgcucugggaaugauggugcugaaaauuguccggaauauggaaaaguaucaacuugccgugaccaucauggccauuucuugcguucccaacgcugugauccugcagaaugccuggaaggucagcuguaccauucucgcuacaguguccgugagcccucugcuccugacgucuucccagcagaaagccgacuggaucccccuugcgcugaccaucaagggccucaacccgacagccauuuuucugaccacacugagccgcaccucuaaaaagagauccuggccucuuaaugaggcuaucauggccgucgggaugguuagcauucuggcuucuucccuccugaaaaacgacauccccaugacgggaccucucguggccggcggccugcuuacagugugcuacguccugaccgggcggagcgccgaucuggaacucgagcgcgcuaccgacgugaagugggaggaucaagcggaaauuuccggaagcucucccauccugagcauuacaaucgccgaggacggcuccaugucuaucaaaaaugaagaggaggaacagacccuuacaauucugaucagaacggggcuccugguuauuagcggacucuucccgguguccaucccuauuaccgcugccgccugguaucugugggaggucaagaagcagcgggcuggcgugcuuugggauguucccucuccuccgcccguggggaaagccgaacuggaggacggagcguaccgcaucaagcagaaaggcauccugggcuauagccaaauuggggcuggagucuacaaggaaggcacauuucacaccauguggcacgugacaagaggggccguccucaugcaucggggaaaacgcaucgagccuuccugggccgaugugaagaaggaccugauuucuuacggcgggggauggaaacuugagggcgaauggaaggagggcgaagagguucaggugcuggcucucgaaccggggaaaaaccccagagccguccagaccaagccuggacuguucaaaacgaauaccggcacaaucggggcggugagccucgauuuuucccccggaaccagcggcucuccuauuguugaccggaaggggaagguggucggacuguauggcaacggcguggugacaagauccggggcuuacguuagcgccaucgcccagaccgagaaaucuaucgaggauaaucccgaaauugaggacgauaucuuccgcaagaaacggcuuacaauuauggaccugcacccuggagcuggcaagacgaaaagauaucugccggccaucguccgcgaagcuauuaagcgggggcucagaacccugauccuugcccccacacgcgugguggcggccgagauggaagaggcucugcggggacucccuauuagauaccaaacccccgccauccgcgcugagcauaccggccgggaaaucgucgaccugaugugucacgccacauucacgaugagacuccuguccccugugcggguucccaacuauaaccuuauuaucauggaugaggcccauuuuaccgacccggcuagcauugcggcccgcggguacaucuccacaagaguggaaaugggcgaggcugccggaauuuucaugaccgccacaccucccggcucuaaggaucccuuuccucagagcaaugcucccaucauggacgaggaacgggagaucccugaacgcuccuggaacagcgggcacgagugggucaccgauuucaaaggaaagacggugugguuuguuccgucuauuaaagccggcaaugacaucgcggcuugccugagaaagaacgggaaaaaggugauucagcugucccggaagacauucgauagcgaauaugucaaaaccagaaccaaugacugggauuuugugguuacaaccgacaucucugagaugggagccaacuucaaggccgagcgcgugauugauccccggagauguaugaaaccugucauccucacagacggcgaagaacgcgugauccuggcugggcccaugccugugacccacagcuccgccgcgcaacggagaggccgcauuggacggaaucccaagaacgaaaaugaccaguacaucuacaugggcgagccgcuugaaaacgaugaggacugcgcccauuggaaagaggcuaagaugcugcucgauaauauuaacacgccugaagggaucauucccucuauguuugagccugaaagagagaaagucgacgccaucgauggagaauaucgccugagaggcgaggcucggaagacauucguugaccugaugcgcagaggggaucuccccguguggcuugccuaccggguggcugccgagggaauuaauuaugcggaccgcagaugguguuuugauggcgucaagaacaaucagauccuggaagagaacguggaaguugagaucuggaccaaagagggggaacggaagaaacugaagccuagauggcucgacgcccgcauuuacagcgauccccuggcucuuaaagaguucaaggaguucgccgcuggccggaagucccugacacucaaccugaucaccgagaugggaagacugccgacguuuaugacccagaaagcccgcgacgcccucgauaaucuugcugugcugcacacagcggaagccggcgggaaggcuuauaaccaugcccugucugagcucccugagacccuggaaacacuucugcuccugacccugcucgccacagucaccggaggcauuuuccuuuuucugaugagcgggaaaggagugggcaagaugacgcugggcaugugcugcaucauuacagcuuccauccuccuguggcacgcccaaauccagccccacuggauugcggccagcaucauucuugaguucuuucugaucguucuccugauucccgaaccugagaaacagcggaccccgcaggacaaucaacugaccuacguggucaucgcuauccucacaguggucgccgcuaccauggccaacgaaaugggguuccuugagaagacaaagaaagaccugggacugggcucuauugcgacgcaggagcccgaauccaauauccucgauauugaccugagaccugccagcgcuuggacccuuuaugccguggcuacaaccuuuguuacacccaugcugcggcauuccaucgagaacucuagcgugaaugugucccucaccgccauugcuaaccaggccacgguccugauggggcugggaaagggcuggccucucucuaaaauggauaucgggguuccccuucuggcgauuggauguuacagccaggugaauccuaucacccugacagccgcucuccugcuucugguggcccacuacgcuaucauuggcccgggccuccaagccaaggccacccgcgaagcgcagaaaagagcugccgcugggaucaugaagaaccccacagucgacggaauuaccgugaucgaucuggacccuauucccuaugauccuaaguucgagaaacagcugggccagguuaugcuccuuauccugugcgugacgcaaguccugaugaugcggacaaccugggcccucugugaagcccugacacuugcuaccgggcccaucuccacccugugggagggaaauccgggccgcuuuuggaacacaacgauugccgugagcauggcgaauaucuucagagggucuuaccucgccggagcuggccugcuguuuuccauuaugaagaacaccacaaauacccggcgcggcacagggaacaucggagagacccucggcgaaaaauggaaaagcagacuuaaugcccuggggaaaucugaguuccagauuuauaagaaauccggaauccaggaagucgaccggacgcuggcuaaggagggcaucaagcgcggggagacagaucaucacgccgugagcagaggaucugcgaaacuccggugguuuguugaaagaaacauggugaccccugagggcaaggucguggaccugggcugcgggcgcggaggcuggagcuacuauugugggggacuuaaaaacguucgggaagugaagggccugaccaaagggggacccggccaugaggaacccauuccuauguccacauacggcuggaaucucgucagacugcaaucugggguggauguguucuucacacccccugagaagugcgacacccugcucugugauaucggagagagcuccccgaaccccacgauugaagccggccgcacccuucggguucugagccuggucgagaauuggcucaacaaugacacacaguuuugcaucaaggugcugaacccuuauaugcccuccgugauugagaagauggagacccuucagagaaaguacgggggagcucugguccgcaauccucucucucggaacagcacacacgaaauguacuggguuuccaaugccaccggcaacaucgugucuagcgugaauaugaucuccagaaugcugauuaaccgcuucacgaugaaacacaagaaagcuaccuaugagcccgacgucgaucuggggucuggaacacggaauaucggcauugagagcgaaaugccgaaccucgacaucauuggcaagagaaucgagaagauuaaacaggaacaugagaccuccuggcacuacgaucaagaccauccuuauaagacaugggccuaccacgggagcuaugaaaccaaacagacaggaucugcuuccagcauggugaauggcguugugcgccuucugaccaagcccugggaugucgugccuaugguuacgcagauggccaugacagacaccacccccuuugggcagcaacggguguucaaagagaaggucgauacaagaacgcaggagccuaaggaaggaaccaaaaagcugaugaaaaucacagcggaguggcucuggaaggaacugggcaaaaagaaaacaccccgcauguguacaagagaggaguuuacccggaaggugcgcucuaacgccgcucuuggggccaucuucacagacgaaaacaaguggaaauccgcuagagaggccguggaagauagccgguuuugggagcuggucgacaaggaaagaaaucuccaccuggagggaaaaugcgagaccuguguuuacaacaugaugggcaagcgggagaagaagcugggcgaguucgggaaggccaaaggaucucgcgcgauuugguauauguggcucggcgcuagauuucuggaguucgaggcccuuggguuucugaaugaagaucauugguucucccgggagaacagccucuccggaguggagggcgaagggcugcacaaacuuggcuacauccugcgcgacgugagcaaaaaggagggaggcgccauguacgcugacgauacggccgggugggacaccagaauuacacucgaagaucugaaaaaugaggaaauggucaccaaccauauggagggagagcacaagaagcuggcugaagccaucuuuaaacucacauaucagaauaaggugguucgggugcagcgcccgaccccuagaggcacggucauggacauuaucucucggcgcgaucaaagagggagcggacaggugggcacauacgggcugaacaccuucacaaauauggaggcgcagcuuauccggcaaauggaaggcgagggaauuuucaaauccauccagcaucugaccguuacggaggaaauugccgugcagaacuggcucgcucgcgucggcagagagcggcugucucgcauggccaucagcggggacgauugcgugguuaagccccuugacgauagauuugcuuccgcccugaccgcgcucaaugacaugggaaaagugcggaaggauauucagcaaugggaacccucuagaggcuggaacgacuggacacaggucccuuucugcagccaccacuuucaugagcugaucaugaaggaugggcgcgugcuggucgugccgugucggaaucaggacgaacucaucggcagagcccgcauuucccagggcgcuggguggucucugaaagagaccgccugccuuggcaagagcuaugcucaaauguggucccugauguacuuccaccggagagaccuccgccuggccgcuaacgccaucuguagcgcgguucccucucauugggugccuacaucccggaccacauggagcauucacgccaaacacgaguggaugaccacggaagauaugcuuacagucuggaauagaguguggauccaggagaaccccuggauggaagacaagaccccuguggagucuugggaagagguucccuaucugggaaaacgcgaggaucaguggugcggcucccucauugggcugaccagccgggcuacaugggccaagaacauccagaccgccauuaaucaagugagaucccugaucggaaacgaagaguacacagacuauaugccuucuaugaagcgcuuucggagagaagaggaagaggcuggcguccucugguga

SEQ ID NO: 20192 - RNA, 9876 nt, Artificial Sequence
  derived and/or modified CDS sequence (opt5) from DENV-2__FM210234__SS-prME
accgccggagugaucauuaugcugauccccaccgcuauggccuuccaccucacgaccagaaacggggaaccucauaugauugucggacggcaggaaaagggcaaaagccugcuuuuuaagaccgaagacgggguuaauaugugcacccugauggcgaucgaucucggagaacugugugaagacacaauuaccuacaaaugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggaaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgggaaggacucccccgugaacauugaagccgagccucccuuuggcgauagcuacaucauuaucggagucgaaccuggccagcucaaacugaauugguucaagaaggggucuuccaucggacaaauguuugagacaaccaugagaggcgccaaacgcauggcuauucuuggggacacagccugggauuucggaagccugggcgggguguuuaccucuaucggcaaggcgcuccaccagguuuucggagcuauuuacggcgccgccuuuagcgggguguccuggacgaugaaaauccugauuggagucaucaucacauggauuggcaugaacucucggagcaccucccugagcgugucucuugugcucguuggggucaucacccuguaucugggagcuauggugcaggccgacuccggcuguguggucagcuggaagaauaaagagcucaagugcgggucuggcauuuucaucacagauaacgugcacaccuggacagaacaguacaaguuucaacccgaguccccgagcaaacuggcuuccgccauucagaaggcgcaugaagagggaaucuguggcaucagaucuguuacgcgccuugaaaaucugauguggaaacagauuaccccugagcucaaccacauccugagcgagaaugaagugaagcugacaauuaugaccggggacaucaaaggaauuaugcaggccggcaagcggucccuuagaccccaaccuacagagcucaaauauucuuggaagaccugggggaaggcuaaaaugcugagcacggaaucccauaaccagaccuuccugaucgauggacccgagacagccgaaugcccuaauaccaaccgcgcuuggaauagccucgaggucgaggacuacggcuuuggcguguucacaaccaacaucuggcugaaacuucgggaaaaacaggacgucuuuugugauucuaagcugauguccgccgcgauuaaagacaauagagccgugcacgcugauaugggguauuggaucgagagcgcccucaacgacacauggaagauggaaaaggcuucuuucauugaggucaaauccugccacuggcccaagagccauacccuguggucuaauggagugcuggagagcgaaaugaucauuccgaaauccuucgccggcccuguuagccagcacaacuaccgccccggguauuacacgcaaacagccggacccuggcaucuuggcaagcucgagauggauuuugacuucugugaagggaccaccguggucgugacagaggauugcggaaaccggggcccuucucugagaaccacgacagcuuccggcaaacugaucaccgaauggugcugucggagcugcacacucccgccccugcgcuacagaggggaggacggauguugguauggcauggagauucggccucuuaaggaaaaggaggaaaaucuggugaacucccucgucaccgcggggcacggacagaucgauaauuuuucucugggcguucuggggaucgcccuuuuccucgaggaaaugcugagaacacgcgugggaaccaaacaugcuauucugcucguggccgucagcuuugugacgcugaucaccggcaacauguccuuccgggaccuuggcagaguuauggugauggucggggccgcuaugacagaugacauuggaaugggcgugaccuaccuggcccuccuggcggcuuuuaagguucgccccacauucgccgccgggcugcuucugagaaaacucaccucuaaggagcugaugauggcuacgaucggaauugcccuccugagccaguccacaaucccugagaccauccuugaacugacagaugcgcucgcucugggcaugauggugcugaaaauuguccggaauauggagaaguaucaacuugccgugaccaucauggccauuucuugcguucccaacgcugugauccugcagaaugccuggaaggucagcuguaccauucucgcuacaguguccgugagcccucugcuccugacgucuucccagcagaaagccgacuggaucccccuugcgcugaccaucaaggggcucaacccgacagccauuuuucugaccacacugagccgcaccucuaaaaagagauccuggccucuuaaugaagcuaucauggccgucggaaugguuagcauucuggcuucuucccuccugaaaaacgacauccccaugacgggcccucucguggccggcgggcugcuuacagugugcuacguccugaccggacggagcgccgaucuggagcucgaacgcgcuaccgacgugaagugggaggaucaagcggagauuuccggcagcucucccauccugagcauuacaaucgccgaagacggguccaugucuaucaaaaaugaggaagaggagcagacccuuacaauucugaucagaacgggacuccugguuauuagcggccucuucccgguguccaucccuauuaccgcugccgccugguaucugugggaagucaagaagcagcgggcuggggugcuuugggauguucccucuccuccgcccgugggaaaagccgagcuggaagacggcgcguaccgcaucaagcagaaaggcauccugggguauagccaaauuggagcuggcgucuacaaggaggggacauuucacaccauguggcacgugacaagaggagccguccucaugcaucggggcaaacgcaucgaaccuuccugggccgaugugaagaaggaccugauuucuuacgggggaggcuggaaacuugagggcgaguggaaggaaggggaggaaguucaggugcuggcucucgagccgggcaagaaccccagagccguccagaccaagccuggccuguucaaaacgaauaccgggacaaucggagcggugagccucgauuuuucccccggcaccagcgggucuccuauuguugaccggaagggaaagguggucggccuguauggcaacgggguggugacaagauccggagcuuacguuagcgccaucgcccagaccgaaaaaucuaucgaggauaaucccgagauugaagacgauaucuuccgcaagaaacggcuuacaauuauggaccugcacccuggcgcugggaagacgaaaagauaucugccggccaucguccgcgaggcuauuaagcggggacucagaacccugauccuugcccccacacgcgugguggcggccgaaauggaggaagcucugcggggccucccuauuagauaccaaacccccgccauccgcgcugagcauaccgggcgggagaucgucgaccugaugugucacgccacauucacgaugagacuccuguccccugugcggguucccaacuauaaccuuauuaucauggaugaagcccauuuuaccgacccggcuagcauugcggcccgcggcuacaucuccacaagaguggagaugggagaagcugccggcauuuucaugaccgccacaccucccgggucucgggaucccuuuccucagagcaaugcucccaucauggacgaggagcgcgaaaucccugagagauccuggaacagcggacacgaaugggucaccgauuucaagggcaaaacggugugguuuguuccgucuauuaaggccgggaaugacaucgcggcuugccugcggaaaaacggaaagaaagugauucagcuguccagaaagacauucgauagcgaguaugucaagacccgcaccaaugacugggauuuugugguuacaaccgacaucucugaaaugggcgccaacuucaaagccgagcgggugauugaucccagacgcuguaugaagccugucauccucacagacggggaggaacgggugauccuggcuggccccaugccugugacccacagcuccgccgcgcaaagacgcggacggauuggcagaaaucccaaaaacgagaaugaccaguacaucuacaugggggaaccgcuugagaacgaugaagacugcgcccauuggaaggaggcuaaaaugcugcucgauaauauuaacacgccugagggaaucauucccucuauguuugaaccugagcgcgaaaaggucgacgccaucgauggcgaguauagacugagaggggaagcucgcaaaacauucguugaccugaugagacggggagaucuccccguguggcuugccuaccgcguggcugccgagggcauuaauuaugcggacagacggugguguuuugauggggucaagaacaaucagauccuggaggaaaacguggagguugaaaucuggaccaaggagggcgagcgcaagaagcugaaaccucgcuggcucgacgcccggauuuacagcgauccccuggcucuuaaggaguucaaagaguucgccgcuggaagaaagucccugacacucaaccugaucaccgaaaugggccgccugccgacguuuaugacccagaaggcccgggacgcccucgauaaucuugcugugcugcacacagcggaggccgggggacgggcuuauaaccaugcccugucugaacucccugagacccuggagacacuucugcuccugacccugcucgccacagucaccggcgggauuuuccuuuuucugaugagcggaaaaggcgugggcaagaugacgcuggggaugugcugcaucauuacagcuuccauccuccuguggcacgcccaaauccagccccacuggauugcggccagcaucauucuugaguucuuucugaucguucuccugauucccgagccugaaaaacagcggaccccgcaggacaaucaacugaccuacguggucaucgcuauccucacaguggucgccgcuaccauggccaacgagaugggauuccuugaaaagaccaagaaggaccugggccuggggucuauugcgacgcaggagcccgaguccaauauccucgauauugaccugcgcccugccagcgcuuggacccuuuaugccguggcuacaaccuuuguuacacccaugcugagacauuccaucgaaaacucuagcgugaaugugucccucaccgccauugcuaaccaggccacgguccugaugggacugggcaagggguggccucucucuaaaauggauaucggaguuccccuucuggcgauuggcuguuacagccaggugaauccuaucacccugacagccgcucuccugcuucugguggcccacuacgcuaucauuggcccggggcuccaagccaaggccacccgggaggcgcagaaacgcgcugccgcuggaaucaugaagaaccccacagucgacggcauuaccgugaucgaucuggacccuauucccuaugauccuaaauucgaaaagcagcuggggcagguuaugcuccuuauccugugcgugacgcaaguccugaugaugagaacaaccugggcccucugugaggcccugacacuugcuaccggacccaucuccacccugugggaaggcaauccggggcgguuuuggaacacaacgauugccgugagcauggcgaauaucuuccgcggaucuuaccucgccggcgcuggccugcuguuuuccauuaugaagaacaccacaaauaccagacgggggacaggaaacaucggcgagacccucggggagaaauggaaaagccgccuuaaugcccugggaaaaucugaguuccagauuuauaagaaauccggcauccaggaggucgacagaacgcuggcuaaggaagggaucaaacggggagagacagaucaucacgccgugagcagaggcucugcgaagcuccgcugguuuguugagcggaacauggugaccccugaaggcaaggucguggaccuggggugcggaagaggcggguggagcuacuauuguggaggccuuaaaaacguucgcgaggugaaggggcugaccaaaggaggccccggccaugaagaacccauuccuauguccacauacggguggaaucucguccggcugcaaucuggaguggauguguucuucacacccccugaaaagugcgacacccugcucugugauaucggcgagagcuccccgaaccccacgauugaggccgggagaacccuucgcguucugagccuggucgaaaauuggcucaacaaugacacacaguuuugcaucaaagugcugaacccuuauaugcccuccgugauugagaagauggaaacccuucagcggaaguacggaggcgcucuggucagaaauccucucucucgcaacagcacacacgagauguacuggguuuccaaugccaccgggaacaucgugucuagcgugaauaugaucucccggaugcugauuaacagauucacgaugaaacacaagaaagcuaccuaugaacccgacgucgaucugggaucuggcacacgcaauaucggcauugagagcgagaucccgaaccucgacauuaucgggaagcggauugagaagaucaagcaggagcaugaaaccuccuggcacuacgaucaagaccauccuuauaagacaugggccuaccacggaagcuaugagaccaaacagacaggcucugcuuccagcauggugaaugggguugugagacuucugaccaagcccugggaugucgugccuaugguuacgcagauggccaugacagacaccacccccuuuggacagcaacgcguguucaaagaaaaggucgauacaagaacgcaggagccuaaagagggcaccaagaagcugaugaaaaucacagcggaauggcucuggaaggagcuggggaaaaagaaaacaccccggauguguacacgcgaagaguuuaccagaaaggugcggucuaacgccgcucuuggagccauuuucacagacgagaacaaauggaaguccgcuagagaagccguggaggauagccgguuuugggaacuggucgacaaggagcgcaaucuccaccuggaaggcaaaugcgagaccuguguuuacaacaugaugggcaagagagagaaaaagcugggggaguucggaaaagccaagggcucucgggcgaucugguauauguggcucggggcucgcuuucuggaguucgaagcccuuggauuucugaaugaggaucauugguucuccagagaaaacagccucuccggcguggagggggagggccugcacaaacuuggauacauucugcgggacgugagcaaaaaggaaggcggggccauguacgcugacgauacggccggaugggacacccgcaucacacucgaggaucugaaaaaugaagagauggucaccaaccauauggaaggcgagcacaagaaacuggcugaggccauuuuuaagcucacauaucagaauaaggugguuagagugcagcggccgaccccucgcgggacggucauggacaucaucucuagacgggaucaacgcggaagcggccagguggggacauacggccugaacaccuucacaaauauggaagcgcagcuuauuagacaaauggagggagaaggcaucuucaaauccauucagcaucugaccguuacggaggagaucgccgugcagaacuggcucgcucgggucgggcgcgaaagacugucucggauggccauuagcggagacgauugcgugguuaagccccuugacgauagauuugcuuccgcccugaccgcgcucaaugacaugggcaaagugcgcaaggauauccagcaaugggagcccucucggggguggaacgacuggacacaggucccuuucugcagccaccacuuucaugaacugaucaugaaagauggaagagugcuggucgugccgugucgcaaucaggacgagcucauuggccgggccagaaucucccagggggcuggcuggucucugaaggaaaccgccugccuuggaaagagcuaugcucaaauguggucccugauguacuuccaccgccgggaccucagacuggccgcuaacgccauuuguagcgcgguucccucucauugggugccuacaucccgcaccacauggagcauccacgccaaacacgaguggaugaccacggaggauaugcuuacagucuggaaucggguguggauucaggaaaaccccuggauggaggacaagaccccuguggaaucuugggaggaaguucccuaucugggcaaaagagaggaucaguggugcgggucccucaucggacugaccagccgcgcuacaugggccaagaacauucagaccgccaucaaucaagugcggucccugaucggcaacgaggaauacacagacuauaugccuucuaugaaaagauuucggagagaggaagaggaagcugggguccucugguga

SEQ ID NO: 20193 - RNA, 9876 nt, Artificial Sequence
  derived and/or modified CDS sequence (opt5) from DENV-2__FM210213__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaggaacaggacaaacgcuuugugugcaagcauuccaugguggauagaggcuggggcaacggguguggacuguucggcaaagggggaaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucguggccgucagcuuugugacgcugauuaccggaaacauguccuuccgggaccuuggcagaguuauggugauggucggcgccgcuaugacagaugacaucgggaugggagugaccuaccuggcccuccuggcggcuuuuaagguucgccccacauucgccgccggccugcuucugagaaaacucaccucuaaggagcugaugauggcuacgauugggaucgcccuccugagccaguccacaauuccugaaaccauccuugagcugacagaugcgcucgcucugggaaugauggugcugaaaaucguccggaauauggaaaaguaucaacuugccgugaccauuauggccaucucuugcguucccaacgcugugauucugcagaaugccuggaaggucagcuguaccauccucgcuacaguguccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccgucgggaugguuagcauccuggcuucuucccuccugaaaaacgacauucccaugacgggaccucucguggccggcggccugcuuacagugugcuacguccugaccgggcggagcgccgaucuggaacucgagcgcgcuaccgacgugaagugggaggaucaagcggaaaucuccggaagcucucccauucugagcaucacaauugccgaggacggcuccaugucuaucaaaaaugaagaggaggaacagacccuuacaauccugauuagaacggggcuccugguuaucagcggacucuucccgguguccauuccuaucaccgcugccgccugguaucugugggaggucaagaagcagcgggcuggcgugcuuugggauguucccucuccuccgcccguggggaaagccgaacuggaggacggagcguaccgcauuaagcagaaaggcauccugggcuauagccaaaucggggcuggagucuacaaggaaggcacauuucacaccauguggcacgugacaagaggggccguccucaugcaucggggaaaacgcauugagccuuccugggccgaugugaagaaggaccugaucucuuacggcgggggauggaaacuugagggcgaauggaaggagggcgaagagguucaggugcuggcucucgaaccggggaaaaaccccagagccguccagaccaagccuggacuguucaaaacgaauaccggcacaauuggggcggugagccucgauuuuucccccggaaccagcggcucuccuaucguugaccggaaggggaagguggucggacuguauggcaacggcguggugacaagauccggggcuuacguuagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguccgcgaagcuaucaagcgggggcucagaacccugauucuugcccccacacgcgugguggcggccgagauggaagaggcucugcggggacucccuaucagauaccaaacccccgccauucgcgcugagcauaccggccgggaaaucgucgaccugaugugucacgccacauucacgaugagacuccuguccccugugcggguucccaacuauaaccuuaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccugcggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucucacagacggcgaagaacgggugauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaaggucgacgccauugauggagaauauagacugcggggcgaggcucgcaaaacauucguugaccugaugagaagaggggaucuccccguguggcuugccuaccgcguggcugccgagggaaucaauuaugcggacagacggugguguuuugauggcgucaagaacaaucagauucuggaagagaacguggaaguugagaucuggaccaaggagggggaacgcaagaagcugaaaccucgcuggcucgacgcccggaucuacagcgauccccuggcucuuaaggaguucaaagaguucgccgcuggcagaaagucccugacacucaaccugauuaccgagaugggacgccugccgacguuuaugacccagaaggcccggaaugcccucgacaaccuugcugugcugcacacagcggaagccggcgggagagcuuauaaucaugcccugucugagcucccugagacccuggaaacacuucugcuccugacccugcucgccacagucaccggaggcaucuuccuuuuucugaugagcgggaaaggagugggcaagaugacgcugggcaugugcugcauuaucacagcuuccauucuccuguggcacgcccaaauccagccccacuggaucgcggccagcauuauccuugaguucuuucugauuguucuccugauccccgaaccugagaaacagcggaccccgcaggauaaccaacugaccuacguggucauugcuauccucacaguggucgccgcuaccauggccaaugaaaugggguuccuugagaagaccaagaaggaccugggacugggcucuaucgcgacgcaggagcccgaauccaacauucucgacaucgaucugcgcccugccagcgcuuggacccuuuaugccguggcuacaaccuuuguuacacccaugcugagacauuccauugaaaauucuagcgugaacgugucccucaccgccaucgcuaaucaggccacgguccugauggggcugggaaagggcuggccucucucuaaaauggacauugggguuccccuucuggcgaucggauguuacagccaggugaacccuauuacccugacagccgcucuccugcuucugguggcccacuacgcuaucaucggcccgggccuccaagccaaggccacccgggaagcgcagaaacgcgcugccgcugggauuaugaagaaucccacagucgauggaaucaccgugauugaccuggauccuauccccuaugacccuaaauucgagaagcagcugggccagguuaugcuccuuauucugugcgugacgcaaguccugaugaugagaacaaccugggcccucugugaagcccugacacuugcuaccgggcccaucuccacccugugggagggaaacccgggccgguuuuggaauacaacgaucgccgugagcauggcgaacauuuuccgcgggucuuaccucgccggagcuggccugcuguuuuccaucaugaagaauaccacaaacaccagacggggcacagggaauauuggagagacccucggcgaaaaauggaaaagccgccuuaacgcccuggggaaaucugaguuccagaucuauaagaaauccggcauucaggaagucgauagaacgcuggcuaaggagggcaucaaaagaggggaaacagaccaucacgccgugagcagaggaucugcgaagcuccgcugguuuguugaacggaacauggugaccccugagggcaaggucguggaucugggcugcgggagaggaggcuggagcuacuauugugggggacuuaaaaauguucgcgaagugaagggccugaccaaagggggacccggccaugaggaacccaucccuauguccacauacggcuggaaccucguccggcugcaaucugggguggacguguucuucacacccccugagaagugcgauacccugcucugugacauuggagagagcuccccgaaucccacgaucgaagccggcagaacccuucgcguucugagccuggucgagaacuggcucaauaacgauacacaguuuugcauuaaagugcugaauccuuauaugcccuccgugaucgaaaagauggagacccuucagcggaaguacgggggagcucuggucagaaacccucucucucgcaauagcacacacgaaauguacuggguuuccaacgccaccggcaauauugugucuagcgugaacaugaucucccggaugcugaucaauagauucacgaugaaacacaagaaagcuaccuaugagcccgacgucgaccuggggucuggaacacgcaacauuggcaucgagagcgaaauuccgaaucucgauaucauuggcaagcggaucgagaaaauuaagcaggaacaugagaccuccuggcacuacgaccaagaucauccuuauaagacaugggccuaccacgggagcuaugaaaccaaacagacaggaucugcuuccagcauggugaacggcguugugagacuucugaccaagcccugggacgucgugccuaugguuacgcagauggccaugacagauaccacccccuuugggcagcaacgcguguucaaagagaaggucgacacaagaacgcaggagccuaaagaaggaaccaagaagcugaugaaaaucacagcggaguggcucuggaaggaacugggcaaaaagaaaacaccccggauguguacacgcgaggaguuuaccagaaaggugcggucuaacgccgcucuuggggccaucuucacagaugaaaauaaauggaaguccgcuagagaggccguggaagacagccgguuuugggagcuggucgauaaggaacgcaaccuccaccuggagggaaaaugcgagaccuguguuuacaauaugaugggcaagagagagaagaagcugggcgaguucgggaaagccaagggaucucgggcgauuugguauauguggcucggcgcucgcuuucuggaguucgaggcccuuggguuucugaacgaagaccauugguucuccagagagaauagccucuccggaguggagggcgaagggcugcacaaacuuggcuacauccugcgggaugugagcaaaaaggagggaggcgccauguacgcugacgacacggccgggugggauacccgcauuacacucgaagaccugaaaaacgaggaaauggucaccaaucauauggagggagagcacaagaaacuggcugaagccaucuuuaagcucacauaucagaacaaggugguuagagugcagcggccgaccccucgcggcacggucauggauauuaucucuagacgggaccaacgcgggagcggacaggugggcacauacgggcugaauaccuucacaaacauggaggcgcagcuuaucagacaaauggaaggcgagggaauuuucaaauccauccagcaucugaccguuacggaggaaauugccgugcagaauuggcucgcucgggucggccgcgagagacugucucggauggccaucagcggggaugacugcgugguuaagccccuugaugacagauuugcuuccgcccugaccgcgcucaacgauaugggaaaagugcgcaaggacauucagcaaugggaacccucucggggcuggaaugauuggacacaggucccuuucugcagccaccacuuucaugagcugaucaugaaagacgggagagugcuggucgugccgugucgcaaccaggaugaacucaucggacgggccagaauuucccagggcgcuggguggucucugaaggagaccgccugccuuggcaagagcuaugcucaaauguggucccugauguacuuccaccgccgggaccucagacuggccgcuaaugccaucuguagcgcgguucccucucauugggugccuacaucccgcaccacauggagcauucacgccaaacacgaguggaugaccacggaagacaugcuuacagucuggaaccggguguggauccaggagaaccccuggauggaagauaagaccccuguggagucuugggaagagguucccuaucugggaaaaagagaggaccaguggugcggcucccucauugggcugaccagccgcgcuacaugggccaagaauauccagaccgccauuaaccaagugcggucccugaucggaaaugaagaguacacagauuauaugccuucuaugaaaagauuucggagagaagaggaagaggcuggcguccucugguga

SEQ ID NO: 20194 - RNA, 9876 nt, Artificial Sequence
  derived and/or modified CDS sequence (opt5) from DENV-2__FM210235__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagagcaggacaaacgcuuugugugcagacauuccaugguggaucggggcuggggcaacggguguggacuguucggcaaggggggaaucgucaccugcgccauguuuacaugcaagaaaaauauggaaggcaagauuguucagccugagaaccucgaauacacgaucgugauuaccccccacagcggggaggagcaugcugugggaaaugacacaggcaaacacggcaaggaaaucaaaaucaccccucagucucccauuacagaggccgaacugaccggguauggaacggucaccauggaguguuccccgcgcacaggccuugauuucaacgaaauggugcugcuccaaauggaggacaaggcuuggcugguucacagacagugguuucuugaucugccucuccccuggcugccuggggccgacacccagggaagcaauuggauccagaaagagacacuggugaccuucaagaacccccaugccaagaaacaagacgucgugguucucggcucucaggaaggggcuaugcacacggcgcugacaggcgccaccgagauucagauguccagcggaaaucuucuguuuacaggccaucucaagugccggcugagaauggauaaacuucaacugaaggggauguccuacucuauguguaccggaaaauucaagaucgugaaggaaauugcugagacccagcacggcacaaucgucauccgcgugcaguaugagggggacggaagccccugcaaaauuccuuucgaaaucauggaucucgagaagcggcauguccugggcagacugauuacggugaacccgaucguuaccgaaaaagacucccccgugaacauugaggccgaaccucccuuuggggauagcuacaucauuaucggcgucgagccuggacagcucaagcugaauugguucaaaaagggcucuuccaucgggcaaauguuugagacaaccaugcgcggagccaagcggauggcuauucuuggcgacacagccugggauuucgggagccugggaggcguguuuaccucuaucgggaaagcgcuccaccagguuuucggcgcuauuuacggagccgccuuuagcggcguguccuggacgaugaagauccugauuggggucaucaucacauggauuggaaugaacucuagaagcaccucccugagcgugucucuugugcucguuggcgucaucacccuguaucugggggcuauggugcaggccgacuccggauguguggucagcuggaaaaauaaggaacucaaaugcggcucugggauuuucaucacagauaacgugcacaccuggacagagcaguacaaguuucaacccgaauccccgagcaagcuggcuuccgccauucagaaagcgcaugaggaaggcaucuguggaauccgcucuguuacgcggcuugagaaucugauguggaagcagauuaccccugagcucaaccacauccugagcgaaaaugaggugaaacugacaauuaugaccggcgacaucaaggggauuaugcaggccggaaaaagaucccuucgcccccaaccuacagaacucaaguauucuuggaaaaccuggggcaaggcuaagaugcugagcacggagucccauaaccagaccuuccugaucgaugggcccgaaacagccgagugcccuaauaccaaccgggcuuggaauagccucgaggucgaagacuacggauuuggcguguucacaaccaacaucuggcugaaacuuagagagaagcaggacguuuuuugugauucuaaacugauguccgccgcgauuaaggacaaucgcgccgugcacgcugauaugggcuauuggaucgaaagcgcccucaacgacacauggaaaauggagaaggcuucuuucauugaggucaaguccugccacuggcccaaaagccauacccuguggucuaauggggugcuggaaagcgagaugaucauuccgaaguccuucgccggaccuguuagccagcacaacuaccggcccggcuauuacacgcaaacagccgggcccuggcaucuuggaaaacucgaaauggauuuugacuucugugagggcaccaccguggucgugacagaagauugcgggaacagaggaccuucucugcggaccacgacagcuuccggcaagcugaucaccgaguggugcugucgcagcugcacacucccgccccugagauaccggggcgaggacggguguugguauggaauggaaauuagaccucuuaaagagaaggaagagaaucuggugaacucccucgucaccgcgggccacgggcagaucgauaauuuuucucugggaguucugggcauggcccuuuuccucgaagagaugcugcgcacacggguggggaccaagcaugcuauccugcucgugacggucagcuuugugacccugauuacaggaaacauguccuucagagaccuuggccgcguuauggugauggucggcgccgccaugaccgaugacaucgggaugggagugacauaccuggcucuccuggccgcguuuaaaguuagacccaccuucgcugccggccugcuucugcggaagcucacgucuaaagagcugaugauggccacaauugggaucgcucuccugagccaguccaccauuccugaaacaauccuugagcugaccgaugcccucgcgcugggaaugauggugcugaagaucguccgcaauauggaaaaauaucaacuugcugugaccauuauggccaucucuugcguucccaacgccgugauucugcagaaugcuuggaaggucagcuguacaauccucgccgcuguguccgugagcccucugcuccugacgucuucccagcagaaggccgacuggauuccccuugaguggagcaucaaaggccugaacccgaccgcgaucuuucucacaacccugucuagaacauccaagaaacggagcuggccucugaaugaagccauuauggcugucgggaugguuucuauccuugccuccagccugcucaagaacgacauucccaugaccggaccucugguggcuggcggccuccugacggugugcuacguccuuacagggcgcuccgccgaucuggagcuggagagagccaccgacgugaaaugggaagaucaagcugagaucagcggaucuagccccauucucuccaucaccauugcggaagacggcucuaugagcaucaagaaugaggaggaagagcagacacugaccauccuuauucggacagggcugcucguuaucuccggacuguucccggugucuauuccuaucacggccgcugccugguaucucugggaagucaaaaagcagcgcgccggcgugcugugggauguucccagcccuccccccguggggaaggcugagcuugaagacggagccuacagaauuaaacagaagggcauccugggcuauucccaaaucggggcgggagucuacaaagagggcaccuuucacacaauguggcacgugacccggggggcuguccugaugcaucgcggaaagagaauugagccuucuugggccgaugugaaaaaggaccucaucagcuacggcgggggauggaagcuggaaggcgaguggaaagaaggcgaggaaguucaggugcuugcccuggagccggggaagaacccccgggcuguccagacaaaaccuggacucuucaagaccaauacgggcaccauuggggccgugucccuggauuuuagccccggaacaucuggcuccccuaucguugacagaaaagggaagguggucggacucuauggcaacggcguggugacccgcagcggggcguacguuucugcuauugcccagacagagaaguccaucgaagauaaucccgagaucgaagacgauauuuuccggaaaaagagacugaccaucauggaccuucacccuggagccggcaaaacaaagcgcuaucugccggcuauuguccgggaggccaucaaaagagggcugcgcacgcucauucuggcucccacccgggugguggccgcggaaauggaggaggcccuuagaggacugccuauccgcuaccaaacacccgcuauucgggccgaacauaccggcagagagaucgucgaccucaugugucacgcuaccuucacaaugcggcugcucagcccugugcgcguucccaacuauaaccugaucauuauggaugaagcccauuuuacggacccggccuccaucgcugcgagaggguacauuucuacccggguggagaugggcgaggccgcuggaaucuucaugacagccaccccucccggcagccgcgaucccuuuccucaguccaaugcccccauuauggacgaagagagagaaaucccugagcggagcuggaacucugggcacgaaugggucacagauuucaagggaaagaccgugugguuuguuccguccaucaaagcuggcaaugacauugccgcgugccuuagaaagaacgggaaaaaggugauccagcugagccgcaaaacguucgauucugaguaugucaagacacggaccaaugacugggauuuugugguuaccacagacauuagcgagaugggagcuaacuucaaggccgaaagagugaucgauccccgccgguguaugaaaccugucauucugaccgacggcgaggaaagagugauccucgccgggcccaugccugugacacacuccucugcugcccaacgccggggcagaaucggacgcaaucccaagaacgagaaugaccaguacauuuacaugggcgaaccgcuggagaacgaugaggacugcgcgcauuggaaagaagccaagaugcuucuggauaauaucaacaccccugaggggauuauccccagcauguuugaaccugagagagaaaaagucgacgcuauugauggagaguaucggcuccgcggcgaggccagaaagacguucguugaccugaugcggcgcggggaucugcccguguggcucgcuuacagaguggccgcugaaggaaucaauuaugccgaccggagaugguguuuugauggcgucaaaaacaaucagauucuugaggaaaacguggagguugagaucuggacaaaggaaggggagcgcaagaaacugaagccucgguggcuggacgcgagaaucuacuccgauccccucgcccugaaagaauucaaggaguucgcugccggccgcaaaucucuuacccugaaccucauuacagaaaugggacggcugccgaccuuuaugacgcagaaggcuagagacgcccuggauaaucucgccgugcuucacaccgcugaggcgggcgggcgggccuauaaccaugcucugagcgagcugccugaaacacucgagacccugcuucugcucacacugcuggccaccgucacaggaggcaucuuccucuuucuuauguccgggaagggagugggcaaaaugacccugggcaugugcugcauuaucacggccagcauucugcucugguacgcucaaauccagccccacuggaucgccgcgucuauuauccuggaauucuuucuuauuguucugcucauccccgagccugaaaagcagcgcacaccgcaggacaaucaacugaccuauguggucauugccauccugaccguggucgcugccacaauggcuaacgagaugggguuccucgagaaaaccaagaaagaccuuggacugggcuccaucgccacaagagaacccgagagcaauauucuggauaucgaccuccggccugcguccgccuggacgcuguacgcuguggccaccacauuuguuacccccaugcuucgccacucuauugaaaacagcuccgugaaugugucucugacagcuaucgccaaccaggcuaccguccucauggggcugggaaagggcuggccucugagcaagauggauauugggguuccccuccuugccaucggauguuacucccaggugaauccuauuacgcugaccgcggcccugcuccugcuuguggcucauuaugccaucaucggcccgggccugcaggcuaaagccacaagagaggcccaaaagcgggcggcugccgggauuaugaaaaaccccaccgucgacggagugacaguuaucgaucucgacccuauucccuacgauccuaaguucgaaaaacagcugggccaggugaugcugcucauccuuugcgucacccaggugcugaugaugcgcacgacaugggcucugugugaggcccucacccuggccacagggcccauuagcacccuuugggagggaaauccgggcagauuuuggaacaccacaaucgcugucucuauggccaauaucuuccggggguccuaucuggcgggagccggccuccuguuuagcauuaugaagaacacgaccaauacacgcagaggcaccgggaacaucggagaaacacugggcgagaaguggaaaucucggcucaaugcucuugggaaguccgaauuccaaauuuacaaaaagagcggaauccaggagguggacagaacccuggccaaagagggcauuaagcgcggggaaacggaucaccaugcuguuucucggggaagcgccaaacugagaugguuuguggagcgcaacauggucacaccugaaggcaaggugguugaccucggcugcgggcggggaggcugguccuauuacugugggggacugaagaacgugagagaggucaaaggccuuaccaaggggggacccggccacgaagagcccaucccuaugucuaccuauggcuggaaucuggugcgccuccagagcgggguggauguuuucuucacacccccugagaaaugcgacacccugcugugugauaucggagaauccagcccgaaccccacaauugaggcgggccggacgcucagaguccuuucccugguggaaaauuggcugaacaaugacacccaauuuugcaucaaggugcucaacccuuacaugcccucugucauugagaaaauggaaacacugcagcgcaaguacgggggagcccuuguucggaauccucugagcagaaacuccacccaugagauguauugggugucuaaugcuacaggcaacaucgugagcuccgucaauaugauuucucgcaugcucaucaaccgguucaccaugaagcacaaaaaggccacguacgagcccgacguggaucuggggagcggaaccagaaauaucggcauugaauccgagaucccgaaccuggacauuaucggcaaacgcauugaaaagaucaaacaggagcacgaaacaagcuggcauuaugaucaggaccacccuuacaagaccugggcuuaucaugggucuuacgagacaaagcaaaccggauccgccagcucuaugguuaauggcguggucagacuccuuacaaaacccugggaugugguuccuauggugacccagauggcuaugacggacacaacccccuuugggcagcagcgggucuucaaggagaaaguggauacccgcacacaagaaccuaaggagggaacgaaaaagcugaugaagauuaccgccgaauggcuguggaaagagcucggcaagaaaaagacacccagaauguguacccgggaggaauuuacaagaaaagugcgguccaacgcggcccugggggcuaucuucaccgacgagaacaaguggaaaagcgcccgcgaagcugucgaggauucuagauuuugggaacuuguugacaaggagcggaaucugcaccucgagggaaagugcgaaacauguguguauaacaugaugggcaaacgcgagaagaaacugggcgaauucgggaaggccaaaggauccagagccaucugguacauguggcugggcgcgcgguuucucgaguucgaagcucugggguuucuuaaugaggaucacugguucagccgcgagaacucccugagcggaguggaaggcgaggggcuccauaagcugggcuacauucuuagagacgucucuaagaaagaaggaggcgccauguaugccgacgauaccgcugggugggacacgcggaucacccuggaggaucucaagaaugaagagauggugacaaaccacauggagggagaacauaaaaagcuggccgaggcuauuuuuaaacugaccuaccagaauaagguugugcgcguccagagaccgacaccucggggcaccgugauggacaucauuagccgcagagaucagcggggguccggacaaguuggcacguaugggcucaacacauucaccaauauggaagcccagcugauccgccagauggagggcgagggaguguucaagucuauccaaagacuuacagucaccgaagagauugcggugcagaacuggcuggcccggguuggcagagaacgccucagccggauggcuaucuccggggacgauugcguggucaaaccccuggacgauagauuugccucugcucuuacggcccugaaugacaugggaaaggugcgcaaagauauucagcagugggagcccagccggggcuggaacgacuggacccaagucccuuucugcucccaccauuuucacgaacucaucaugaaggaugggagagugcugguugugccgugucgcaaucaggacgagcugauuggacgggcgagaaucucucagggcgccggguggagccucaaagagacagcuugccugggcaaguccuacgcccagauguggagccuuauguauuuccaccgccgggaccugagacucgcugccaacgcuaucuguucugccguccccucccauugggugccuaccagccgcacaaccuggucuauucacgcgaagcaugaauggaugacaaccgaggauaugcugacgguguggaaucggguuuggauccaagaaaaccccuggauggaggacaaaacaccuguggaauccugggaggagguccccuaccuuggaaagagagaagaucaguggugcggcagccugauugggcucaccucccgggccaccugggcuaaaaacauccagacagccauuaaucaggugagaucucugaucggaaacgaggaauauaccgacuacaugccuagcaugaagcgcuuucggagagaggaagaggaggccggcguucugugguga

SEQ ID NO: 20195 - RNA, 9876 nt, Artificial Sequence
  derived and/or modified CDS sequence (opt5) from DENV-2__FM210205__SS-prME
agcgccggcaugaucauuaugcugauccccaccgugauggcuuuccaccugacaacgagaaauggggaaccucauaugauugucggaauccaggaaaagggcaagucccugcuuuuuaagaccgaagacgggguuaauaugugcacacugauggccauggaucucggagaacugugugaagacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcucaagaaacugaccuccaaggagcucaugaugacaaccauuggcaucgugcugcuuucucaaagcacgauucccgaaacaguccuggagcucaccgaugcccuggcccuggggaugauggugcuuaaaaucgugcggaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucuagaacaaauaagaagcgcuccuggccgcucaacgaggccaucauggcugugggcauggucagcauucuggccucuucccuccugaaaaaugacaucccuaugaccgggccccuuguggcgggaggccugcugacgguuugcuaugugcucacaggcagaagcgccgaucuggaacuugagcgggcuaccgacgucaagugggaggaucaggccgaaauuucuggguccagcccuauccuguccauuaccaucagcgaggacggaucuaugagcauuaaaaacgaagaggaggaacagacacucaccauccugauccgcacaggccuccuggugauuuccgggcuuuuucccaucucuauuccgaucacggcugccgccugguaccugugggaggucaagaaacagagagcuggagugcugugggauguuccuucucccccucccaugggcaaggcggaacucgaggacggggccuaucggauuaagcaaaaaggaauccugggcuacucccagaucggcgcugggguguacaaggaaggaaccuuccacacaauguggcaugucacccgcggcgccgugcuuaugcacaaagggaagagaauugagcccuccugggccgauguuaaaaaggaccugaucagcuauggaggcggguggaagcucgagggagaauggaaagagggcgaagaggugcagguccuggcucucgaaccuggcaagaauccgcgggccgugcagacaaaacccgggcuguuuaagaccaacacgggaaccauuggcgcggugucccuugauuucucuccugggacaagcggaucccccaucauugacaaaaagggcaagguugucgggcuguacggaaacggcguggugacccgcagcggcgcuuaugucucugccaucgcccaaacagagaaauccaucgaggauaauccugaaauugaggacgauaucuuuagaaagcggcgccugaccauuauggaccuccaccccggggcuggaaaaacaaagagauaccugccugccaucgugcgggaagcgauuaaaagaggccuucgcacgcugauccucgcuccgacccggguuguggccgccgagauggaagaggcucugagagggcuccccauucgcuaucagaccccugccauccgggcugagcauaccggaagagaaaucgucgaccugaugugucacgccaccuucacaaugcgccuucugagccccgugcggguuccuaacuacaaucugauuaucauggaugaggcgcauuucacggaccccgccucuauugcugccagaggcuauaucuccacccgcguggaaaugggggaggcugccggcauuuuuaugacagccaccccgccuggaagccgggaucccuucccccaguccaacgcuccuaucaucgacgaggaaagagagauucccgaacggucuuggaauagcggccacgagugggucacagauuuuaaggggaagaccgugugguucguuccuuccaucaaagcgggaaacgacauugccgcuugccuccgcaagaauggcaaaaaggugauccaacugagcagaaaaacguuugauucugaauacgucaagacacggaccaacgacugggauuucguggugaccacagacauuuccgagaugggggccaauuuuaaagccgagcgcgucaucgauccgagacgguguaugaagcccguuauccuuaccgacggagaagagagagugauucuggcuggcccuaugcccgugacacauagcucugccgcgcagcgccgggggagaaucggccgcaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgggagaaagucgacgccauugauggggaauacagacuccgcggagaggcucggaagacguuuguggaccuuaugagacgcggcgaucugccuguuuggcuggccuauaaaguggcggccgaggggaucaacuacgcugacagacggugguguuucgauggaaucaagaacaaucagauucucgaagagaacgucgaaguggagaucuggacaaaggagggcgaacgcaaaaagcugaaacccagauggcuugacgcccggauuuauuccgauccucuggcucucaaggaguuuaaagaguucgccgcugggcgcaagucucugacccugaaucucaucacagagaugggcagacuucccaccuucaugacgcaaaagacccgggacgcccuggauaaccuggcgguucuccacacagccgaagcuggaggcagagccuacaaucaugcucugagcgagcuuccggagacccuggaaacacuccugcugcucacccuucuggccacagugaccgggggaauuuuucuguuccucauguccggccgcgggaucggaaaaaugacgcugggcaugugcugcaucauuacagccucuauccuucugugguaugcucagauucagccucacuggaucgcggccagcauuauccucgaguuuuuccugaucguccugcucauucccgaacccgagaagcagcggaccccucaagacaaccagcuuaccuacguggucaucgcuauucugacagugguugccgccaccauggcuaaugaaaugggcuuucuggagaaaacaaagaaagacuucgggcucggauccaucgccacgcagcagccggagagcaacauucuggauaucgaccuuagacccgcgucugccuggacccuguacgcuguggccacaaccuuugugacaccuaugcuccgccauuccauugaaaauagcuccgucaacguuucucugaccgcuaucgccaaucaagcgacggugcugaugggccucgggaagggauggccccuuagcaagauggauaucggcgugccucugcuggccauuggguguuauucccaggucaaccccaucacccucacagcugcccugcuucugcucguggcucacuacgccauuaucggaccuggccugcaggcuaaagccacccgggaggcgcagaagagagccgcugccggcauuaugaaaaauccgacaguugacgggaucaccgugaucgaucuggaccccauuccuuaugaucccaaguucgaaaaacaacucggacaggucaugcuucugauccugugcgugacgcagguccucaugaugcggacaaccugggcucugugugaggcccuuacacuggccaccggcccuauuucuacccucugggaagggaaccccggacgcuuuuggaauacaacgaucgcggugagcauggcuaacauuuucagaggcuccuaccuggccggggcuggacugcucuuuagcaucaugaagaauaccacaaacacccggcgcggcacaggcaacaucggggagacccuuggagagaaauggaagucuagacugaaugcccugggcaaguccgaguuccaaauuuauaaaaagagcgggauccaggagguugaccggacgcucgccaaagaaggaauuaagcgcggcgagacagaucaccaugcugugucuagaggguccgccaaacugcggugguuugucgagcgcaacauggugaccccggaaggaaagguuguggaccuuggcugcggcagagggggauggagcuacuauuguggcgggcugaagaauguccgggaggugaaaggacucaccaagggcgggccuggacacgaagaacccauccccaugucuacauacggcuggaaccuggugagacugcagagcggcguugaugucuucuucauuccucccgaaaaaugcgacacccuccuuugugauaucggggaguccucuccuaauccgacaguggaggcgggacgcacgcugcgggugcugaaccucgucgaaaauuggcugaacaauaacacccaguuuugcaucaagguucuuaaucccuacaugccuagcgugauugagaaaauggaagcccugcaaagaaaguauggcggggcucucgugcgcaacccccugucccggaauagcacacaugagauguacugggucuccaacgccucuggaaauaucgugagcuccguuaacaugauuucuagaaugcugaucaaccgcuucaccaugcggcacaagaaagcuacauaugaaccugacguggaccucggcagcgggaccagaaauauuggaaucgaguccgagauucccaaccuugauaucaucggcaagcgcauugagaagaucaagcaggagcaugaaacgucuuggcacuacgaccaggaucacccguauaaaaccugggccuaccauggcagcuaugagacaaagcagaccggguccgcgagcucuauggucaauggagugguucggcugcugacaaagccuugggacgugcuccccaccgucacacaaauggccaugaccgauacgacaccuuuuggccagcagagaguguucaaagaaaagguggacacccgcacccaggagcccaaagaggggacaaagaaacugaugaagauuacggcugaauggcuuuggaaagagcugggaaagaagaaaaccccucggauguguacaagagaagaguuuacccgcaaggucagauccaacgccgcucucggcgccaucuucacagaugagaauaaauggaaaagcgcucgggaagccguugaggacucucgcuuuugggaacugguggauaaagagagaaaccugcaccucgaagggaagugcgagaccuguguguacaauaugaugggaaagcgggagaaaaagcugggcgaguucggcaaagcgaagggguccagagccauuugguacauguggcuuggagcucgguuucuggaguucgaagcccucggcuuucugaacgaggaccauugguucagccgcgaaaauucucuuuccggggucgagggagagggccugcacaaacucggguauauccugagagaugugagcaagaaggaaggcggagcuauguacgccgacgacacagccggcugggauacccggaucacgcuggaggaccucaaaaacgaagagaugguuaccaaucacauggaaggggagcauaagaaacuggcggaggcuauuuuuaaacuuacauaucaaaacaaagugguccgcgugcagagacccaccccgcggggaacaguuauggauaucauuucccgcagagaccagcggggcagcgggcaagugggaaccuacggccugaauacguucacaaacauggaagcccagcucauccgccagauggagggggaaggcgucuucaagaauauucagcaccugaccgugacagaggagguugccgugcaaaacuggcuugcuagagucggacgggaacgccugucuagaauggccaucagcggcgaugacugcguggucaagccucucgaugaccgguuugcuaacgcccugaccgcgcugaaugauauggggaaaauccgcaaggacauucagcagugggagcccuccaaaggauggaacgauuggacgcagguccccuucugcucucaucacuuucaugaacucaucaugaaggacggcagaguucugguggucccuugucggaaucaagaugagcuuauugggagagcccgcaucagccagggagcuggcuggucccugcgggaaaccgccugccucgggaaaucuuaugcucagauguggagccugauguacuuccacagacgcgaccuucggcuggccgcgaacgccauuuguuccgcugugccgucucacugggugcccacaagcagaaccacaugguccauccaugccaagcacgaguggaugaccacagaggacaugcucaccguuuggaaucgcguguggauucgggaaaacccuuggauggaggauaagacgcccgucgaaagcugggaggaaaucccuuaucugggcaaaagagaggaccaguggugcggaucucugaucggccucacaucccgcgcuaccugggccaagaauauucaagcugccaucaaccaggugcggagccugauugggaaugaggaauacaccgauuacaugcccucuaugaaaagauuucgccgggaggaagaggaagcgggaguucuuugguga

SEQ ID NO: 20196 - RNA, 9876 nt, Artificial Sequence
  derived and/or modified CDS sequence (opt5) from DENV-2__FM210206__SS-prME
agcgccggaaugaucauuaugcugauccccaccgucauggcuuuccaccucaccacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucacccucauggccgcuauccuggccuacacaauuggaaccacccacuuucagcgcguucuuaucuucauucugcucacagcuguggccccuuccaugacgaugagaugcaucggcauuucuaaccgggauuuugucgaaggggugagcggaggcuccuggguugacaucgugcuggagcacgggagcugugucaccacaauggcgaagaauaagcccacccuugauuucgaacugaucaaaacagaggccaagcagccugcuacccuccgcaaauauugcauugaagccaagcugacgaacacaaccaccgagucuagauguccgacacaaggagagcccucccugaaagaagaacaagacaagcgguuugugugcaagcauagcaugguggaucgcggcuggggcaauggguguggacucuucggcaaagggggaaucgugaccugcgcuauguuuacaugcaagaaaaacauggaaggcaagauuguucagccugagaaucuggaauacacgaucguggugacaccccacucuggggaggagcaugccgucggaaacgacacaggcaaacacggcaaggaaauuaaagugaccccucaguccagcaucacagaggcggaacuuaccggguauggaacgguuaccauggaguguucucccagaacaggccuggauuucaaugaaauggugcuccugcaaauggagaacaaggccuggcuuguccaccggcagugguuucuggaccucccgcugccuuggcugcccggggcugauaagcaggaguccaauuggauccagaaagaaacccucgugacauucaagaacccucaugccaaaaagcaagacguugugguccugggaagccaggagggcgcuaugcacaccgcccuuacgggggccacagaaauucagauguccucuggcaaucugcucuuuaccggacaucugaaaugccgccuuagaauggacaagcugcaacucaagggcaugagcuacuccauguguacagggaaauucaagguggucaaagagaucgcugagacccagcacggaaccauugugauccggguucaguaugaaggcgaugggagccccugcaagauucccuucgagaucauggaccuggagaagcgguacgugcugggacgccucaucacagucaacccuauugugacggagaaggauucuccgguuaacaucgaagcggagcccccuuuuggcgacuccuacauuaucauugggguggagcccggccagcugaaacuuaauugguucaaaaagggaagcucuaucggccaaauguuugaaaccacaaugagaggggccaaaagaauggcuauucugggagauaccgccugggacuucggcagccucgggggagucuuuacauccaucggcaaggcccugcaucagguguucggggcuaucuauggcgccgcguuuucuggagugagcuggaccaugaaaauucugaucggcguuauuaucacguggauugggaugaacucccgcagcacaucucuuuccgucagccucgugcuggugggaaucgucacccuguaccucggcgugaugguucaggcugauucuggguguguggucuccuggaagaauaaggagcugaaaugcggaagcggcaucuucauuaccgacaacgugcacacauggaccgaacaguauaaguuucaaccugagucccccucuaaacuugccagcgccauccagaaggcucaggaagaggggauuuguggcauccgguccguuacaagacuggagaaucucauguggaaacagauuacgccggaacugaaccacauccuggccgagaaugaagugaaacuuaccaucaugacaggagauauuaaaggcaucaugcaagcugggaagcgcucucuccggccucagcccaccgagcugaaguacagcuggaaaacauggggaaaggccaaaaugcuguccauugaaagcuauaaccagaccuuccucaucgacggcccugagacggcggagugccccaauaccaacagagccuggaacucucuggaagucgaggauuacggguuuggaguguucacaaccaacauuuggcuuaagcugaaagaaaagcaggacgcuuuuugugacuccaagcucaugagcgccgcuaucaaagauaaucgcgccguucaugcggacaugggcuauuggaucgagucugcccugaacgauacauggaagauugagaaggcuagcuucaucgaagugaagaauugccacuggccuaaaagccauacccuguggucuaacggcguccuugagagcgaaaugauuauccccaagaaccucgccgggccggugucccaacacaauuaccggccuggauaccacacacagauugcuggccccuggcaucuggggaagcuggagauggacuucgauuuuugugacggaaccacggugaucgucacagaagauugcggcaacagagggcccagccuccgcaccaccacagccucuggaaaacugauuaccgaguggugcugucgguccugcacgcuuccuccgcugagauaucggggcgaggacggcuguugguacgggauggaaauccgcccccucaaggagaaagaagagaaucugguuaacagccuggugacagccggacacggccagguggauaauuucucccuugggguccucggaauggcucuguuucuggaagagaugcucagaacccgggugggcacaaagcaugcgauccugcuuguugccgugucuuucgucacccugauuacagggaacaugagcuuuaaagaccucggaagagugguugugauggucggcgcuaccauggccgaugacaucggcaugggggugacguaucuggcccugcuugcugccuucaagguucgcccuaccuuugcggcuggacugcuccugcggaagcucacauccaaagagcugaugaugaccacaauuggcaucgugcuucugucucaaagcaccauucccgaaacgguccucgagcugacagaugcccuggcccuugggaugauggugcugaagaucgugagaaauauggaaaaauaccagcucgcugucaccaucauggccauucugugcguuccuaacgcggugauccuccagaaugcuuggaagguguccuguacaauucuggccgucgugucuguuagcccccuucugcucaccuccagccagcagaaaaccgacuggaucccucuggcccugacaauuaagggacuuaaccccacggcuaucuuccugaccacacucucucgcaccaauaaaaagagauccuggccgcugaacgaggccaucauggcugugggcauggucagcauucucgccucuucccugcuuaagaaugacaucccuaugacagggccccugguggcgggaggccugcucaccguuugcuaugugcugacgggccggagcgccgaucuugaacuggagcgcgcuacagacgucaaaugggaggaucaggccgaaauuucuggguccagcccuauccucuccauuaccaucagcgaggacggaucuaugagcauuaagaacgaagaggaggaacagacccugacaauccucaucagaaccggccugcuugugauuuccgggcuguuucccaucucuauuccgaucacagcugccgccugguaccugugggaggucaaaaagcagcgggcuggagugcucugggauguuccuucucccccucccaugggcaaagcggaacuggaggacggggccuaucgcauuaagcaaaagggaauccuuggcuacucccagaucggcgcugggguguacaaagaaggaacguuccacaccauguggcaugucacaagaggcgccgugcugaugcacaaggggaaacggauugagcccuccugggccgauguuaagaaagaccucaucagcuauggaggcggguggaagcuggagggagaauggaaggagggcgaagaggugcagguccucgcucuggaaccuggcaaaaauccgcgcgccgugcagaccaagcccgggcuuuuuaaaacaaacaccggaacgauuggcgcggugucccuggauuucucuccugggaccagcggaucccccaucauugacaagaaaggcaagguugucgggcuguacggaaacggcguggugacaagaagcggcgcuuaugucucugccaucgcccaaaccgagaaguccaucgaggauaauccugaaauugaggacgauaucuuucggaaacgcagacucacaauuauggaccugcaccccggggcuggaaagaccaaacgguaccuuccugccaucgugagagaagcgauuaagcgcggccugcggacacucauccuggcuccgacgagaguuguggccgccgagauggaagaggcucuccgcgggcugcccauucgguaucagaccccugccaucagagcugagcauacaggacgcgaaaucgucgaccuuaugugucacgccaccuucaccaugcggcugcugagccccgugagaguuccuaacuacaaucucauuaucauggaugaggcgcauuucacagaccccgccucuauugcugcccgcggcuauaucuccacgcggguggaaaugggggaggcugccggcauuuuuaugaccgccacaccgccuggaagcagagaucccuucccccaguccaacgcuccuaucaucgacgaggaacgggagauucccgaacgcucuuggaauagcggccacgagugggucaccgauuuuaaagggaagacagugugguucguuccuuccaucaaggcgggaaacgacauugccgcuugccugcgcaaaaauggcaagaaagugauccaacuuagccggaagaccuuugauucugaauacgucaaaacgcgcacaaacgacugggauuucguggugaccaccgacauuuccgagaugggggccaauuuuaaggccgagagagucaucgauccgcggagauguaugaaacccguuauccugacagacggagaagaaagagugauucucgcuggcccuaugcccgugacccauagcucugccgcgcagcggagagggcgcaucggccggaacccuaagaaugaaaacgaccaguacauuuauaugggagagccccuggaaaaugaugaggacugcgcucacuggaaggaggccaaaaugcugcucgauaacaucaauacaccggaaggcauuaucccuagcauguucgagcccgaaagagagaaggucgacgccauugauggggaauaccgccuucggggagaggcuagaaaaaccuuuguggaccugaugcgcagaggcgaucugccuguuuggcucgccuauaagguggcggccgaggggaucaacuacgcugaccggcgcugguguuucgauggaaucaaaaacaaucagauucuggaagagaacgucgaaguggagaucuggacgaaggagggcgaaagaaagaaacuuaagccccgguggcuggacgcccgcauuuauuccgauccucucgcucugaaagaguuuaaggaguucgccgcugggagaaaaucucugacacucaaucuuaucaccgagaugggccggcugcccacauucaugacccaaaagacgagagacgcccuggauaaccucgcgguucugcacaccgccgaagcuggaggccgcgccuacaaucaugcucuuagcgagcugccggagacacucgaaacccugcugcuccuuacacugcuggccaccgugacagggggaauuuuucucuuccugauguccggccgggggaucggaaagaugacccuuggcaugugcugcaucauuacggccucuauccugcucugguaugcucagauucagccucacuggaucgcggccagcauuauccuggaguuuuuccugaucguccuccuuauucccgaacccgagaaacagagaacaccucaagacaaccagcugaccuacguggucaucgcuauucugaccgugguugccgccacaauggcuaaugaaaugggcuuucucgagaagaccaaaaaggaccuggggcuuggauccaucgccacacagcagccggagagcaacauucuggauaucgaccuccgccccgcgucugccuggacgcuguacgcuguggccaccacauucgugaccccuaugcugcggcauuccauugaaaauagcuccgucaacguuucucucacagcuaucgccaaucaagcgaccgugcuuaugggccuggggaaaggauggccccugagcaagauggauaucggcgugccucuccuggccauuggguguuauucccaggucaaccccaucacgcuuaccgcugcccugcuccugcugguggcucacuacgccauuaucggaccuggccuccaggcuaaggccacaagagaggcgcagaaacgggccgcugccggcauuaugaagaauccgaccguugacgggaucacagugaucgaucuugaccccauuccuuaugaucccaaauuugaaaagcaacugggacaggucaugcugcucauccugugcgugacccagguccuuaugaugcgcacgacaugggcucugugugaggcccucacccuggccacaggcccuauuucuacccugugggaagggaaccccggaagauucuggaauaccacaaucgcggugagcauggcuaacauuuuucggggcuccuaccucgccggggcuggacuucuguucagcaucaugaaaaauacgaccaacacacgcagaggcaccggcaacaugggggagacacugggagagaaguggaaaucucggcucaaugcccugggcaaguccgaauuucaaaucuauaagaaaagcgggauucaggagguugaccgcacccuugccaaggaaggaaucaaaagaggcgagacggaucaccaugcugugucucggggguccgccaagcugcgcugguucgucgagagaaacauggugacaccggaaggaaaaguuguggaccucggcugcggcagagggggauggagcuacuauuguggcgggcugaagaauguccgggaggugaagggacugaccaaaggcgggccuggacacgaggaacccauucccaugucuaccuacggcuggaaccucgugcgccuucagagcggcguugaugucuuuuucaucccucccgaaaagugcgacacacugcugugugauauuggggaguccucuccuaauccgaccguggaggcgggacggacacucagagugcugaaccuugucgaaaauuggcugaacaauaacacgcaguucugcaucaaaguucucaaucccuacaugccuagcgugaucgagaagauggaagcccugcaacgcaaauauggcggggcucuggugcggaacccccucuccagaaauagcacccaugagauguacugggucuccaacgccucuggaaauauugugagcuccguuaacaugaucucucgcaugcuuauuaaccgguuuacaaugagacacaagaaggcuaccuaugaaccugacguggaccugggcagcgggacacgcaauaucggaauugaguccgagauccccaaccuggauauuaucggcaaacggaucgaaaagauuaaacaggagcaugaaaccucuuggcacuacgaccaggaucacccguauaagacgugggccuaccauggcagcuaugagaccaaacagacaggguccgcgagcucuauggucaauggagugguuagacuccugaccaagccuugggacgugcuucccacagucacccaaauggccaugacagauaccacgccuuucggccagcagcgcguguuuaaggaaaaaguggacacacggacccaggagcccaaggaggggaccaaaaagcugaugaaaaucacagcugaauggcucuggaaggagcugggcaaaaagaagacgccuagaauguguacccgcgaagaguucacaagaaaaguccgguccaacgccgcucugggcgccauuuuuaccgaugagaauaaguggaaaagcgcucgcgaagccguugaggacucuagauucugggaacucguggauaaggagcggaaccugcaccuugaagggaaaugcgagacauguguguacaauaugaugggaaagagagagaagaaacugggcgaauuuggcaaggcgaaagggucccgggccaucugguacauguggcucggagcucgcuuccuggaguuugaagcccuuggcuuccugaacgaggaccauugguuuagcagagaaaauucucucuccggggucgagggagagggccugcacaagcugggguauauucuccgggaugugagcaaaaaggaaggcggagcuauguacgccgacgacaccgccggcugggauacacgcaucacccuggaggaccuuaagaacgaagagaugguuacgaaucacauggaaggggagcauaaaaagcuggcggaggcuaucuucaaacucaccuaucaaaacaagguggucagagugcagcggcccacaccgcgcggaaccguuauggauauuaucuccagacgggaccagcgcggcagcgggcaagugggaacauacggccugaauaccuuuacgaacauggaagcccagcuuauuagacagauggagggggaaggcgucuucaaaaauauccagcaccugacagugaccgaggagguugccgugcaaaacuggcucgcucgggucggacgcgaaagacugucucggauggccauuagcggcgaugacugcguggucaagccucuggaugaccgcuucgcuaacgcccucacagcgcugaaugauauggggaagaucagaaaagacauccagcagugggagcccuccaagggauggaacgauuggacccaggugcccuuuugcucucaucacuuccaugaacuuauuaugaaagacggccggguucugguggucccuuguagaaaucaagaugagcucaucgggcgcgcccggauuagccagggagcuggcuggucccugagagaaacggccugccuugggaagucuuaugcucagauguggagccugauguacuuucaccgccgggaccucagacuggccgcgaacgccaucuguuccgcugugccgucucacugggugcccaccagccgcacaaccugguccauucaugccaaacacgaguggaugacaaccgaggacaugcugacaguuuggaaucggguguggaucagagaaaacccuuggauggaggauaagacccccgucgaaagcugggaggaaauuccuuaucucggcaagcgcgaggaccaguggugcggaucucugaucggccuuacgucccgggcuacaugggccaaaaauauccaagcugccauuaaccaggugagaagccugaucgggaaugaggaauacaccgauuacaugcccucuaugaagcgcuuccggagagaggaagaggaagcgggaguucucugguga

SEQ ID NO: 20197 - RNA, 9876 nt, Artificial Sequence
  derived and/or modified CDS sequence (opt5) from DENV-2__FM210246__SS-prME
agcgccggaaugaucauuaugcugauccccacagugauggcuuuccaccugacaacgagaaauggggaaccucauaugauugucggaauccaggaaaagggcaaaucccugcuuuuuaagaccgaagacgggguuaauaugugcacacugauggccauggaucucggagaacugugugaagacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgagagcuucaaccagacguuucugaucgacggcccugagaccgcggagugccccaauacaaacagagccuggaacucucucgaagucgaggauuauggguucggaguguuuaccacaaacauuuggcugaaacuuaaagaaaagcaggacgcuuucugugacuccaagcugaugagcgccgcuaucaaagauaaucgcgccguucaugcggacaugggcuacuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaucggccuggauaccacacccagauugcuggccccuggcaucucgggaagcuggagauggacuuugauuucugugacggaacgacagugaucgucaccgaagauugcggcaacagagggcccagccugcgcaccacaaccgccucuggaaaacucauuacggaguggugcugucgguccugcacacugccuccgcuuagauaccggggcgaggacggcuguugguaugggauggaaauccgcccccugaaggagaaagaagagaaucucguuaacagccuggugaccgccggacacggccagguggauaauuuuucccuggggguccuuggaauggcucucuuccuggaagagaugcugagaacacgggugggcaccaagcaugcgauccuccugguugccgugucuuuugucacacuuauuaccgggaacaugagcuucaaagaccugggaagagugguugugauggucggcgcuacgauggccgaugacaucggcaugggggugaccuaccucgcccugcuggcugccuuuaagguucgcccuacauucgcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaucagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuucuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuacgugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuccccaucucuauuccgaucacggcugccgccugguaucugugggaggucaaaaagcagcgggcuggagugcugugggauguuccuucucccccucccaugggcaaagcggaacucgaggacggggccuaccgcauuaagcaaaagggaauccugggcuauucccagaucggcgcugggguguacaaagaaggaaccuuucacacaauguggcaugucaccagaggcgccgugcuuaugcacaaggggaaacggauugagcccuccugggccgauguuaagaaagaccugaucagcuacggaggcggguggaagcucgagggagaauggaaggagggcgaagaggugcagguccuggcucucgaaccuggcaaaaauccgcgcgccgugcagacaaagcccgggcuguucaaaaccaacacgggaaccauuggcgcggugucccuugauuuuucuccugggacaagcggaucccccaucauugacaagaaaggcaagguugucgggcuguauggaaacggcguggugaccagaagcggcgcuuacgucucugccaucgcccaaacagagaaguccaucgaggauaauccugaaauugaggacgauaucuuccggaaacgcagacugaccauuauggaccuccaccccggggcuggaaagacaaaacgguaucugccugccaucgugagagaagcgauuaagcgcggccuucggacgcugauccucgcuccgaccagaguuguggccgccgagauggaagaggcucugcgcgggcuccccauucgguaccagaccccugccaucagagcugagcauaccggacgcgaaaucgucgaccugaugugucacgccaccuucacaaugcggcuucugagccccgugagaguuccuaacuauaaucugauuaucauggaugaggcgcauuuuacggaccccgccucuauugcugcccgcggcuacaucuccacccggguggaaaugggggaggcugccggcauuuucaugacagccaccccgccuggaagcagagaucccuuuccccaguccaacgcuccuaucaucgacgaggaacgggagauucccgaacgcucuuggaauagcggccacgagugggucacagauuucaaagggaagaccgugugguuuguuccuuccaucaaggcgggaaacgacauugccgcuugccuccgcaaaaauggcaagaaagugauccaacugagccggaagacguucgauucugaauaugucaaaacacgcaccaacgacugggauuuuguggugaccacagacauuuccgagaugggggccaauuucaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuacaugggagagccccucgaaaaugaugaggacugcgcucacuggaaggaggccaaaaugcugcuggauaacaucaauaccccggaaggcauuaucccuagcauguuugagcccgaaagagagaaggucgacgccauugauggggaauaucgccuccggggagaggcuagaaaaacguucguggaccuuaugcgcagaggcgaucugccuguuuggcuggccuacaagguggcggccgaggggaucaacuaugcugaccggcgcugguguuuugauggaaucaaaaacaaucagauucucgaagagaacgucgaaguggagaucuggacaaaggagggcgaaagaaagaaacugaagccccgguggcuugacgcccgcauuuacuccgauccucuggcucucaaagaguucaaggaguucgccgcugggagaaaaucucugacccugaaucucaucacagagaugggccggcuucccaccuuuaugacgcaaaagaccagagacgcccuggauaaccuggcgguucuccacacagccgaagcuggaggccgcgccuauaaucaugcucugagcgagcuuccggagacccuggaaacacuccugcugcucacccuucuggccacagugaccgggggaauuuuccuguuucucauguccggccgggggaucggaaagaugacgcugggcaugugcugcaucauuacagccucuauccuucugugguacgcucagauucagccucacuggaucgcggccagcauuauccucgaguucuuucugaucguccugcucauucccgaacccgagaaacagagaaccccucaagacaaccagcuuaccuauguggucaucgcuauucugacagugguugccgccaccauggcuaaugaaaugggcuuccuggagaagaccaagaaggaccucgggcugggauccaucgccacgcagcagccggagagcaacauucuugauaucgaccugcgccccgcgucugccuggacccucuacgcuguggccacaaccuuugugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuacucccaggucaaccccaucacccugacagcugcccuucugcuccugguggcucacuaugccauuaucggaccuggccugcaggcuaaggccaccagagaggcgcagaaacgggccgcugccggcauuaugaagaauccgacaguugacgggaucaccgugaucgaucucgaccccauuccuuacgaucccaaauucgaaaagcaacuuggacaggucaugcugcugauccucugcgugacgcagguccugaugaugcgcacaaccugggcucuuugugaggcccugacacucgccaccggcccuauuucuacccugugggaagggaaccccggaagauuuuggaauacaacgaucgcggugagcauggcuaacauuuuccggggcuccuaucuggccggggcuggacuccuuuuuagcaucaugaaaaauaccacaaacacccgcagaggcacaggcaacaugggggagacccugggagagaaguggaaaucucggcugaaugcccucggcaaguccgaguuccaaaucuacaagaaaagcgggauucaggagguugaccgcacgcuggccaaggaaggaaucaaaagaggcgagacagaucaccaugcugugucucggggguccgccaaacuucgcugguuugucgagagaaacauggugaccccggaaggaaaaguuguggaccugggcugcggcagagggggauggagcuauuacuguggcgggcucaagaauguccgggaggugaagggacugaccaaaggcgggccuggacacgaagaacccauucccaugucuacauauggcuggaaccuggugcgccuccagagcggcguugaugucuucuucaucccucccgaaaagugcgacacccuucugugugauauuggggaguccucuccuaauccgacaguggaggcgggacggacgcugagagugcucaaccuggucgaaaauuggcuuaacaauaacacccaguuuugcaucaaaguucugaaucccuacaugccuagcgugaucgagaagauggaagcccuccaacgcaaauacggcggggcucuggugcggaacccccuguccagaaauagcacacaugagauguauugggucuccaacgccucuggaaauauugugagcuccguuaacaugaucucucgcaugcucauuaaccgguucaccaugagacacaagaaggcuacauacgaaccugacguggaccuuggcagcgggacccgcaauaucggaauugaguccgagauccccaaccuggauauuaucggcaaacggaucgaaaagauuaaacaggagcaugaaacgucuuggcacuaugaccaggaucacccguacaagaccugggccuaucauggcagcuacgagacaaaacagaccggguccgcgagcucuauggucaauggagugguuagacugcucacaaagccuugggacgugcugcccaccgucacacaaauggccaugaccgauacgacaccuuuuggccagcagcgcguguucaaggaaaaaguggacacccggacccaggagcccaaggaggggaccaagaaacuuaugaaaaucacggcugaauggcuguggaaggagcucggcaaaaagaagaccccuagaauguguacacgcgaagaguuuaccagaaaaguccgguccaacgccgcucugggcgccauuuucacagaugagaauaaguggaaaagcgcucgcgaagccguugaggacucuagauuuugggaacugguggauaaggagcggaaccuccaccuggaagggaaaugcgagaccuguguguauaauaugaugggaaagagagagaagaaacuuggcgaguucggcaaggcgaaagggucccgggccaucugguacauguggcugggagcucgcuuucucgaguucgaagcccugggcuuucuuaacgaggaccauugguucagcagagaaaauucucuguccggggucgagggagagggccuccacaagcugggguacauucugcgggaugugagcaaaaaggaaggcggagcuauguaugccgacgacacagccggcugggauacccgcaucacgcucgaggaccugaagaacgaagagaugguuaccaaucacauggaaggggagcauaagaaacuugcggaggcuaucuuuaaacugacauaccaaaacaaaguggucagagugcagcggcccaccccgcgcggaacaguuauggauauuaucuccagacgggaccagcgcggcagcgggcaagugggaaccuauggccucaauacguucacaaacauggaagcccagcugauuagacagauggagggggaaggcgucuucaaaaauauccagcaccuuaccgugacagaggagguugccgugaagaacuggcuggcucgggucggacgcgaaagacucucucggauggccauuagcggcgaugacugcguggucaagccucuggaugaccgcuuugcuaacgcccugaccgcgcucaaugauauggggaaaaucagaaaggacauccaacagugggagcccuccaaaggauggaacgauuggacacaggugcccuucugcucucaucacuuucaugaacugauuaugaaggacggccggguucuuguggucccuuguagaaaucaggaugagcugaucgggcgcgcccggauuagccaaggagcuggcuggucccucagagaaaccgccugccuggggaaaucuuacgcucagauguggagccuuauguauuuccaccgccgggaccugagacucgccgcgaacgccaucuguuccgcugugccgucucacugggugcccacaagccgcaccacaugguccauucaugccaagcacgaguggaugaccacagaggacaugcugaccguuuggaaucggguguggaucagagaaaacccuuggauggaggauaagacgcccgucgaaagcugggaggaaauuccuuaccugggcaaacgcgaggaccaguggugcggaucucucaucggccugacaucccgggcuaccugggccaagaauauccaggcugccauuaaccaagugagaagccuuaucgggaaugaggaauauaccgauuacaugcccucuaugaaacgcuuucggagagaggaagaggaagcgggaguucugugguga

SEQ ID NO: 20198 - RNA, 9876 nt, Artificial Sequence
  derived and/or modified CDS sequence (opt5) from DENV-2__FM210207__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaaacgggccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaaaaauaccacaaacacccgcagaggcacaggcaacaugggggagacccugggagagaaguggaaaucucggcugaaugcccucggcaagaacgaauuucaaaucuauaagaaauccgggauucaggagguugaccgcacgcuggccaaggaaggaaucaaaagaggcgagacagaucaccaugcugugagccgggggucugccaaacuucgcugguucgucgagagaaauauggugaccccggaaggaaaaguuguggaccugggcugcggcagagggggaugguccuacuauuguggcgggcucaagaacguccgggaggugaagggacugaccaaaggcgggccuggacacgaagaacccauucccaugagcacauacggcuggaaucuggugcgccuccagucuggcguugaugucuuuuucaucccucccgaaaagugcgacacccuucugugugauauuggggagagcuccccuaacccgacaguggaggcgggacggacgcugagagugcucaaucuggucgaaaacuggcuuaauaacaauacccaguucugcaucaaaguucugaaccccuacaugccuucugugaucgagaagauggaagcccuccaacgcaaauauggcggggcucuggugcggaauccccugagcagaaacuccacacaugagauguacugggucagcaaugccuccggaaacauugugucuagcguuaacaugaucucccgcaugcucauuaaucgguuuaccaugagacacaagaaggcuacauaugaaccugacguggaccuuggcucugggacccgcaacaucggaauugagagcgagauccccaaucuggauauuaucggcaaacggaucgaaaagauuaaacaggagcaugaaacguccuggcacuacgaccaggaucacccguauaagaccugggccuaccauggcucuuaugagacaaaacagaccgggagcgcguccagcauggucaacggagugguuagacugcucacaaagccuugggacgugcugcccaccgucacacaaauggccaugaccgauacgacaccuuucggccagcagcgcguguuuaaggaaaaaguggacacccggacccaggagcccaaggaggggaccaagaaacuuaugaaaaucacggcugaauggcuguggaaggagcucggcaaaaagaagaccccuagaauguguacacgcgaagaguucaccagaaaaguccggucuaaugccgcucugggcgccauuuuuacagaugagaacaaguggaaauccgcucgcgaagccguugaggacagcagauucugggaacugguggauaaggagcggaaucuccaccuggaagggaaaugcgagaccuguguguacaacaugaugggaaagagagagaagaaacuuggcgaauuuggcaaggcgaaagggucucgggccaucugguacauguggcugggagcucgcuuccucgaguuugaagcccugggcuuccuuaaugaggaccauugguuuuccagagaaaacagccugucuggggucgagggagagggccuccacaagcugggguauauucugcgggauguguccaaaaaggaaggcggagcuauguacgccgacgacacagccggcugggauacccgcaucacgcucgaggaccugaagaaugaagagaugguuaccaaccacauggaaggggagcauaagaaacuugcggaggcuaucuucaaacugacauaucaaaauaaaguggucagagugcagcggcccaccccgcgcggaacaguuauggauauuaucagcagacgggaccagcgcggcuccgggcaagugggaaccuacggccucaacacguuuacaaauauggaagcccagcugauuagacagauggagggggaaggcgucuucaaaaacauccagcaccuuaccgugacagaggagguugccgugcaaaacuggcuggcucgggucggacgcgaaagacucagccggauggccauuucuggcgaugacugcguggucaagccucuggaugaccgcuucgcuaaugcccugaccgcgcucaacgauauggggaagaucagaaaagacauccagcagugggagcccagcaagggauggaaugauuggacacaggugcccuuuugcucccaucacuuccaugaacugauuaugaaagacggccggguucuuguggucccuuguagaaaccaagaugagcugaucgggcgcgcccggauuucucagggagcuggcuggagccucagagaaaccgccugccuggggaaguccuaugcucagauguggucucuuauguacuuucaccgccgggaccugagacucgccgcgaaugccaucuguagcgcugugccgucccacugggugcccacaucucgcaccacauggagcaugcaugccaaacacgaguggaugaccacagaggacaugcugaccguuuggaaccggguguggauuagagaaaauccuuggauggaggauaagacgcccgucgaauccugggaggaaaucccuuaucugggcaagcgcgaggaccaguggugcggaagccucauuggccugacaucucgggcuaccugggccaaaaacauccaagcugccaucaaucaggugagaucccuuauugggaacgaggaauacaccgauuacaugcccagcaugaagcgcuuccggagagaggaagaggaagcgggaguucugugguga

SEQ ID NO: 20199 - RNA, 9876 nt, Artificial Sequence
  derived and/or modified CDS sequence (opt5) from DENV-2__FM210238__SS-prME
accgccggcaugaucauuaugcugauccccaccgcuauggccuuccaccucacgacccggaacggggagccucauaugauugugggacggcaggaaaagggcaagagccugcuuuuuaagacagaggacggggucaauaugugcacccugauggcgaucgaucucggagaacugugugaggacacaauuaccuacaaaugcccccuucugagacaaaacgaacccgaggauaucgacuguuggugcaauuccacaucuaccuggguuacguauggcaccuguacaaccacaggggagcacagacgggaaaagcgcagcguggcucucgugccucaugucggaaugggccuggagaccagaacggaaacauggauguccucugagggcgccuggaaacacgcccagcggaucgagaccuggauucugcgccaucccggguucacaaucauggcugccauucucgcuuacaccgugggaaccacacacuuucagagagcccugaucuucauucuucuggcggccguugcuccuagcaugacgaugcggugcaucggcauuuccaaccgcgauuuuguggaaggggucucuggaggcagcuggguggacaucguucucgagcacggguccugugugaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaggaacaggacaaacgcuuugucugcaagcauuccaugguggauagaggcuggggcaacggguguggacuguucggcaaagggggaaucgugaccugcgccauguuuacaugcaaaaagaauauggaaggcaaaauuguccagccugagaaccucgaauacacgaucguuauuacaccccacagcggggaggagcaugcugugggaaaugacacaggcaagcacggcaaagaaaucaagaucaccccucagucucccauuacagaggccgaacugaccggguauggaacggugaccauggaguguuccccgcggacaggccuugauuucaacgaaaugguccugcuccaaauggaggacaaggcuuggcuggugcaccgccagugguuucuugaucugccucuccccuggcugccuggggccgacacccagggaagcaauuggauccagaaggagacacugguuaccuucaagaacccccaugccaaaaagcaagacguggucgugcucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucguuaaagaaauugcugagacccagcacggcacaaucgugaucagaguccaguaugagggggacggaagccccugcaagauuccuuucgaaaucauggaucucgagaaacgccaugugcugggccggcugauuacggucaacccgaucgugaccgaaaaggacucccccguuaacauugaggccgaaccucccuuuggggauagcuacaucauuaucggcguggagccuggacagcucaaacugaauugguucaagaagggaucuuccaucgggcaaauguuugagacaaccaugagaggagccaaacgcauggcuauucuuggcgacacagccugggauuucgggagccugggaggcgucuuuaccucuaucgggaaggcgcuccaccagguguucggcgcuauuuacggagccgccuuuagcggcguuuccuggacgaugaaaauccugauuggggugaucaucacauggauuggaaugaacucucggagcaccucccugagcgucucucuugugcucgugggcguuaucacccuguaucugggggcuaugguccaggccgacuccggauguguggugagcuggaagaauaaagaacucaagugcggcucugggauuuucaucacagauaacguccacaccuggacagagcaguacaaguuucaacccgaauccccgagcaaacuggcuuccgccauucagaaggcgcaugaggaaggcaucuguggaaucagaucugugacgcgccuugagaaucugauguggaaacagauuaccccugagcucaaccacauccugagcgaaaaugagguuaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgagguggaagacuacggauuuggcgucuucacaaccaacaucuggcugaaacuucgggagaaacaggacguguuuugugauucuaagcugauguccgccgcgauuaaagacaauagagccguucacgcugauaugggcuauuggaucgaaagcgcccucaacgacacauggaagauggagaaggcuucuuucauugaggugaaauccugccacuggcccaagagccauacccuguggucuaaugggguccuggaaagcgagaugaucauuccgaaauccuucgccggaccugugagccagcacaacuaccgccccggcuauuacacgcaaacagccgggcccuggcaucuuggaaagcucgaaauggauuuugacuucugugagggcaccaccguuguggucacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgugaccgcgggccacgggcagaucgauaauuuuucucugggaguccugggcauggcccuuuuccucgaagagaugcugagaacacgcguugggaccaaacaugcuauccugcucgugacggugagcuuugucacccugauuacaggaaacauguccuuccgggaccuuggcagagugaugguuauggugggcgccgccaugaccgaugacaucgggaugggagucacauaccuggcucuccuggccgcguuuaaggugcgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugaugguucugaaaaucgugcggaauauggaaaaguaucaacuugcugucaccauuauggccaucucuugcgugcccaacgccguuauucugcagaaugcuuggaaggugagcuguacaauccucgccgcugucuccgugagcccucugcuccugacgucuucccagcagaaagccgacuggauuccccuugcgcugaccaucaagggccucaacccgacagccaucuuucugaccacacugagccgcaccucuaaaaagagauccuggccucuuaaugaggcuauuauggccguggggauggucagcauccuggcuucuucccuccugaaaaacgacauucccaugacgggaccucucguugccggcggccugcuuacagugugcuacgugcugaccgggcggagcgccgaucuggaacucgagcgcgcuaccgacgucaagugggaggaucaagcggaaaucuccggaagcucucccauucugagcaucacaauugccgaggacggcuccaugucuaucaaaaaugaagaggaggaacagacccuuacaauccugauuagaacggggcuccuggugaucagcggacucuucccgguuuccauuccuaucaccgcugccgccugguaucugugggaggugaagaagcagcgggcuggcguccuuugggaugugcccucuccuccgcccguugggaaagccgaacuggaggacggagcguaccgcauuaagcagaaaggcauccugggcuauagccaaaucggggcuggaguguacaaggaaggcacauuucacaccauguggcacgucacaagaggggccgugcucaugcaucggggaaaacgcauugagccuuccugggccgaugucaagaaggaccugaucucuuacggcgggggauggaaacuugagggcgaauggaaggagggcgaagaggugcagguucuggcucucgaaccggggaaaaaccccagagccgugcagaccaagccuggacuguucaaaacgaauaccggcacaauuggggcggucagccucgauuuuucccccggaaccagcggcucuccuaucguggaccggaaggggaagguugugggacuguauggcaacggcgucgugacaagauccggggcuuacgugagcgccauugcccagaccgagaaaucuaucgaggauaaucccgaaaucgaggacgauauuuuccgcaagaaacggcuuacaaucauggaccugcacccuggagcuggcaagacgaaaagauaucugccggccauuguucgcgaagcuaucaagcgggggcucagaacccugauucuugcccccacacgcgucguggcggccgagauggaagaggcucugcggggacucccuaucagauaccaaacccccgccauucgcgcugagcauaccggccgggaaaucguggaccugaugugucacgccacauucacgaugagacuccuguccccuguccgggugcccaacuauaaccuuaucauuauggaugaggcccauuuuaccgacccggcuagcaucgcggcccgcggguacauuuccacaagaguugaaaugggcgaggcugccggaaucuucaugaccgccacaccucccggcucucgggaucccuuuccucagagcaaugcucccauuauggacgaggaacgcgagaucccugaaagauccuggaacagcgggcacgagugggugaccgauuucaagggaaaaacggucugguuugugccgucuaucaaggccggcaaugacauugcggcuugccugcggaaaaacgggaagaaaguuauccagcuguccagaaagacauucgauagcgaauaugugaagacccgcaccaaugacugggauuuugucgugacaaccgacauuucugagaugggagccaacuucaaagccgagcggguuaucgaucccagacgcuguaugaagccugugauucucacagacggcgaagaacgggucauccuggcugggcccaugccugugacccacagcuccgccgcgcaaagacgcggccggaucggaagaaaucccaaaaacgaaaaugaccaguacauuuacaugggcgagccgcuugaaaacgaugaggacugcgcccauuggaaggaggcuaaaaugcugcucgauaauaucaacacgccugaagggauuauccccucuauguuugagccugaacgcgagaagguggacgccauugauggagaauauagacugcggggcgaggcucgcaaaacauucgucgaccugaugagaagaggggaucuccccguuuggcuugccuaccgcguggcugccgagggaaucaauuaugcggacagacggugguguuuugauggcgugaagaacgaccagauucuggaagagaaugucgaaguggagaucuggaccaaggagggggaacgcaagaagcugaaaccucgcuggcucgaugcccggaucuacagcgacccccuggcucuuaaggaguucaaagaguucgccgcuggcagaaagucccugacacucaaccugauuaccgagaugggacgccugccgacguuuaugacccagaaggcccgggaugcccucgacaaccuugcuguucugcacacagcggaagccggcgggagagcuuauaaucaugcccugucugagcucccugagacccuggaaacacuucugcuccugacccugcucgccacagugaccggaggcaucuuccuuuuucugaugagcgggaaaggagucggcaagaugacgcugggcaugugcugcauuaucacagcuuccauucuccugugguacgcccaaauccagccccacuggaucgcggccagcauuauccuugaguucuuucugauugugcuccugauccccgaaccugagaaacagcggaccccgcaggacaaccaacugaccuauguugugauugcuauccucacagucguggccgcuaccauggccaaugaaaugggguuccuugagaagaccaagaaggaucugggacugggcucuaucgcgacgcaggagcccgaauccaacauucucgacaucgaucugcgcccugccagcgcuuggacccuuuacgccgucgcuacaaccuuugugacacccaugcugagacacuccauugaaaauucuagcguuaacgugucccucaccgccaucgcuaaucaggccacggugcugauggggcugggaaagggcuggccucucucuaaaauggacauuggggucccccuucuggcgaucggauguuacagccagguuaacccuauuacccugacagccgcucuccugcuucugguggcccauuaugcuaucaucggcccgggccuccaagccaaggccacccgggaagcgcagaaacgcgcugccgcugggauuaugaagaaucccacaguggauggaaucaccgucauugaccuggauccuauccccuacgacccuaaauucgagaagcagcugggccaggugaugcuccuuauucugugcguuacgcaagugcugaugaugagaacaaccugggcccucugugaagcccugacacuugcuaccgggcccaucuccacccugugggagggaaacccgggccgguuuuggaauacaacgaucgccgucagcauggcgaacauuuuccgcgggucuuaucucgccggagcuggccugcuguuuuccaucaugaagaauaccacaaacaccagacggggcacagggaauauuggagagacccucggcgaaaaauggaaaagccgccuuaacgcccuggggaaaucugaguuccagaucuacaagaaauccggcauucaggaaguggauagaacgcuggcuaaggagggcaucaaaagaggggaaacagaccaccaugccgucagcagaggaucugcgaagcuccgcugguuuguggaacggaauaugguuaccccugagggcaagguggucgaucugggcugcgggagaggaggcuggagcuauuacugugggggacuuaaaaacgugcgcgaaguuaagggccugaccaaagggggacccggccacgaggaacccaucccuauguccacauauggcuggaaccucgugcggcugcaaucuggggucgacguguucuucacacccccugagaagugcgauacccugcucugugacauuggagagagcuccccgaaucccacgaucgaagccggcagaacccuucgcgugcugagccugguugagaacuggcucaauaacgacacacaguuuugcauuaaaguccugaauccuuacaugcccuccgugaucgaaaagauggagacccuucagcggaaguacgggggagcucuggugagaaacccucucucucgcaauagcacacaugaaauguauugggucuccaacgccaccggcaauauuguuucuagcgugaacaugaucucccggaugcugaucaauagauucacgaugaaacacaagaaagcuaccuacgagcccgauguggaccuggggucuggaacacgcaacauuggcaucgagagcgaaauuccgaaucucgauaucauuggcaagcggaucgagaaaauuaagcaggaacacgagaccuccuggcauuaugaccaagaucacccuuacaagacaugggccuaucaugggagcuacgaaaccaaacagacaggaucugcuuccagcauggucaacggcgugguuagacuucugaccaagcccugggacguggucccuauggugacgcagauggccaugacagauaccacccccuuugggcagcaacgcguuuucaaagagaagguggacacaagaacgcaggagccuaaagaaggaaccaagaagcugaugaaaaucacagcggaguggcucuggaaggaacugggcaaaaagaaaacaccccggauguguacacgcgaggaguuuaccagaaagguccggucuaaugccgcucuuggggccaucuucacagaugaaaacaaauggaaguccgcuagagaggccguggaagacagccgguuuugggagcugguggauaaggaacgcaaccuccaccuggagggaaaaugcgagaccugugucuauaauaugaugggcaagagagagaagaagcugggcgaguucgggaaagccaagggaucucgggcgauuugguacauguggcucggcgcucgcuuucuggaguucgaggcccuuggguuucugaacgaagaccacugguucuccagagagaauagccucuccggaguugagggcgaagggcugcauaaacuuggcuacauccugcgggacgugagcaaaaaggagggaggcgccauguaugcugaugacacggccgggugggauacccgcauuacacucgaagaccugaaaaacgaggaaauggugaccaaucacauggagggagagcauaagaaacuggcugaagccaucuuuaagcucacauaccagaacaaggucgugagaguucagcggccgaccccucgcggcacggugauggauauuaucucuagacgggaccaacgcgggagcggacaggucggcacauaugggcugaauaccuucacaaacauggaggcgcagcuuaucagacaaauggaaggcgagggaguguucaaauccauucagcggcugaccguuacggaggaaaucgccgugcagaauuggcucgcucgcgucggcagagagcggcugucuagaauggccauuagcggggaugacugcgugguuaagccccuugaugaccgcuuugcuuccgcccugaccgcgcucaacgauaugggaaaagugcggaaggacauccagcaaugggaacccucuagaggcuggaaugauuggacacaggucccuuucugcagccaccauuuucacgagcugauuaugaaagacgggcgcgugcuggucgugccgugucggaaccaggacgaacucaucggacgggcccgcaucucccagggcgcuggguggucucugaaggagaccgccugccuuggcaagagcuacgcucaaauguggucccugauguauuuccaccggagagaucuccgccuggccgcuaaugccauuuguagcgcgguucccucucauugggugccuacaucccggaccacauggagcauccacgccaaacaugaguggaugaccacggaagacaugcuuacagucuggaacagaguguggauucaggagaaucccuggauggaagauaagaccccuguggagucuugggaagagguucccuaccugggaaaacgcgaggaccaguggugcggcucccucaucgggcugaccagccgggcuacaugggccaagaacauucagaccgccaucaaccaagugagaucccugauuggaaaugaagaguauacagauuacaugccuucuaugaaacgguuuagacgcgaagaggaagaggcuggcguccucugguga

SEQ ID NO: 20200 - RNA, 9876 nt, Artificial Sequence
  derived and/or modified CDS sequence (opt5) from DENV-2__FM210224__SS-prME
accgccggagugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguauggaauggaaauccggccccuuaaggagaaggaagagaaucuggucaacucucucgugacagcgggccacgggcagaucgauaauuuuagccugggagugcugggcauggcccuuuuccucgaagagaugcugagaacccgcgucgggacgaaacaugcuauucugcucguugccguguccuuugugacccugaucacaggaaacaugucuuuccgggaccuuggcagagucauggugaugguuggcgccaccaugacagaugacauugggaugggagugaccuaccuggcucuccuggccgcguuuaagguccgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugauggugcugaaaauuguucggaauauggaaaaguaucaacuugcugugacaaucauggccauuagcugcgucccuaacgccgugauccugcagaaugcuuggaagguuuccuguacgauucucgccgcugugagcgucucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccguggggauggugucuauucuggcuuccagccuccugaaaaacgacaucccuaugacaggaccccucgucgccggcggccugcuuaccguuugcuacgugcugaccgggcgguccgccgaucuggaacucgagcgcgcuacagacgugaagugggaggaucaagcggaaauuagcggaucuagcccuauccuguccauuaccaucucugaggacggcagcauguccaucaaaaaugaagaggaggaacagacacuuacgauucugaucagaaccgggcuccuggucauuucuggacucuuccccgugagcaucccgauuacagccgcugccugguaucugugggagguuaagaagcagcgggccggcgugcuuugggaugucccuucucccccucccguggggaaagcugaacuggaggacggagccuaccgcaucaagcagaaaggcauccugggcuauagccaaauuggggcgggaguuuacaaggaaggcaccuuucacacaauguggcacgugaccagaggggcuguccucaugcaucggggaaaacgcaucgagcccagcugggccgaugugaagaaggaccugauuuccuacggcgggggauggaaacuugagggcgaauggaaggagggcgaagagguccaggugcuggcccucgaaccugggaaaaacccgagagcuguucagacgaagcccggacuguucaaaaccaauacaggcaccaucggggccgugagccucgauuuuucuccuggaacauccggcagccccauugucgaccggaaggggaaggugguuggacuguauggcaacggcguggucaccagaucuggggcguacguguccgcuaucgcccagacagagaaaagcaucgaggauaauccugaaauugaggacgauaucuuccgcaagaaacggcuuacgauuauggaccugcaccccggagccggcaagaccaaaagauaucugccugcuaucgugcgcgaagccauuaagcgggggcucagaacacugauccuugcuccgacccgcguugucgccgcggagauggaagaggcccugcggggacuccccauuagauaccaaaccccugcuauccgcgccgagcauacaggccgggaaaucguggaccugaugugucacgcuacguucaccaugagacuccugucccccgugcgggucccuaacuauaaccuuauuaucauggaugaggcccauuuuacagaccccgccucuauugcugcgcgcggguacaucagcaccagaguggaaaugggcgaggccgcuggaauuuucaugacagccaccccgccuggcucccgggaucccuuuccccagagcaaugccccuaucaucgacgaggaacgcgagauucccgaaagaucuuggaacuccgggcacgaguggguuacggauuucaagggaaaaacagugugguuugucccuagcaucaaggcuggcaaugacauugccgcgugccugcggaaaaacgggaagaaagugauccagcugucuagaaagaccuucgauagcgaauauguuaagacccgcacaaaugacugggauuuuguggucaccacagacauuuccgagaugggagcuaacuucaaagccgagcgggugaucgauccgagacgcuguaugaagcccguuauccucaccgacggcgaagaacgggugauucuggccgggccuaugcccgucacgcacucuagcgcugcccaaagacgcggccggaucggaagaaauccuaaaaacgaaaaugaccaguacauuuacaugggcgagccccuugaaaacgaugaggacugcgcgcauuggaaggaggccaaaaugcugcucgauaauaucaacacaccggaagggauuaucccuuccauguuugagcccgaacgcgagaagguggacgcuauugauggagaauauagacugcggggcgaggcccgcaaaaccuucguggaccugaugagaagaggggaucucccugucuggcuugcuuaccgcguugccgcugagggaaucaauuaugccgacagacggugguguuuugauggcgcgaagaacaaucagauccuggaagagaacguggaaguggagauuuggacaaaggagggggaacgcaagaagcugaaaccccgcuggcucgacgcccggaucuacucugauccucuggcucuuaaggaguucaaagaguucgccgcuggcagaaagagccugacccucaaccugauuacggagaugggacgccugcccaccuuuaugacacagaaggcccgggacgcccucgauaaucuugcuguccugcacaccgcggaagccggcgggagagcuuauaaccaugcccuguccgagcucccggagacacuggaaacccuucugcuccugacacugcucgccaccgugacgggaggcaucuuccuuuuucugaugagcgggaaaggaguuggcaagaugacacugggcaugugcugcauuaucaccgcuucuauccuccugugguacgcccaaauucagccucacuggaucgcggccuccauuauccuugaguucuuucugauugugcuccugauccccgaacccgagaaacagcggaccccucaggacaaucaacugacauaugucgugaucgcuauucucaccguuguggccgcuacaauggccaacgaaaugggguuccuugagaagacgaaaaaggaccugggacugggcagcaucgcgacccaggagccggaauccaauauucucgauaucgaccugcgccccgccucugcuuggacacuuuacgccgucgcuaccacauuugugaccccuaugcugagacacagcauugagaacuccucugucaaugugagccucacggccaucgcuaaccaggccaccguucugauggggcugggaaagggcuggccccucuccaaaauggauauuggggugccucuucuggcgaucggauguuacagccaggugaaucccaucacacugaccgccgcucuccugcuucugauugcccauuaugcuaucauuggcccuggccuccaagccaaggccacacgggaagcgcagaaacgcgcugccgcugggaucaugaagaacccgaccgucgacggaauuacgguuaucgaucuggaccccaucccuuacgaucccaaauucgagaagcagcugggccaggugaugcuccuuauucugugcgugacacaaguccugaugaugagaaccacaugggcccucugugaagcccugacccuugcuaccgggccuaucucuacacugugggagggaaaucccggccgguuuuggaacacgaccauugccguguccauggcgaauaucuuccgcgggagcuaucucgccggagcuggccugcuguuuucuauuaugaagaacacaaccaauacaagacggggcaccgggaacaucggagagacgcucggcgaaaaauggaagucccgccuuaaugcccuggggaaaagcgaguuccagaucuacaagaaaucuggcauucaggaaguugacagaacacuggcuaaggagggcaucaaaagaggggaaaccgaucaccaugccgugagcagaggauccgcgaagcuccgcugguuugucgaacggaacauggugaccccggagggcaaggucguggaccugggcugcgggagaggaggcuggucuuauuacugugggggacuuaaaaacguucgcgaagugaagggccugacaaaagggggaccuggccacgaggaacccauucccaugagcaccuauggcuggaaucucguccggcugcaauccgggguggauguuuucuucacaccucccgagaagugcgacacgcugcucugugauaucggagagagcuccccuaacccgaccauugaagccggcagaacacuucgcgugcugucucuggucgagaauuggcucaacaaugacacccaguuuugcaucaaagugcugaaccccuacaugccuagcgugaucgaaaagauggagacacuucagcggaaguacgggggagcucugguuagaaauccccucucccgcaacucuacccaugaaauguauugggucagcaaugccacgggcaacauuguguccucugugaauaugaucagccggaugcugauuaacagauucaccaugaaacacaagaaagcuacauacgagccugacgucgaucugggguccggaacccgcaauaucggcauugagagcgaaauccccaaccucgacauuaucggcaagcggaucgagaaaauuaagcaggaacacgagacaucuuggcauuaugaucaagaccacccguacaagaccugggccuaucauggguccuacgaaacaaaacagaccggaagcgcuucuuccaugguuaauggcguggugagacuucugacgaagccuugggaugucgugcccaugguuacacagauggccaugaccgacaccacaccuuuugggcagcaacgcguguucaaagagaaggucgauacgagaacccaggagcccaaagaaggaacaaagaagcugaugaaaaucaccgcggaguggcucuggaaggaacugggcaaaaagaaaacaccucggauguguacccgcgaggaguuuacaagaaaggugcggagcaacgccgcucuuggggccauuuucaccgacgaaaacaaauggaagucugcuagagaggccguugaagauucccgguuuugggagcugguggacaaggaacgcaaucuccaccuggagggaaaaugcgagacgugugucuauaacaugaugggcaagagagagaagaagcugggcgaguucgggaaagccaagggaagccgggcgaucugguacauguggcucggcgcucgcuuucuggaguucgaggcccuuggguuucugaaugaagaucacugguucuccagagagaacagccucucuggaguggagggcgaagggcugcauaaacuuggcuacauucugcgggacgugagcaaaaaggagggaggcgccauguaugcugacgauaccgccgggugggacacacgcaucacccucgaagaucugaaaaaugaggaaauggucacaaaccacauggagggagagcauaagagacuggcugaagccaucuuuaaacucaccuaccagaauaagguugugcgggugcagcgccccacgccgagaggcacagucauggacauuaucucccggcgcgaucaaagagggucuggacaggugggcaccuaugggcugaacacauucaccaauauggaggcgcagcuuauucggcaaauggaaggcgagggaaucuucaagagcauucagcaccugacgguuaccgaggaaaucgccgugcagaacuggcucgcucgcgucggcagagagcggcuguccagaauggccaucucuggggacgauugcgugguuaaaccucuugacgaucgcuuugcuagcgcccugacagcgcucaaugacaugggaaaggugcggaaagauauucagcaaugggaacccuccaagggcuggaacgacuggacccagguccccuucugcucucaucacuuucacgagcugaucaugaaagaugggagagugcugguugugccuugucgcaaucaggacgaacucauuggacgggccagaaucagccagggcgcuggguggucccugaaggagacagccugccuuggcaagagcuacgcucaaauguggucucugauguauuuccaucgccgggaccucagacuggccgcuaacgccauuuguuccgcggucccgagccacugggugcccaccucucgcacaaccugguccauccaugccaaacacgaguggaugacgacagaagauaugcuuaccgucuggaaucggguguggauucaggagaacccuuggauggaagacaagacccccguugagagcugggaagaggugccuuaccugggaaaaagagaggaucaguggugcggcucccucaucgggcugacaucucgcgcuaccugggccaagaacauccagacagccauuaaucaaguccggagccugaucggaaacgaagaguauacggacuacaugcccuccaugaaaagauuucggagagaagaggaagaggcuggcgugcucugguga

SEQ ID NO: 20201 - RNA, 9876 nt, Artificial Sequence
  derived and/or modified CDS sequence (opt5) from DENV-2__FM210225__SS-prME
accgccggagugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguauggaauggaaauccggccccuuaaggagaaggaagagaaucuggucaacucucucgugacagcgggccacgggcagaucgauaauuuuagccugggagugcugggcauggcccuuuuccucgaagagaugcugagaacccgcgucgggacgaaacaugcuauucugcucguugccguguccuuugugacccugaucacaggaaacaugucuuuccgggaccuuggcagagucauggugaugguuggcgccaccaugacagaugacauugggaugggagugaccuaccuggcucuccuggccgcguuuaagguccgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugauggugcugaaaauuguucggaauauggaaaaguaucaacuugcugugacaaucauggccauuagcugcgucccuaacgccgugauccugcagaaugcuuggaagguuuccuguacgauucucgccgcugugagcgucucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccguggggauggugucuauucuggcuuccagccuccugaaaaacgacaucccuaugacaggaccccucgucgccggcggccugcuuaccguuugcuacgugcugaccgggcgguccgccgaucuggaacucgagcgcgcuacagacgugaagugggaggaucaagcggaaauuagcggaucuagcccuauccuguccauuaccaucucugaggacggcagcauguccaucaaaaaugaagaggaggaacagacacuuacgauucugaucagaaccgggcuccuggucauuucuggacucuuccccgugagcaucccgauuacagccgcugccugguaucugugggagguuaagaagcagcgggccggcgugcuuugggaugucccuucucccccucccguggggaaagcugaacuggaggacggagccuaccgcaucaagcagaaaggcauccugggcuauagccaaauuggggcgggaguuuacaaggaaggcaccuuucacacaauguggcacgugaccagaggggcuguccucaugcaucggggaaaacgcaucgagcccagcugggccgaugugaagaaggaccugauuuccuacggcgggggauggaaacuugagggcgaauggaaggagggcgaagagguccaggugcuggcccucgaaccugggaaaaacccgagagcuguucagacgaagcccggacuguucaaaaccaauacaggcaccaucggggccgugagccucgauuuuucuccuggaacauccggcagccccauugucgaccggaaggggaaggugguuggacuguauggcaacggcguggucaccagaucuggggcguacguguccgcuaucgcccagacagagaaaagcaucgaggauaauccugaaauugaggacgauaucuuccgcaagaaacggcuuacgauuauggaccugcaccccggagccggcaagaccaaaagauaucugccugcuaucgugcgcgaagccauuaagcgggggcucagaacacugauccuugcuccgacccgcguugucgccgcggagauggaagaggcccugcggggacuccccauuagauaccaaaccccugcuauccgcgccgagcauacaggccgggaaaucguggaccugaugugucacgcuacguucaccaugagacuccugucccccgugcgggucccuaacuauaaccuuauuaucauggaugaggcccauuuuacagaccccgccucuauugcugcgcgcggguacaucagcaccagaguggaaaugggcgaggccgcuggaauuuucaugacagccaccccgccuggcucccgggaucccuuuccccagagcaaugccccuaucaucgacgaggaacgcgagauucccgaaagaucuuggaacuccgggcacgaguggguuacggauuucaagggaaaaacagugugguuugucccuagcaucaaggcuggcaaugacauugccgcgugccugcggaaaaacgggaagaaagugauccagcugucuagaaagaccuucgauagcgaauauguuaagacccgcacaaaugacugggauuuuguggucaccacagacauuuccgagaugggagcuaacuucaaagccgagcgggugaucgauccgagacgcuguaugaagcccguuauccucaccgacggcgaagaacgggugauucuggccgggccuaugcccgucacgcacucuagcgcugcccaaagacgcggccggaucggaagaaauccuaaaaacgaaaaugaccaguacauuuacaugggcgagccccuugaaaacgaugaggacugcgcgcauuggaaggaggccaaaaugcugcucgauaauaucaacacaccggaagggauuaucccuuccauguuugagcccgaacgcgagaagguggacgcuauugauggagaauauagacugcggggcgaggcccgcaaaaccuucguggaccugaugagaagaggggaucucccugucuggcuugcuuaccgcguugccgcugagggaaucaauuaugccgacagacggugguguuuugauggcgugaagaacaaucagauccuggaagagaacguggaagucgagauuuggacaaaggagggggaacgcaagaagcugaaaccccgcuggcucgacgcgcggaucuacucugauccucuggcccuuaaggaguucaaagaguucgcugccggcagaaagagccugacccucaaccugauuacggagaugggacgccugcccaccuuuaugacacagaaggcucgggacgcccucgauaaucuugccgugcugcacaccgcugaagcgggcgggagagccuauaaccaugcucuguccgagcucccggagacacuggaaacccuucugcuccugacacugcucgccaccguuacgggaggcaucuuccuuuuucugaugagcgggaaaggagugggcaagaugacacugggcaugugcugcauuaucaccgccucuauccuccugugguacgcucaaauucagccucacuggaucgccgcguccauuauccuugaguucuuucugauuguccuccugauccccgaacccgagaaacagcggaccccucaggacaaucaacugacauaugugguuaucgccauucucaccguggucgcugccacaauggcuaacgaaaugggguuccuugagaagacgaaaaaggaccugggacugggcagcaucgccacccaggagccggaauccaauauucucgauaucgaccugcgccccgcgucugccuggacacuuuacgcuguggccaccacauuugucaccccuaugcugagacacagcauugagaacuccucugugaauguuagccucacggcuaucgccaaccaggcuaccgugcugauggggcugggaaagggcuggccccucuccaaaauggauauuggggugccucuucuggccaucggauguuacagccaggucaaucccaucacacugaccgcggcccuccugcuucugauugcucauuaugccaucauuggcccuggccuccaagcuaaggccacacgggaagcccagaaacgcgcggcugccgggaucaugaagaacccgaccguugacggaauuacggugaucgaucuggaccccaucccuuacgaucccaaauucgagaagcagcugggccaggugaugcuccuuauucugugcgucacacaagugcugaugaugagaaccacaugggcucucugugaagcccugacccuugccaccgggccuaucucuacacugugggagggaaaucccggccgguuuuggaacacgaccauugcuguuuccauggccaauaucuuccgcgggagcuaucucgcgggagccggccugcuguuuucuauuaugaagaacacaaccaauacaagacggggcaccgggaacaucggagagacgcucggcgaaaaauggaagucccgccuuaaugcucuggggaaaagcgaguuccagaucuacaagaaaucuggcauucaggaaguggacagaacacuggccaaggagggcaucaaaagaggggaaaccgaucaccaugcugucagcagaggauccgccaagcuccgcugguuuguggaacggaacauggucaccccggagggcaaggugguugaccugggcugcgggagaggaggcuggucuuauuacugugggggacuuaaaaacgugcgcgaagucaagggccugacaaaagggggaccuggccacgaggaacccauucccaugagcaccuauggcuggaaucucgugcggcugcaauccgggguugauguguucuucacaccucccgagaagugcgacacgcugcucugugauaucggagagagcuccccuaacccgaccauugaagcgggcagaacacuucgcguccugucucugguggagaauuggcucaacaaugacacccaguuuugcaucaaagugcugaaccccuacaugccuagcguuaucgaaaagauggagacacuucagcggaaguacgggggagcccuggucagaaauccccucucccgcaacucuacccaugaaauguauugggugagcaaugcuacgggcaacauuguguccucugucaauaugaucagccggaugcugauuaacagauucaccaugaaacacaagaaagccacauacgagccugacguugaucugggguccggaacccgcaauaucggcauugagagcgaaauccccaaccucgacauuaucggcaagcggaucgagaaaauuaagcaggaacacgagacaucuuggcauuaugaucaagaccacccguacaagaccugggcuuaucauggguccuacgaaacaaaacagaccggaagcgccucuuccauggugaauggcguggucagacuucugacgaagccuugggaugugguucccauggugacacagauggcuaugaccgacaccacaccuuuugggcagcaacgcgucuucaaagagaagguggauacgagaacccaggagcccaaagaaggaacaaagaagcugaugaaaaucaccgccgaguggcucuggaaggaacugggcaaaaagaaaacaccucggauguguacccgcgaggaguuuacaagaaagguucggagcaacgcggcccuuggggcuauuuucaccgacgaaaacaaauggaagucugccagagaggcuguggaagauucccgguuuugggagcuggucgacaaggaacgcaaucuccaccuggagggaaaaugcgagacguguguguauaacaugaugggcaagagagagaagaagcugggcgaguucgggaaagccaagggaagccgggccaucugguacauguggcucggcgcgcgcuuucuggaguucgaggcucuuggguuucugaaugaagaucacugguucuccagagagaacagccucucuggaguggagggcgaagggcugcauaaacuuggcuacauucugcgggacgucagcaaaaaggagggaggcgccauguaugccgacgauaccgcugggugggacacacgcaucacccucgaagaucugaaaaaugaggaaaugguuacaaaccacauggagggagagcauaagagacuggccgaagcuaucuuuaaacucaccuaccagaauaagguggugcggguccagcgccccacgccgagaggcacagugauggacauuaucucccggcgcgaucaaagagggucuggacagguuggcaccuaugggcugaacacauucaccaauauggaggcccagcuuauucggcaaauggaaggcgagggaaucuucaagagcauucagcaccugacggugaccgaggaaaucgcgguccagaacuggcucgcccgcgugggcagagagcggcuguccagaauggcuaucucuggggacgauugcguugugaaaccucuugacgaucgcuuugccagcgcucugacagcccucaaugacaugggaaagguccggaaagauauucagcaaugggaacccuccaagggcuggaacgacuggacccaggugcccuucugcucucaucacuuucacgagcugaucaugaaagaugggagaguucugguggucccuugucgcaaucaggacgaacucauuggacgggcgagaaucagccagggcgccggguggucccugaaggagacagcuugccuuggcaagagcuacgcccaaauguggucucugauguauuuccaucgccgggaccucagacuggcugccaacgcuauuuguuccgccgugccgagccacuggguccccaccucucgcacaaccugguccauccaugcgaaacacgaguggaugacgacagaagauaugcuuaccguguggaaucggguuuggauucaggagaacccuuggauggaagacaagacccccguggagagcugggaagaggucccuuaccugggaaaaagagaggaucaguggugcggcucccucaucgggcugacaucucgcgccaccugggcuaagaacauccagacagccauuaaucaagugcggagccugaucggaaacgaagaguauacggacuacaugcccuccaugaaaagauuucggagagaagaggaagaggccggcgugcucugguga

SEQ ID NO: 20202 - RNA, 9876 nt, Artificial Sequence
  derived and/or modified CDS sequence (opt5) from DENV-2__FM210226__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucguggccgucagcuuugugacgcugauuaccggaaacauguccuuccgggaccuuggcagaguuauggugauggucggcgccgcuaugacagaugacaucgggauuggagugaccuaccuggcccuccuggcggcuuuuaagguucgccccacauucgccgccggccugcuucugagaaaacucaccucuaaggagcugaugauggcuacgaucgggauugcccuccugagccaguccacaaucccugaaaccauccuugagcugacagaugcgcucgcucugggaaugauggugcugaaaauuguccggaauauggaaaaguaucaacuugccgugaccaucauggccauuucuugcguucccaacgcugugauccugcagaaugccuggaaggucagcuguaccauucucgcuacaguguccgugagcccucugcuccugacgucuucccagcagaaagccgacuggaucccccuugcgcugaccaucaagggccucaacccgacagccauuuuucugaccacacugagccgcaccucuaaaaagagauccuggccucuuaaugaggcuaucauggccgucgggaugguuagcauucuggcuucuucccuccugaaaaacgacauccccaugacgggaccucucguggccggcggccugcuuacagugugcuacguccugaccgggcggagcgccgaucuggaacucgagcgcgcuaccgacgugaagugggaggaucaagcggaaauuuccggaagcucucccauccugagcauuacaaucgccgaggacggcuccaugucuaucaaaaaugaagaggaggaacagacccuuacaauucugaucagaacggggcuccugguuauuagcggacucuucccgguguccaucccuauuaccgcugccgccugguaucugugggaggucaagaagcagcgggcuggcgugcuuugggauguucccucuccuccgcccguggggaaagccgaacuggaggacggagcguaccgcaucaagcagaaaggcauccugggcuauagccaaauuggggcuggagucuacaaggaaggcacauuucacaccauguggcacgugacaagaggggccguccucaugcaucggggaaaacgcaucgagccuuccugggccgaugugaagaaggaccugauuucuuacggcgggggauggaaacuugagggcgaauggaaggagggcgaagagguucaggugcuggcucucgaaccggggaaaaaccccagagccguccagaccaagccuggacuguucaaaacgaauaccggcacaaucggggcggugagccucgauuuuucccccggaaccagcggcucuccuauuguugaccggaaggggaagguggucggacuguauggcaacggcguggugacaagauccggggcuuacguuagcgccaucgcccagaccgagaaaucuaucgaggauaaucccgaaauugaggacgauaucuuccgcaagaaacggcuuacaauuauggaccugcacccuggagcuggcaagacgaaaagauaucugccggccaucguccgcgaagcuauuaagcgggggcucagaacccugauccuugcccccacacgcgugguggcggccgagauggaagaggcucugcggggacucccuauuagauaccaaacccccgccauccgcgcugagcauaccggccgggaaaucgucgaccugaugugucacgccacauucacgaugagacuccuguccccugugcggguucccaacuauaaccuuauuaucauggaugaggcccauuuuaccgacccggcuagcauugcggcccgcggguacaucuccacaagaguggaaaugggcgaggcugccggaauuuucaugaccgccacaccucccggcucucgggaucccuuuccucagagcaaugcucccaucauggacgaggaacgcgagaucccugaaagauccuggaacagcgggcacgagugggucaccgauuucaagggaaaaacggugugguuuguuccgucuauuaaggccggcaaugacaucgcggcuugccugcggaaaaacgggaagaaagugauucagcuguccagaaagacauucgauagcgaauaugucaagacccgcaccaaugacugggauuuugugguuacaaccgacaucucugagaugggagccaacuucaaagccgagcgggugauugaucccagacgcuguaugaagccugucauccucacagacggcgaagaacgggugauccuggcugggcccaugccugugacccacagcuccgccgcgcaaagacgcggccggauuggaagaaaucccaaaaacgaaaaugaccaguacaucuacaugggcgagccgcuugaaaacgaugaggacugcgcccauuggaaggaggcuaaaaugcugcucgauaauauuaacacgccugaagggaucauucccucuauguuugagccugaacgcgagaaggucgacgccaucgauggagaauauagacugcggggcgaggcucgcaaaacauucguugaccugaugagaagaggggaucuccccguguggcuugccuaccgcguggcugccgagggaauuaauuaugcggacagacggugguguuuugauggcgucaagaacaaucagauccuggaagagaacguggaaguugagaucuggaccaaggagggggaacgcaagaagcugaaaccucgcuggcucgacgcccggauuuacagcgauccccuggcucuuaaggaguucaaagaguucgccgcuggcagaaagucccugacacucaaccugaucaccgagaugggacgccugccgacguuuaugacccagaaggcccgggacgcccucgauaaucuugcugugcugcacacagcggaagccggcgggagagcuuauaaccaugcccugucugagcucccugagacccuggaaacacuucugcuccugacccugcucgccacagucaccggaggcauuuuccuuuuucugaugagcgggaaaggagugggcaagaugacgcugggcaugugcugcaucauuacagcuuccauccuccuguggcacgcccaaauccagccccacuggauugcggccagcaucauucuugaguucuuucugaucguucuccugauucccgaaccugagaaacagcggaccccgcaggacaaucaacugaccuacguggucaucgcuauccucacaguggucgccgcuaccauggccaacgaaaugggguuccuugagaagaccaagaaggaccugggacugggcucuauugcgacgcaggagcccgaauccaauauccucgauauugaccugcgcccugccagcgcuuggacccuuuaugccguggcuacaaccuuuguuacacccaugcugagacauuccaucgagaacucuagcgugaaugugucccucaccgccauugcuaaccaggccacgguccugauggggcugggaaagggcuggccucucucuaaaauggauaucgggguuccccuucuggcgauuggauguuacagccaggugaauccuaucacccugacagccgcucuccugcuucugguggcccacuacgcuaucauuggcccgggccuccaagccaaggccacccgggaagcgcagaaacgcgcugccgcugggaucaugaagaaccccacagucgacggaauuaccgugaucgaucuggacccuauucccuaugauccuaaauucgagaagcagcugggccagguuaugcuccuuauccugugcgugacgcaaguccugaugaugagaacaaccugggcccucugugaagcccugacacuugcuaccgggcccaucuccacccugugggagggaaauccgggccgguuuuggaacacaacgauugccgugagcauggcgaauaucuuccgcgggucuuaccucgccggagcuggccugcuguuuuccauuaugaagaacaccacaaauaccagacggggcacagggaacaucggagagacccucggcgaaaaauggaaaagccgccuuaaugcccuggggaaaucugaguuccagauuuauaagaaauccggaauccaggaagucgacagaacgcuggcuaaggagggcaucaaaagaggggaaacagaucaucacgccgugagcagaggaucugcgaagcuccgcugguuuguugaacggaacauggugaccccugagggcaaggucguggaccugggcugcgggagaggaggcuggagcuacuauugugggggacuuaaaaacguucgcgaagugaagggccugaccaaagggggacccggccaugaggaacccgucccuauguccacauacggcuggaaucucgugcggcugcaaucugggguggauguuuucuucacacccccugagaagugcgacacccugcucugugauauuggagagagcuccccgaaccccacgaucgaagccggcagaacccuucgcguccugagccugguggagaauuggcucaacaaugacacacaguuuugcauuaaagugcugaacccuuauaugcccuccgucaucgaaaagauggagacccuucagcggaaguacgggggagcucugguuagaaauccucucucucgcaacagcacacacgaaauguacuggguguccaaugccaccggcaacauugugucuagcgucaauaugaucucccggaugcugaucaacagauucacgaugaaacacaagaaagcuaccuaugagcccgacguggaucuggggucuggaacacgcaauauuggcaucgagagcgaaauuccgaaccucgacaucauuggcaagcggaucgagaaaauuaagcaggaacaugagaccuccuggcacuacgaucaagaccauccuuauaagacaugggccuaccacgggagcuaugaaaccaaacagacaggaucugcuuccagcaugguuaauggcguggucagacuucugaccaagcccugggaugugguuccuauggugacgcagauggccaugacagacaccacccccuuugggcagcaacgcgucuucaaagagaagguggauacaagaacgcaggagccuaaagaaggaaccaagaagcugaugaaaaucacagcggaguggcucuggaaggaacugggcaaaaagaaaacaccccggauguguacacgcgaggaguuuaccagaaaggugcggucuaacgccgcucuuggggccaucuucacagacgaaaacaaauggaaguccgcuagagaggccgucgaagauagccgguuuugggagcugguugacaaggaacgcaaucuccaccuggagggaaaaugcgagaccuguguguacaacaugaugggcaagagagagaagaagcugggcgaguucgggaaagccaagggaucucgggcgauuugguauauguggcucggcgcucgcuuucuggaguucgaggcccuuggguuucugaaugaagaucauugguucuccagagagaacagccucuccggaguggagggcgaagggcugcacaaacuuggcuacauccugcgggacgucagcaaaaaggagggaggcgccauguacgcugacgauacggccgggugggacacccgcauuacacucgaagaucugaaaaaugaggaaauggugaccaaccauauggagggagagcacaagaaacuggcugaagccaucuuuaagcucacauaucagaauaagguugugagaguccagcggccgaccccucgcggcacggugauggacauuaucucuagacgggaucaacgcgggagcggacagguuggcacauacgggcugaacaccuucacaaauauggaggcgcagcuuaucagacaaauggaaggcgagggaauuuucaaauccauccagcaucugaccgugacggaggaaauugccguccagaacuggcucgcucgggugggccgcgagagacugucucggauggccaucagcggggacgauugcguugugaagccccuugacgauagauuugcuuccgcccugaccgcgcucaaugacaugggaaaaguccgcaaggauauucagcaaugggaacccucucggggcuggaacgacuggacacaggugccuuucugcagccaccacuuucaugagcugaucaugaaagaugggagaguccuggugguuccgugucgcaaucaggacgaacucaucggacgggccagaauuucccagggcgcuggguggucucugaaggagaccgccugccuuggcaagagcuaugcucaaauguggucccugauguacuuccaccgccgggaccucagacuggccgcuaacgccaucuguagcgcggugcccucucauugggucccuacaucccgcaccacauggagcauucacgccaaacacgaguggaugaccacggaagauaugcuuacaguguggaaucggguguggauccaggagaaccccuggauggaagacaagaccccuguugagucuugggaagaggugcccuaucugggaaaaagagaggaucaguggugcggcucccucauugggcugaccagccgcgcuacaugggccaagaacauccagaccgccauuaaucaaguccggucccugaucggaaacgaagaguacacagacuauaugccuucuaugaaaagauuucggagagaagaggaagaggcuggcgugcucugguga

SEQ ID NO: 20203 - RNA, 9876 nt, Artificial Sequence
  derived and/or modified CDS sequence (opt5) from DENV-2__FM210227__SS-prME
acagccggagugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaggaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccgugaccgaggcugaacugacgggguauggaaccgucacaauggaguguagcccccggaccggccuugauuucaacgaaauggugcugcuccaaauggaggacaaagccuggcugguucaccgccagugguuucuugaucugccgcucccuuggcugcccggggcugacacacagggaucuaauuggauccagaaggagacccuggugacguucaagaacccucaugccaaaaagcaagacgucgugguucucggcucccaggaaggggccaugcacacagcucugaccggcgcgacagagauucagaugagcuccggaaaucuucuguuuaccggccaucucaaaugcagacugcggauggauaaacuucaacugaaagggaugucuuacagcauguguaccggaaaguucaagaucgugaaagaaauugccgagacacagcacggcacgaucgucaucagagugcaguaugagggggacggaucccccugcaagauucccuucgaaaucauggaucucgagaaacgccauguccugggccggcugauuaccgugaacccuaucguuacagaaaaggacagcccggugaacauugaggcugaacccccuuuuggggauucuuacaucauuaucggcgucgagcccggacagcucaaacugaauugguucaagaagggcuccagcaucgggcaaauguuugagaccacaaugagaggagccaaacgcauggccauucuuggcgacaccgcuugggauuucgggucucugggaggcguguuuacgagcaucgggaaggcccuccaccagguuuucggcgcgauuuacggagcugccuuuuccggcgugucuuggacaaugaaaauccugauuggggccaucaucaccuggauuggaaugaacagccgguccaccagccugucugucucccuugugcucgugggcguuaucacacuguaucugggggcuaugguccaggccgacagcggauguguggugucuuggaagaauaaagaacucaagugcggcuccgggauuuucaucaccgauaacguccacacauggacggagcaguacaaguuucaaccugaaagccccuccaaacuggcuucugccauucagaaggcgcaugaggaaggcaucuguggaaucagaagcgugacccgccuugagaaucugauguggaaacagauuacaccggagcucaaccacauccuguccgaaaaugagguuaagcugaccauuaugacaggcgacaucaaagggauuaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguggaagacuacggauuuggcgucuucaccacaaacaucuggcugaaacuucgggagaaacaggacguguuuugugauuccaagcugaugagcgccgcgauuaaagacaauagagccguucacgcugauaugggcuauuggaucgaaucuacccucaacgacacguggaagauggagaaggccuccuucauugaggugaaaagcugccacuggccuaagucucauacacuguggagcaaugggguccuggaauccgagaugaucauucccaagagcuucgcuggaccggugucucagcacaacuaccgcccuggcuaucauacccaaaccgccgggcccuggcaccuuggaaagcucgaaauggauuuugacuucugugagggcacaaccguuguggucacggaagauugcgggaaccggggacccucccugagaacaaccacagccagcggcaaacugaucaccgaguggugcugucgguccugcacacucccuccgcugcgcuacagaggcgaggacggguguugguacggaauggaaauucggccccuuaaggagaaggaagagaaucuggugaacucucucgugaccgcuggccaugggcagaucgauaauuuuagccugggaguccugggcauggcgcuuuuccucgaagagaugcugagaacgcgcguugggaccaaacacgccauccugcucguggcuguguccuuugucacacugauuaccggaaacaugucuuuccgggaccuuggcagagugaugguuauggugggcgccacaaugaccgaugacaucgggaugggagucacguaucuggcccuccuggcugccuuuaaggugcgcccuacauucgcggcuggccugcuucugagaaaacucaccagcaaggagcugaugauggccacaauugggaucgcccuccugucccagucuaccauucccgaaaccauccuugagcugacagaugcucucgcccugggaaugaugauccugaaaauuguucggaauauggaaaaguaccaacuugcggugacgaucauggcuauuagcugcgucccuaacgccgugauccugcagaaugccuggaagguuuccuguaccauucucgcugccgugagcgucucuccccugcuccugacauccagccagcagaaagcugacuggaucccucuugcccugaccaucaagggccucaaccccacagcgauuuuucugaccacgcugucucgcacauccaaaaagagaagcuggccgcuuaaugaggccaucauggcuguggggauggugucuauucuggccuccagccuccugaaaaacgacaucccuaugaccggaccccucgucgcuggcggccugcuuaccguuugcuaugugcugacagggcgguccgccgaucuggaacucgagcgcgccaccgacgugaagugggaggaucaagcugaaauuagcggaucuagcccuauccuguccauuacaaucucugaggacggcagcauguccaucaaaaaugaagaggaggaacagacgcuuaccauucugaucagaacagggcuccuggucauuucuggacucuuccccgugagcaucccgauuaccgcggccgcuugguaccugugggagguuaagaagcagcgggccggcgugcuuugggaugucccuucucccccucccguggggaaagccgaacuggaggacggagcuuaucgcaucaagcagaaaggcauccugggcuacagccaaauuggggccggaguuuauaaggaaggcacauuucacaccauguggcaugugacgagaggggcgguccucaugcaccggggaaaacgcaucgagcccagcugggcugaugugaagaaggaccugauuuccuacggcgggggauggaaacuugagggcgaauggaaggagggcgaagagguccaggugcuggcccucgaaccugggaaaaacccgagagccguucagaccaagcccggacuguucaaaacaaauaccggcacaaucggggcugugagccucgauuuuucuccuggaaccuccggcagccccauugucgaccggaaggggaaggugguuggacuguacggcaacggcguggucacaagaucuggggccuauguguccgcgaucgcucagacggagaaaagcaucgaggauaauccugaaauugaggacgauaucuuccgcaagaaacggcuuaccauuauggaccugcaucccggagccggcaagacaaaaagauaccugccugccaucgugcgcgaagcuauuaagcgggggcucagaacccugauccuugccccgacccgcguugucgcugccgagauggaagaggcgcugcggggacuccccauuagauaucaaaccccugccauccgcgcugagcacacgggccgggaaaucguggaccugaugugucaugccaccuucacaaugagacuccugucccccgugcgggucccuaacuacaaccuuauuaucauggaugaggcucacuuuaccgaccccgccucuauugccgcucgcggguauaucagcacaagaguggaaaugggcgaggcggccggaauuuucaugaccgcuacgccgccuggcucccgggaucccuuuccccagagcaaugccccuaucauggacgaggaacgcgagauccccgaaagaucuuggaacuucgggcacgaguggguuacagauuuuaagggaaaaaccgugugguucgucccuuccauuaaggccggcaaugacaucgcugccugccugcggaaaaacgggaagaaagugauucagcugagcagaaagaccuuugauucugaauacguuaagacacgcaccaaugacugggauuucguggucacaaccgacaucagcgagaugggagcgaacuuuaaagcugagcgggugauugauccgagacgcuguaugaagcccguuauccucacggacggcgaagaacgggugauccuggccgggccuaugcccgucacacauuccucugccgcucaaagacgcggccggauuggaagaaauccuaaaaacgaaaaugaccaguauaucuacaugggcgagccccuugaaaacgaugaggacugcgcccacuggaaggaggcgaaaaugcugcucgauaauauuaacaccccggaagggaucauuccuagcauguucgagcccgaacgcgagaagguggacgccaucgauggagaauacagacugcggggcgaggcucgcaaaacauuuguggaccugaugagaagaggggaucucccugucuggcuugccuaucgcguugcugccgagggaauuaauuacgcugacagacggugguguuucgauggcgugaagaacaaucagauccuggaagagaacguggaagucgagaucuggaccaaggagggggaacgcaagaagcugaaaccccgcuggcucgacgcccggauuuauuccgauccucuggcgcuuaaggaguucaaagaauuugccgcuggcagaaagucucugacgcucaaccugaucaccgagaugggacgccugcccacauucaugacccagaaggcccgggacgcucucgauaaucuugccgugcugcauacagccgaagcuggcgggagagcguacaaccacgcccugagcgagcucccggagacccuggaaacacuucugcuccugacccugcucgcuacgguuacaggaggcauuuuucuuuuccugauguccgggaaaggagugggcaagaugacccugggcaugugcugcaucauuaccgccagcauccuccugugguaugcccaaauccagccucacuggauugcugccucuaucauucuugaguuuuuccugaucguccuccugauucccgaacccgagaaacagcggacaccucaggacaaucaacugaccuacgugguuaucgcgauccucacaguggucgccgcuacgauggccaacgaaaugggguuucuugagaagaccaaaaaggaccugggacugggcuccguggcuacacaggagccggaaagcaauauucucgauaucgaccugcgccccgccuccgcguggacccuuuaugccgucgcuacaaccuucgugacgccuaugcugagacauucuauugagaacagcuccguuaaugugucucucaccgccaucgcuaaccaggccacagugcugauggggcugggaaagggcuggccccucagcaaaauggauauuggggucccucuucuggcuaucggauguuacucccagguuaaucccauuacccugacagccgcgcuccugcuucugguggcccacuacgcuaucaucggcccuggccuccaagccaaggcuacccgggaagcccagaaacgcgccgcggcugggauuaugaagaacccgacgguggacggaaucacagucauugaucuggaccccaucccuuaugaucccaaauuugagaagcagcugggccaggugaugcuccuuauucugugcguuacccaagugcugaugaugagaacaaccugggcccucugugaagcucugacccuugccacagggccuaucagcacgcugugggagggaaaucccggccgguucuggaacaccacaaucgccgucucuauggcuaauauuuuucgcggguccuaccucgccggagcgggccugcuguucagcaucaugaagaacaccacaaauaccagacggggcacggggaacauuggagagacacucggcgaaaaauggaagucucgccuuaaugcccuggggaaauccgaguuucagaucuauaagaaaagcggcauucaggaaguggacagaacccuggcuaaggagggcaucaaaagaggggagaccgaucaucacgccgucucuagaggaagcgcuaagcuccgcugguucguggaacggaacaugguuacaccggagggcaagguggucgaccugggcugcgggagaggaggcugguccuacuauugugggggacuuaaaaacgugcgcgaaguuaagggccugaccaaagggggaccuggccaugaggaacccauccccaugucuacauacggcuggaaucucgugcggcugcaaagcggggucgauguguucuuuacgccucccgagaagugcgacacccugcucugugauauuggagaguccagcccuaacccgacaaucgaagccggcagaacccuucgcgugcugucccugguugagaauuggcucaacaaugacacacaguucugcauuaaaguccugaaccccuauaugccuucugugaucgaaaagauggagacccuucagcggaaguacgggggagcgcuggugagaaauccccucagccgcaacuccacgcacgaaauguacugggucucuaaugccaccggcaacauuguuagcuccgugaauaugaucucucggaugcugaucaacagauuuacaaugaaacacaagaaagcuaccuaugagccugacguggaucuggggagcggaacacgcaauauuggcaucgaguccgaaauucccaaccucgacaucauuggcaagcggaucgagaaaauuaagcaggaacaugagaccagcuggcacuacgaucaagaccauccguauaagacaugggccuaccacgggucuuaugaaaccaaacagacgggauccgcuagcucuauggucaauggcgugguuagacuucugacaaagccuugggaugugguccccauggugacccagauggccaugaccgacacaacgccuuucgggcagcaacgcguuuuuaaagagaagguggauaccagaacacaggagcccaaagaaggaaccaagaagcugaugaaaaucacagcugaguggcucuggaaggaacugggcaaaaagaaaaccccucggauguguacacgcgaggaguucaccagaaagguccgguccaacgccgcgcuuggggccaucuuuacggacgaaaacaaauggaaguccgcuagagaggccguggaagauucucgguucugggagcugguggacaaggaacgcaaucuccaccuggagggaaaaugcgagaccugugucuacaacaugaugggcaagagagagaagaagcugggcgaguuugggaaagcuaagggaucccgggccauuugguauauguggcucggcgcccgcuuccuggaauuugaggcgcuuggguuccugaaugaagaucauugguuuagcagagagaacucccucagcggaguugagggcgaagggcugcacaaacuuggcuacauccugcgggacgugucuaaaaaggagggaggcgcuauguacgccgacgauacagccgggugggacacccgcauuacacucgaagaucugaaaaaugaggaaauggugaccaaccauaugggaggcgagcacaagagacuggcugaggccaucuucaaacucacguaucagaauaaggucgugcggguucagcgccccacaccgagagggaccgugauggacauuaucagccggcgcgaucaaagaggauccggccaggucgggacauacggccugaacaccuucacgaauauggaagcucagcuuauccggcaaauggagggagaaggcauuuuuaagucuauccagcaucugaccgugacagaggagauugccguucagaacuggcucgcgcgcguggggagagaacggcugagcagaauggccaucuccggagacgauugcgucgugaaaccucuugacgaucgcuucgcuucugcccugaccgcucucaaugacaugggcaagguucggaaagauauucagcaaugggagcccagcaagggguggaacgacuggacacaggugcccuuuugcucccaccacuuccaugaucugaucaugaaagacggaagaguccugguggucccuugucgcaaucaggacgaacucaucggccgggccagaauuucucagggggcgggcuggagccugaaggagaccgccugccuuggaaaguccuaugcucaaauguggagccugauguacuuucaccgccgggaucucagacuggccgcuaacgccaucuguucugcugugccgucccauuggguucccacaagccgcaccacguggucuauucacgccaaacacgaauggaugacaaccgaggacaugcuuaccguguggaaucgggucuggauccaggagaacccuuggauggaagauaagacacccguggaguccugggaagaggugccuuaucugggcaaaagagaagaccaguggugcgggagccucauuggacugaccucccgcgcgacaugggccaagaacauccagacggcuauuaaucaaguucggucucugaucggcaacgaggaguacaccgauuauaugcccagcaugaaaagauuccggagagaagaggaagaggccggggugcucugguga

SEQ ID NO: 20204 - RNA, 9876 nt, Artificial Sequence
  derived and/or modified CDS sequence (opt5) from DENV-2__FM210204__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaaggcgggauugugacaugcgcgauguuuacgugcaaaaagaauauggaagggaaaaucguccagccugagaaccucgaauacaccauuguuaucacaccccacagcggggaggagcaugccgugggaaaugacaccggcaagcacggcaaagaaaucaagauuacaccucagucuuccgugaccgaggcugaacugacgggguauggaaccgucacaauggaguguagcccccggaccggccuugauuucaacgaaauggugcugcuccaaauggaggacaaagccuggcugguucaccgccagugguuucuugaucugccgcucccuuggcugcccggggcugacacacagggaucuaauuggauccagaaggagacccuggugacguucaagaacccucaugccaaaaagcaagacgucgugguucucggcucccaggaaggggccaugcacacagcucugaccggcgcgacagagauucagaugagcuccggaaaucuucuguuuaccggccaucucaaaugcagacugcggauggauaaacuucaacugaaagggaugucuuacagcauguguaccggaaaguucaagaucgugaaagaaauugccgagacacagcacggcacgaucgucaucagagugcaguaugagggggacggaucccccugcaagauucccuucgaaaucauggaucucgagaaacgccauguccugggccggcugauuaccgugaacccuaucguuacagaaaaggacagcccggugaacauugaggcugaacccccuuuuggggauucuuacaucauuaucggcgucgagcccggacagcucaaacugaauugguucaagaagggcuccagcaucgggcaaauguuugagaccacaaugagaggagccaaacgcauggccauucuuggcgacaccgcuugggauuucgggucucugggaggcguguuuacgagcaucgggaaggcccuccaccagguuuucggcgcgauuuacggagcugccuuuuccggcgugucuuggacaaugaaaauccugauuggggccaucaucaccuggauuggaaugaacagccgguccaccagccugucugucucccuugugcucgugggcguuaucacacuguaucugggggcuaugguccaggccgacagcggauguguggugucuuggaagaauaaagaacucaagugcggcuccgggauuuucaucaccgauaacguccacacauggacggagcaguacaaguuucaaccugaaagccccuccaaacuggcuucugccauucagaaggcguaugaggaaggcaucuguggaaucagaagcgugacccgccuugagaaucugauguggaaacagauuacaccggagcucaaccauauccuguccgaaaaugagguuaagcugaccauuaugacaggcgacaucaaagggauuaugcaggccggaaagcggucucuuagaccucaacccaccgaacucaaauacagcuggaagacguggggcaaggcuaaaaugcuguccaccgagagccacaaccagacauuccugaucgaugggcucgaaaccgccgagugcccuaauacaaaccgcgcuuggaacucucuggagguggaagacuauggauuuggcgucuucaccacaaacaucuggcuuaagcugcgggagaaacaggacguguuuugugauuccaagcucaugagcgccgcgauuaaagacaauagagccguucaugcugauaugggcuacuggaucgaaucugcccugaacgacaccuggaagauggagaaggcuuccuucauugaggugaaaagcugccacuggcccaagucucacacgcuguggagcaaugggguccuugaauccgagaugaucauuccuaagagcuucgccggacccgugucucagcauaacuaucgcccgggcuaccacacacaaaccgccgggccuuggcaucucggaaagcuggaaauggauuuugacuucugugagggcaccacaguuguggucaccgaagauugcgggaaccggggacccucccugagaacgacaaccgcuagcggcaaacucaucacagaguggugcugucgguccugcacccugcccccucuucgcuacagaggcgaggacggguguugguauggaauggaaauucggccgcugaaggagaaggaagagaaucucgugaacucucuggugacagcgggccacgggcagaucgauaauuuuagccugggaguccuuggcauggcccucuuccuggaagagaugcugagaacccgcguugggacgaaacaugcuauccuccugguggccguguccuuugucacccuuauuacaggaaacaugucuuucaaggaccugggccgggugaugguuauggugggcgccaccaugacagaugacaucgggaugggagucaccuaccucgcucugcuggccgcguuuaaagugagacccacguucgcugccggccuucugcuccgcaagcugacaagcaaagagcucaugauggccaccauugggaucgcucugcuuucccagucuacaauuccugaaaccauccuggagcucaccgaugcccuggcgcugggaaugaugguucuuaagaucgugagaaauauggaaaaguaucaacuggcugucacaauuauggccaucagcugcgugcccaacgccguuauucuccagaaugcuuggaaaguguccuguacgauccuggccgcugucagcgugucuccucuccugcuuaccuccagccagcagaaggccgacuggauuccccuggcgcucacaaucaaaggccugaacccuaccgccaucuuucugacaacccuuucucggacguccaagaaacgcagcuggccccugaaugaggcuauuauggccguggggauggucucuauccucgcuuccagccugcucaagaacgacauuccgaugacaggaccucugguugccggcggccuucugaccgugugcuacgugcugaccgggagauccgccgaucucgaacuggagcgggcuacagacgucaaaugggaggaucaagcggaaaucagcggaucuagccccauucuuuccaucaccauuucugaggacggcagcauguccaucaagaaugaagaggaggaacagacacugacgauccucauucgcaccgggcugcucgugaucucuggacuguucccuguuagcauucccaucacagccgcugccugguaucuuugggaggugaagaaacagagagccggcguccugugggaugugccguccccucccccuguugggaaggcugaacuggaggacggagccuaccggauuaaacagaagggcauccucggcuauucucaaaucggggcgggaguguacaaagaaggcaccuuucacacaauguggcacgucacccgcggggcugugcugaugcauagaggaaagcggauugagcccagcugggccgaugucaagaaagaccuuaucuccuacggcgggggauggaagcuggagggcgaauggaaagagggcgaagaggugcagguucucgcccuggaacccgggaagaacccucgcgcugugcagacgaaaccgggacucuucaagaccaauacaggcaccauuggggccgucagccuggauuuuucucccggaacauccggcagcccuaucguggacagaaaggggaaaguugugggacuuuauggcaacggcgucgugacccggucuggggcguacguguccgcuauugcccagacagaaaagagcaucgaggauaaucccgaaaucgaggacgauauuuuccgcaagaagcgccugacgaucauggaccugcacccuggagccggcaaaaccaagcgguaucuccccgcuauuguuagagaagccaucaagcgcgggcugcggacacuuauucuggcuccuaccagagucguggccgcggagauggaagaggcccuccgcggacugccgauccgguaccaaacccccgcuauuagagccgagcauacaggccgcgaaaucguggaccucaugugucacgcuacguucaccaugcggcugcuuuccccugucagagugcccaacuauaaccugaucauuauggaugaggcccauuuuacagacccugccucuaucgcugcgcggggguacauuagcacccgcguugaaaugggcgaggccgcuggaaucuucaugacagccacacccccgggcuccagagauccuuuuccccagagcaaugcccccauuauggacgaggaacgggagaucccugaacgcucuuggaacuccgggcacgagugggugacggauuucaaaggaaagacagucugguuugugcccagcaucaaagcuggcaaugacauugccgcgugccugagaaagaacgggaaaaagguuauccagcucucucggaagaccuucgauagcgaauaugugaaaaccagaacaaaugacugggauuuugucgugaccacagacauuuccgagaugggagcuaacuucaaggccgagcgcguuaucgauccucggagauguaugaaaccggugauucugaccgacggcgaagagagagucauccuugccgggcccaugccugugacgcacucuagcgcugcccaacggagaggccgcaucggacggaaucccaagaacgaaaaugaccaguacauuuacaugggcgagccucuggaaaacgaugaggacugcgcgcauuggaaagaggccaagaugcuccuggauaauaucaacacacccgaagggauuaucccguccauguuugagccugaaagagagaaaguggacgcuauugauggagaauaucgccugagaggcgaggcccggaagaccuucgucgaccucaugcgcagaggggaucuucccguuuggcuggcuuaccggguggccgcugagggaaucaauuaugccgaccgcagaugguguuuugauggcgugaagaacaaucagauucuggaagagaacgucgaaguggagaucuggacaaaagagggggaacggaagaaacucaagccuagauggcuggacgcgcgcaucuacucugauccccuugcccugaaagaguucaaggaguucgcugccggcagaaagagccucacccugaaccugauuacggagaugggaagacucccuaccuuuaugacacagaaagcucgcgacgcccuugauaaucuggccguucugcacaccgcugaagcgggcgggcgggccuauaaccaugcucucuccgagcugcccgagacacuugaaacccugcuccugcugacacuccuugccaccgugacgggaggcaucuuccuguuucugaugagcgggaagggagucggcaaaaugacacucggcaugugcugcauuaucaccgccucuauucugcuuugguacgcucaaauccagccgcacuggaucgccgcguccauuauccuggaguucuuucucauugugcugcugaucccugaacccgagaagcagagaacaccccaggacaaucaacucacauauguugugauugccauccuuaccgucguggcugccacaauggcuaacgaaaugggguuccuggagaaaacgaagaaggaccugggacucggcagcgucgccacccaggagccugaauccaauauccuggauauugaccuucggccggcgucugccuggacacuguacgcuguggccaccacauuuguuacccccaugcuccgccacagcaucgagaacuccucugugaaugugagccugacggcuauugccaaccaggcuaccguccugauggggcucggaaaaggcuggccucuuuccaagauggauaucgggguuccccugcuggccauuggauguuacagccaggugaauccuaucacacucaccgcggcccugcuucugcucguggcucauuaugccauuaucggccccggccugcaagcuaaagccacaagagaagcccagaagcgggcggcugccgggaucaugaaaaacccuaccgucgacggaauuacggugaucgaucuggacccgauucccuacgauccuaaguucgagaagcagcucggccagguuaugcuucugauccugugcgugacacaaguccucaugaugcgcaccacaugggcucugugugaagcccuuacccuggccaccgggcccauuucuacacucugggagggaaauccuggcagauuuuggaacacgaccaucgcuguguccauggccaauaucuuccgggggagcuaucuggcgggagccggccugcucuuuucuauuaugaaaaacacaaccaauacacgcagaggcaccgggaacaucggagagacgcuuggcgaaaaguggaaaucccggcugaaugcucugggaaagagcgaguuccagauuuacaaaaagucuggaauccaggaagucgaccgcacacucgccaaagagggcauuaagagaggggagaccgaucaccaugcugugagccggggauccgccaagcugagaugguuuguugaacgcaacauggugacccccgagggcaaagucguggaccuuggcugcgggcggggaggcuggucuuauuacugugggggacugaagaacguuagagaagugaaaggccucacaaaagggggaccgggccacgaggaaccuauccccaugagcaccuauggcuggaaucugguccgccugcaauccgggguggauguguucuucacacccccugagaaaugcgacacgcuccuuugugauaucggagagagcucccccaacccuaccauugaagcgggccggacacugagaguucugucucucgucgagaauuggcugaacaaugacacccaguuuugcaucaaggugcuuaacccguacaugcccccugugauugaaaagauggagacacugcagcgcaaauacgggggagcccucguccggaauccccugagcagaaacuccacccaugaaauguauuggguuucuaaugcuacgggcaacaucgugagcuccgugaauaugauuucucgcaugcugaucaaccgguucaccaugaagcacaaaaaggccacauacgagccugacgucgaucucgggagcggaaccagaaauaucggcauugaguccgaaauccccaaccuugacauuaucggcaaacgcauugagaagaucaagcaggaacacgagacaagcuggcauuaugaucaagaccacccguacaaaaccugggcuuaucaugggucuuacgaaacaaagcagaccggauccgccagcucuauggugaauggcguugugcggcugcugacgaaaccuugggaugucgugcccaugguuacacagauggcuaugaccgacaccacaccuuuugggcagcaaagaguguucaaggagaaagucgauacgcgcacccaggagcccaaggaaggaacaaagaaacucaugaagauuaccgccgaguggcuguggaaagaacuuggcaagaaaaagacaccuagaauguguacccgggaggaguuuacacgcaaagugagauccaacgcggcccugggggcuaucuucaccgacgaaaacaaguggaaaagcgcccgggaggcuguggaagauucuagauuuugggagcucgucgacaaagaacggaaucugcaccuggagggaaagugcgagacguguguuuauaacaugaugggcaaacgcgaaaagaaacucggcgaguucgggaaggccaagggauccagagccaucugguacauguggcugggcgcgcgguuucuugaguucgaggcucugggguuucucaaugaagaucacugguucagccgcgagaacucccugagcggaguggagggcgaagggcuucauaaacugggcuacauucucagagacgugucuaagaaagagggaggcgccauguaugccgacgauaccgcugggugggacacacggaucacccuggaagaucugaagaaugaggaaauggucacaaaccacauggagggagagcauaaacgccucgccgaagcuauuuuuaagcugaccuaccagaauaaggugguuagagugcagcggcccacgccgcgcggcacagucauggacaucauuagcagacgggaucaacgcggguccggacaggugggcaccuaugggcuuaacacauucaccaauauggaggcccagcugaucagacaaauggaaggcgagggaaucuucaaaucuauucagcaccucacgguuaccgaggaaaucgcggugcagaacuggcuggcccgggucggccgcgagagacuuagccggauggcuauuuccggggacgauugcgugguuaagccucuggacgauagauuugccucugcucucacagcccugaaugacaugggaaaagugcgcaaggauauccagcaaugggaacccagcaaaggcuggaacgacuggacccagguccccuucugcucccaucacuuucacgaucugauuaugaaggacgggcgggugcucgucgugccuuguagaaaucaggacgagcugaucggacgcgcgcggaucucucagggcgccggguggagccuuaaggaaacagcuugccugggcaaauccuacgcccaaauguggagccucauguauuuccauagacgcgaucugcggcuugcugccaacgcuauuuguucugccguuccgucccacugggugcccaccagcagaacaaccuggucuauccaugcgaagcacgaguggaugacgacagaggacaugcugaccgucuggaaucgcguguggauucaggaaaacccuuggauggaggauaaaacccccguggaauccugggaggaaguuccuuaccucggaaagcgggaggaccaguggugcggcagccugaucgggcugacauccagagccaccugggcuaaaaacauucagacagccaucaaucaagugcgcucucucauuggaaacgaggaauauacggauuacaugcccagcaugaagcgguuuagacgggaggaagaggaagccggcguccugugguga

SEQ ID NO: 20205 - RNA, 9876 nt, Artificial Sequence
  derived and/or modified CDS sequence (opt5) from DENV-2__FM210230__SS-prME
accgcuggcgugaucauuaugcugauccccaccgcuauggccuuccaccucacgacccggaacggggagccucauaugauugucggacggcaggaaaagggcaaaagccugcuuuuuaagaccgaggacgggguuaauaugugcacccugauggcgaucgaucucggagaacugugugaggacacaauuaccuacaaaugcccccuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccguuggaaccacacacuuucagagagcccugaucuucauucuucuggcggccguggcuccuagcaugacgaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacagaggcuaagcagccugccacccugagaaaauauugcauugaagcgaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggcaucguuacaugcgccauguuuacaugcaaaaagaauauggaaggcaaaauuguucagccugagaaccucgaauacacgaucgugauuacaccccacagcggggaggagcaugcugugggaaaugacacaggcaagcacggcaaagaaaucaagaucaccccucagucucccauuacagaggccgaacugaccggguauggaacggucaccauggaguguuccccgcggacaggccuugauuucaacgaaauggugcugcuccaaauggaggacaaggcuuggcugguucaccgccagugguuucuugaucugccucuccccuggcugccuggggccgacacccagggaagcaauuggauccagaaggagacacuggugaccuucaagaacccccaugccaaaaagcaagacgucgugguucucggcucucaggaaggggcuaugcacacggcgcugacaggcgccaccgagauucagauguccagcggaaaucuucuguuuacaggccaucucaaaugcagacugcggauggauaaacuucaacugaaagggauguccuacucuauguguaccggaaaguucaagaucgugaaagaaauugcugagacccagcacggcacaaucgucaucagagugcaguaugagggggacggaagccccugcaagauuccuuucgaaaucauggaucucgagaaacgccauguccugggccggcugauuacggugaacccgaucguuaccgaaaaggacucccccgugaacauugaggccgaaccucccuuuggggauagcuacaucauuaucggcgucgagccuggacagcucaaacugaauugguucaagaagggaucuuccaucgggcaaauguuugagacaaccaugagaggagccaaacgcauggcuauucuuggcgacacagccugggauuucgggagccugggaggcguguuuaccucuaucgggaaggcgcuccaccagguuuucggcgcuauuuacggagccgccuuuagcggcguguccuggacgaugaaaauccugauuggggucaucaucacauggauuggaaugaacucucggagcaccucccugagcgugucucuugugcucguuggcgucaucacccuguaucugggggcuauggugcaggccgacuccggauguguggucagcuggaagaauaaagaacucaagugcggcucugggauuuucaucacagauaacgugcacaccuggacagagcaguacaaguuucaacccgaauccccgagcaaacuggcuuccgccauucagaaggcgcaugaggaaggcaucuguggaaucagaucuguuacgcgccuugagaaucugauguggaaacagauuaccccugagcucaaccacauccugagcgaaaaugaggugaagcugacaauuaugaccggcgacaucaaagggauuaugcaggccggaaagcggucccuuagaccccaaccuacagaacucaaauauucuuggaagaccuggggcaaggcuaaaaugcugagcacggagucccauaaccagaccuuccugaucgaugggcccgaaacagccgagugcccuaauaccaaccgcgcuuggaauagccucgaggucgaagacuacggauuuggcguguucacaaccaacaucuggcugaaacuucgggagaaacaggacgucuuuugugauucuaagcugauguccgccgcgauuaaagacaauagagccgugcacgcugauaugggcuauuggaucgaaagcgcccucaacgacacauggaagauggagaaggcuucuuucauugaggucaaauccugccacuggcccaagagccauacccuguggucuaauggggugcuggaaagcgagaugaucauuccgaaauccuucgccggaccuguuagccagcacaacuaccgccccggcuauuacacgcaaacagccgggcccuggcaucuuggaaagcucgaaauggauuuugacuucugugagggcaccaccguggucgugacagaagauugcgggaaccggggaccuucucugagaaccacgacagcuuccggcaaacugaucaccgaguggugcugucggagcugcacacucccgccccugcgcuacagaggcgaggacggguguugguauggaauggaaauucggccucuuaaggagaaggaagagaaucuggugaacucccucgucaccgcgggccacgggcagaucgauaauuuuucucugggaguucugggcauggcccuuuuccucgaagagaugcugagaacacgcguggggaccaaacaugcuauccugcucgugacggucagcuuugugacccugauuacaggaaacauguccuuccgggaccuuggcagaguuauggugauggucggcgccgccaugaccgaugacaucgggaugggagugacauaccuggcucuccuggccgcguuuaagguucgccccaccuucgcugccggccugcuucugagaaaacucacgucuaaggagcugaugauggccacaauugggaucgcucuccugagccaguccaccauuccugaaacaauccuugagcugaccgaugcccucgcgcugggaaugauggugcugaaaaucguccggaauauggaaaaguaucaacuugcugugaccauuauggccaucucuugcguucccaacgccgugauucugcagaaugcuuggaaggucagcuguacaauccucgccgcuguguccgugagcccuaugcugcucacgucuucccagcagaaagccgacuggauuccccuggcgcuuaccaucaagggccugaacccgacagccaucuuucucaccacacugagccgcaccucuaaaaagagauccuggccucugaaugaggcuauuauggccgucgggaugguuagcauccuugcuucuucccugcucaaaaacgacauucccaugacgggaccucugguggccggcggccuccugacagugugcuacguccuuaccgggcggagcgccgaucuggaacuggagcgcgcuaccgacgugaagugggaggaucaagcggaaaucuccggaagcucucccauucucagcaucacaauugccgaggacggcuccaugucuaucaaaaaugaagaggaggaacagacccugacaauccuuauuagaacggggcugcucguuaucagcggacuguucccgguguccauuccuaucaccgcugccgccugguaucucugggaggucaagaagcagcgggcuggcgugcugugggauguucccucuccuccgcccguggggaaagccgaacuugaggacggagcguaccgcauuaagcagaaaggcauccugggcuauagccaaaucggggcuggagucuacaaggaaggcacauuucacaccauguggcacgugacaagaggggccguccugaugcaucggggaaaacgcauugagccuuccugggccgaugugaagaaggaccucaucucuuacggcgggggauggaaacuggagggcgaauggaaggagggcgaagagguucaggugcuugcucuggaaccggggaaaaaccccagagccguccagaccaagccuggacucuucaaaacgaauaccggcacaauuggggcggugagccuggauuuuucccccggaaccagcggcucuccuaucguugaccggaaggggaagguggucggacucuauggcaacggcguggugacaagauccggggcuuacguuagcgccauugcccagaccgagaaaucuaucgaggauaaucccgaaaucgaggacgauauuuuccgcaagaaacggcugacaaucauggaccuucacccuggagcuggcaagacgaaaagauaucugccggccauuguccgcgaagcuaucaagcgggggcugagaacccucauucuggcccccacacgcgugguggcggccgagauggaagaggcccuucggggacugccuaucagauaccaaacccccgccauucgcgcugagcauaccggccgggaaaucgucgaccucaugugucacgccacauucacgaugagacugcucuccccugugcggguucccaacuauaaccugaucauuauggaugaggcccauuuuaccgacccggcuagcaucgcggcccgcggguacauuuccacaagaguggaaaugggcgaggcugccggaaucuucaugaccgccacaccucccggcucucgggaucccuuuccucagagcaaugcucccauuauggacgaggaacgcgagaucccugaaagauccuggaacagcgggcacgagugggucaccgauuucaagggaaaaacggugugguuuguuccgucuaucaaggccggcaaugacauugcggcuugccuucggaaaaacgggaagaaagugauccagcuguccagaaagacauucgauagcgaauaugucaagacccgcaccaaugacugggauuuugugguuacaaccgacauuucugagaugggagccaacuucaaagccgagcgggugaucgaucccagacgcuguaugaagccugucauucugacagacggcgaagaacgggugauccucgcugggcccaugccugugacccacagcuccgccgcgcaaagacgcggccggaucggaagaaaucccaaaaacgaaaaugaccaguacauuuacaugggcgagccgcuggaaaacgaugaggacugcgcccauuggaaggaggcuaaaaugcuucuggauaauaucaacacgccugaagggauuauccccucuauguuugagccugaacgcgagaaggucgacgccauugauggagaauauagacuccggggcgaggcucgcaaaacauucguugaccugaugagaagaggggaucugcccguguggcucgccuaccgcguggcugccgagggaaucaauuaugcggacagacggugguguuuugauggcgucaagaacaaucagauucuugaagagaacguggaaguugagaucuggaccaaggagggggaacgcaagaagcugaaaccucgcuggcuggacgcccggaucuacagcgauccccucgcucugaaggaguucaaagaguucgccgcuggcagaaagucccuuacacugaaccucauuaccgagaugggacgccugccgacguuuaugacccagaaggcccgggacgcccuggauaaucucgcugugcuucacacagcggaagccggcgggagagcuuauaaccaugcccugucugagcugccugagacccucgaaacacugcuucugcucacccugcuggccacagucaccggaggcaucuuccucuuucuuaugagcgggaaaggagugggcaagaugacgcugggcaugugcugcauuaucacagcuuccauucugcucugguacgcccaaauccagccccacuggaucgcggccagcauuauccuggaguucuuucuuauuguucugcucauccccgaaccugagaaacagcggaccccgcaggacaaucaacugaccuauguggucauugcuauccugacaguggucgccgcuaccauggccaacgaaaugggguuccucgagaagaccaagaaggaccuuggacugggcucuaucgcgacgcaggagcccgaauccaauauucuggauaucgaccuccgcccugccagcgcuuggacccuguacgccguggcuacaaccuuuguuacacccaugcuuagacacuccauugagaacucuagcgugaaugugucccugaccgccaucgcuaaccaggccacgguccucauggggcugggaaagggcuggccucugucuaaaauggauauugggguuccccuccuugcgaucggauguuacagccaggugaauccuauuacccugacagccgcucugcuccugcuuguggcccauuaugcuaucaucggcccgggccugcaagccaaggccacccgggaagcgcagaaacgcgcugccgcugggauuaugaagaaccccacagucgacggagugaccguuaucgaucucgacccuauucccuacgauccuaaauucgagaagcagcugggccaggugaugcugcucauccuuugcgucacgcaagugcugaugaugagaacaaccugggcccugugugaagcccucacacuggcuaccgggcccauuuccacccuuugggagggaaauccgggccgguuuuggaacacaacgaucgccgucagcauggcgaauaucuuccgcgggucuuaucuggccggagcuggccuccuguuuuccauuaugaagaacaccacaaauaccagacggggcacagggaacaucggagagacccugggcgaaaaauggaaaagccgccucaaugcccuugggaaaucugaguuccagauuuacaagaaauccggaauccaggaaguggacagaacgcuggcuaaggagggcauuaaaagaggggaaacagaucaccaugccguuagcagaggaucugcgaagcugcgcugguuuguggaacggaacauggucaccccugagggcaaggugguugaccucggcugcgggagaggaggcuggagcuauuacugugggggacugaaagaugugcgcgaagucaagggccuuaccaaagggggacccggccacgaggaacccaucccuauguccacauauggcuggaaccuggugcggcuccaaucugggguggacguuuucuucacacccccugagaagugcgauacccugcugugugacaucggagagagcuccccgaaucccacgauugaagccggcagaacccuccgcguccuuagccugguggagaacuggcugaauaacgacacacaguuuugcaucaaagugcucaauccuuacaugcccuccgucauugaaaagauggagacccugcagcggaaguacgggggagcucuuguuagaaacccucugucucgcaauagcacacaugaaauguauuggguguccaacgccaccggcaauaucgugucuagcgucaacaugauuucccggaugcucaucaauagauucacgaugaaacacaagaaagcuaccuacgagcccgauguggaccuggggucuggaacacgcaacaucggcauugagagcgaaaucccgaaucuggauauuaucggcaagcggauugagaaaaucaagcaggaacacgagaccuccuggcauuaugaccaagaucacccuuacaagacaugggccuaucaugggagcuacgaaaccaaacagacaggaucugcuuccagcaugguuaacggcguggucagacuccuuaccaagcccugggacgugguuccuauggugacgcagauggccaugacagauaccacccccuuugggcagcaacgcgucuucaaagagaagguggacacaagaacgcaggagccuaaagaaggaaccaagaagcugaugaaaauuacagcggaguggcuguggaaggaacucggcaaaaagaaaacaccccggaucuguacacgcgaggaguuuaccagaaaggugcggucuaaugccgcucugggggccaucuucacagaugaaaacaaauggaaguccgcuagagaggccgucgaagacagccgguuuugggagcuuguugauaaggaacgcaaccugcaccucgagggaaaaugcgagaccuguguguauaauaugaugggcaagagagagaagaagcugggcgaguucgggaaagccaagggaucucgggcgauuugguacauguggcugggcgcucgcuuucucgaguucgaggcccugggguuucuuaacgaagaccacugguucuccagagagaauagccuguccggaguggagggcgaagggcuccauaagcugggcuacauccuucgggacgucagcaaaaagggaggcggggccauguaugcugaugacacggccggaugggauacccgcauuacacuggaggaccucaaaaacgaagagauggugaccaaucacauggaaggcgagcauaagaaacuggcugaggccaucuuuaagcugacauaccagaacaagguugugagaguccagcggccgaccccucgcgggacggugauggauauuaucucuagacgggaccaacgcggaagcggccagguugggacauauggccucaauaccuucacaaacauggaagcgcagcugaucagacaaauggagggagaaggcguguucaaauccauucagcggcuuaccgucacggaggagaucgccgugcagaauuggcuggcucgcguugggagagaacggcucucuagaauggccauuagcggagaugacugcguggucaagccccuggaugaccgcuuugcuuccgcccuuaccgcgcugaacgauaugggcaaagugcggaaggacauccagcaaugggagcccucuagaggguggaaugauuggacacaggucccuuucugcagccaccauuuucacgaacucauuaugaaagacggacgcgugcugguugugccgugucggaaccaggacgagcugaucggcagagcccgcaucucccagggggcuggcuggucucucaaggaaaccgccugccugggaaagagcuacgcucaaauguggucccuuauguauuuccaccggagagaucugcgccucgccgcuaaugccauuuguagcgcgguccccucucauugggugccuacaucccggaccacauggagcauccacgccaaacaugaguggaugaccacggaggacaugcugacaguguggaacagaguuuggauucaggaaaaucccuggauggaggauaagaccccuguggaaucuugggaggaaguccccuaccuuggcaaacgcgaggaccaguggugcgggucccugaucggacucaccagccgggcuacaugggccaagaacauucagaccgccaucaaccaagugagaucccugauuggcaaugaggaauauacagauuacaugccuucuaugaaacgguuuagacgcgaggaagaggaagcugggguucugugguga

SEQ ID NO: 20206 - RNA, 9876 nt, Artificial Sequence
  derived and/or modified CDS sequence (opt5) from DENV-2__KC762665__SS-prME
accgccggcaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggaagcagaucacaccggagcugaaucauauucucagcgagaacgaagugaaacugaccaucaugacaggagacaucaagggcauuaugcaggcugggaaacggucccugagaccucagcccaccgagcuuaaguacagcuggaaaacguggggaaaggccaagaugcucucuaccgaacugcacaaucauacauuccugaucgauggcccugagaccgcggaaugccccaacgccaaucgcgcuuggaacucccucgagguugaggacuauggguuuggaguguucacaaccaauauuuggcugaaacuuaaggaacggcaagaugccuuuugugacagcaaacugaugucugcugccaucaaggacaacagagcgguccacgccgauaugggcuacuggauugaguccgcucucaacgacacauggaaaaucgaaaaggccagcuucaucgaggugaagucuugccacuggccuaaaagccauacccugugguccaauggcgugcuggagagcgaaaugauuauccccaagaacuucgcugggccggucucucagcacaauuaucgcccuggauaccauacgcagacagccggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgcuggacauggccagauugauaauuuuagccuggggguucugggaauggcgcuuuuccucgaggaaaugcugcgcacacgggugggcaccaagcacgccauccugcucgucgcuguguccuuuguuacgcugauuaccgggaacaugucuuucagagaccuuggacgcgugauggucauggugggcgccacaaugaccgaugacaucggcauggggguuacauaccuggcccuccuggcugccuuuaaggugagaccuaccuucgcggcuggacugcuucugcggaaacucacgagcaaggagcugaugaugacaaccaucggcauuacacuccugucccaaucuaccauccccgagaccauucuugaacugacagaugcccucgcccuggggaugaugguccugaaaaucgugcgcaauauggagaaguaucagcuugcugugacgauuauggccauccugugcgucccuaacgcgguuauccuccagaaugcuuggaaagugagcuguaccacacuggccguggucuccgugagcccccuccugcuuaccucuucccaacagaaggccgacuggauuccucuggcucucacaaucaagggacugaaccccaccgccauuuuucugacgacacuuagcagaaccucuaaaaagcgguccuggccgcugaaugaagcuaucauggccguuggcauggugagcauucucgcgucuucccugcucaaaaacgauaucccuaugaccgggccccuggucgccggaggccuucugacagugugcuacguucugaccggccgcagcgcugaccucgagcuggaaagagccgcugacgugcggugggaggagcaggccgaaaucuccgggagcucuccuauucuuagcaucacaauuuccgaggauggaucuaugagcaucaagaaugaagaggaggaacagacgcugaccauucucauccgcacaggccugcucgucauuuccgggcuguuccccgugucuaucccgaucaccgccgcugcgugguaucuuugggaggucaaaaagcaaagagccggagugcugugggacguuccuucucccccucccgugggcaaagcugaacuggaggauggggccuaccggauuaagcagaagggaauccucggcuauucccagauuggcgccggggucuacaaagaaggaacauuucacaccauguggcaugugacgcgcggcgcuguucugaugcacaaggggaaaagaaucgagcccuccugggccgacgugaagaaagaucuuauuagcuacggaggcggguggaagcuggagggagaauggaaggagggcgaagagguccaggugcucgcgcuggaaccuggcaaaaacccgcgggcugugcaaaccaagcccggacucuucaaaacauccaccggaacaaucggcgccguuagccuggacuuuucuccugggaccuccggaagccccaucgucgauaagaaaggcaaggugguggggcuuuauggaaacggcgucgugacaagaucuggcacguacguuuccgccauugcucagaccgaaaagagcaucgaggacaauccugaaauugaggaugacaucuuccgcaaaaagcggcugacaauuauggaucugcaucccggggccggaaaaaccaagagauaucucccugcgaucgugcgcgaagcuaucaaacggggccugagaacccuuauucuggccccgacacgcgucguggccgcugagauggaagaggcccuccgggggcugcccaucagauaccagacgccugcuauucgcgccgagcacaccggacgggaaaucguugaccucaugugucaugcgacauucaccaugagacugcuuucccccauucgggugccuaacuauaaucugaucauuauggaugaggcccacuuuacagaccccgcuucuaucgccgcucgcggcuacaucagcaccagagucgaaaugggggaggccgccggcauuuucaugacggcuacaccgccuggaucccgggaccccuuuccccagagcaacgcgccuaucauggaugaggaacgcgagauucccgaaagaucuuggaauagcggccacgagugggugaccgacuucaaggggaagaccguuugguuugugccuagcaucaaagccggaaacgauauugcugccugccugcggaagaauggcaaaaaggucauccaacucucuagaaaaacauucgacuuugaauauaucaagacccgcacaaacgauugggacuucguggugaccacggauauuagcgagaugggggccaauuuuaaggcugagcgggucaucgacccgagacgcuguaugaaacccguuauucugacagauggagaagaacgggugauccuugccggcccuaugcccgugacccauuccucugcggcucagagacgcgggcgggucggcagaaacccuaagaaugaaaacgaccaguacauuuacaugggagagccccuggaaaaugaugaggacugcgcccacuggaaagaggccaagaugcuccuggacaacaucaauacaccggaaggcaucauuccuagcauguucgagcccgaacgcgagaaaguggaugcuaucgacggggaauauagacugcggggagaggcccgcaagaccuuuguugaucucaugagacggggcgaccuuccuguguggcuggcguaccgcgucgccgcugaggggauuaacuaugccgauagacggugguguuucgacggagugaaaaacaaucaaauccuggaagagaacguugaaguggagauuuggacgaaggagggcgaaagaaagaaacucaagccccgcuggcuggaugcucggaucuacuccgacccucuugcccugaaagaguucaaggaauuugcugccgggagaaaaucucucacccugaaucugauuacagagaugggccgccuccccaccuucaugacacagaaggcgcggaacgcccuugauaaucuggcuguccugcauaccgccgaagcuggaggcagagccuauaaccacgcccucagcgagcugccggagacacuugaaacccugcuccugcugacgcuccuugcuacagugaccgggggaaucuuucuguuccugauguccggcaaggggaucggaaaaaugacccucggcaugugcugcauuaucacagcgagcauucugcuuugguacgcccagauccagccucacuggauugcugccucuaucauccuggaguuuuuccucauuguccugcugauccccgaacccgagaagcaacggaccccucaggacaaucagcucacauaugugguuauugccauccuuacggugguggcugccaccauggcgaacgaaaugggcuuucuggagaaaacaaagaaagauuucgggcugggauccauuaccacacagcaaccggagagcaauauccucgacaucgaucugcgccccgccuccgcuuggacccuuuacgccgucgcuacgaccuuuauuacaccuaugcugagacauucuaucgaaaacagcuccguuaaugugucucucaccgccauugcgaaccaggccacagugcugaugggccuggggaagggauggccccucagcaagauggacaucggcgucccucuucuggcuauuggguguuacucccaggugaaucccaucacccugacggccgcucuccugcuucugguugcccacuaugcuauuaucggaccuggccuccaggccaaagcgacacgggaggcccaaaagcgcgcugccgcuggcaucaugaaaaacccgaccguggacgggauuacagucaucgaucuggaccccauuccuuacgaucccaaguucgaaaaacagcugggacaggugaugcuccuuguccugugcgugacccagguucugaugaugagaaccacaugggcccucugugaggcccugacgcuugcgaccggcccuaucagcacacugugggaagggaaucccggacgguuuuggaacaccacaauugcugugucuauggccaauaucuuccgcggcuccuaucucgcuggggccggacugcuguuuagcaucaugaagaacaccgccaacacgagacggggcacaggcaauaccggggagacccucggagagaaguggaaaaaccgccuuaaugcucugggcaagucugaguuccaaauuuacaaaaaguccgggauccaggaggucgacagaacacuggccaaagaaggaauuaagcggggcgagaccgaucaucacgcggugagcagagggucugccaaacuccgcugguucguugagcggaaccugguggcuccggaaggaaaggucguggaccuuggcugcggcagagggggauggagcuauuacuguggcgggcugaagaaugugaaagagguuaagggacucacaaaaggcgggccuggacaugaggaacccauccccauguccacguauggcuggaaccugguccgccugcagucuggcguggauguguuuuucaccccucccgaaaagugcgacacacuccuuugugauauuggggagagcuccccuaauccgaccgucgaggccggacggacacugagaguucugaaccucguggaaaauuggcugaacaauaacacccaauuuugcaucaaagugcuuaaucccuacaugccuagcgucaucgagaagauggaagcucugcagcgcaaguacggcggggcccucgugcggaacccccuguccagaaauucuacgcacgagauguauuggguuagcaacgcguccggaaacauugugucuagcgucaauaugaucucccgcaugcugauuaaccgguucaccaugagacacaaaaaggccacauacgaaccugacguggaucucggcucugggacccgcaauaucggaauugagagcgagacacccaaccuugacaucaucggcaaacggauugaaaagaucaaacaggagcaugaaaccuccuggcacuaugaucaggaccauccguacaagacaugggcuuaucacggcagcuacgagaccaagcaaacggggucugccuccagcaugguuaauggaguggucagacugcugacaaaaccuugggacgugauucccauggugacccagauggcuaugaccgauacaacgccuuuuggccagcagcgcgucuucaaggaaaaaguugacaccagaacacaagagcccaaggaggggaccaaaaagcucaugaagaucacagccgaauggcuguggaaagagcuuggaaagaaaaagaccccucggauguguacacgcgaagaguuuaccagaaaagugcggucuaacgcugcccugggcgcgauuuucacggaugagaauaaguggaaauccgccagagaagcuguggaggacagcggguuuugggaacucgucgauaaggagcggaaccugcaccuggaaggaaagugcgagaccuguguguauaauaugaugggcaaacgcgagaagaaacucggcgaguucgggaaggccaaaggaucuagagcuaucugguacauguggcugggcgcccgguuucuugaguucgaagcccugggguuucucaacgaggaccauugguucucccgcgaaaauagccuguccggaguugagggcgaggggcuucacaagcugggcuacauucucagagaugugagcaagaaagaaggaggcgcgauguaugcugacgauacagccgggugggacacccggaucacacuggaggaucugaagaacgaagagauggucaccaaucauauggaaggagagcacaaaaagcucgccgaggcuaucuucaaacugacguaccagaacaaggugguucgcgugcagagacccacaccgcggggcaccgucauggacauuaucucucgcagagaccagcgggggagcggacaagugguuacauauggccuuaauaccuuuacgaacauggaagcccagcugauucgccagauggagggggaaggcguguucaaguccauccaacagcucaccgucacagaggagauugcugugaaaaacuggcuggucagagugggacgggaacgccuuucuagaauggccaucagcggcgaugacugcguugugaagccucuggaugaccgguuugcguccgcccucaccgcucugaaugauauggggaaagucagaaaggacauccagcagugggagcccucucgcggauggaacgauuggacacaagugcccuucugcagccaucacuuucacgaacugauuaugaaagacggccgggugcucguugugccuuguagaaaucaggaugagcugaucgggcgcgcccggauuucccagggagcuggcuggucucuuagagaaaccgccugccugggaaagagcuacgcgcagauguggucccucauguauuuccaucgccgggaccugagacuugccgcuaacgccaucuguagcgcugucccgucucacugggugcccacaucccgcaccacguggagcauucaugccacacacgaguggaugaccaccgaggauaugcugacaguuuggaaucggguguggauccaagaaaacccuuggauggaggacaagacccccgucgaaucuugggaggaaaucccuuaccucggcaaaagagaggaucaguggugcggaucccugauuggccugacaagccgcgcuacgugggccaagaauauccagaccgcgauuaaccaggugcggucccucaucgggaaugaggaauauacagacuacaugcccucuaugaaaagauuucggagagaggaagaggaagccggaguccugugguga

SEQ ID NO: 20207 - RNA, 9876 nt, Artificial Sequence
  derived and/or modified CDS sequence (opt5) from DENV-2__KC762669__SS-prME
accgccggcaucauuaucauggugauucccaccgucauggcuuuccaccugacgaccagaaacggggagccucauaugaucguuagccggcaggaaaaggggaaaagccuccuguuuaagaccgagaauggcgugaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccgucgcucuggugccucauguugggaugggacucgagacaagaaccgaaacguggaugucuagcgagggcgccuggaagcacgcccagcggaucgagacaugggugcugcgccaucccggcuucaccauuauggcugccauccuggcuuacacaauugggaccaccuauuuucagagaguccucaucuucauucugcuuacagccguggcgccuuccaugacgaugcggugcaucggaauuucuaaccgcgacuuuguugaaggcgugagcgggggauccugggucgauaucgugcuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggaucgugaccugcgcgauguuuacaugcaagaaaaauauggagggaaagauugugcagccugaaaaccuggaguauacgaucgucauuacaccccacucuggcgaagagaaugccguggggaacgauacaggaaaacauggcaaggagaucaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauucagaaagagacacugguuaccuucaagaauccucacgccaagaaacaggauguggucgugcugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaaggucgugaaggagauugccgaaacccaacauggaacaaucguuauuagagugcaguacgagggcgacgggagccccugcaaaauccccuucgagaucauggaucuggaaaagcgccacguccucggacggcugauuacggugaauccuaucguuaccgagaaagacucuccggugaacauugaagcugagcccccuuuuggcgauuccuacaucauuaucggggucgaacccggccagcugaagcucagcugguucaaaaagggaucuagcauuggccagauguuugagacaaccaugagaggggccaagcgcauggccauccugggagacacagcuugggauuucggcucccuugggggaguguuuaccucuaucggcaaagcccugcaucaaguguucggggcgauuuauggcgcugccuuuagcggaguuuccuggacgaugaagauccucauuggcgucgugaucacauggauugggaugaauagccggucuaccucccugagcgugucucugguccuugugggaguugugacccucuaccugggcgucauggugcaggccgacuccggguguguugugagcuggaaaaacaaggagcugaaaugcggauccggcaucuucaucacagauaauguccacaccuggacagaacaguauaaguuucagccugagucucccagcaagcucgcuuccgccauucaaaaagcucacgaagaggggaucuguggcauuagaucugugacgcgccuggaaaaccuuauguggaagcagaucaccccggagcugaaucauauucucagcgagaacgaaguuaaacugacaaucaugaccggagacaucaagggcauuaugcaggccgggaaacggucccugagaccucagcccacagagcuuaaguacagcuggaaagcguggggaaaggccaagaugcucucuaccgaacugcacaaucauacguuccugaucgauggcccugagaccgcugaaugccccaacacaaaucgcgccuggaacucccucgagguggaggacuauggguuuggagucuucaccacaaauauuuggcugaaacuuaaggaacggcaagauguguuuugugacagcaaacugaugucugcugccaucaaggacaacagagcggugcacgccgauaugggcuacuggauugaguccgcucucaacgacaccuggaaaaucgaaaaggccagcuucaucgaggucaagucuugccacuggccuaaaagccauacacugugguccaauggcguucuggagagcgaaaugauuauccccaagaacuucgcugggccggugucucagcacaauuaucgcccuggauaccauacccagacggccggccccuggcaccuugggcggcucgagauggauuuugacuucugugaaggaacaaccguggucgugaccgaggauugcggcaacagagggcccucccugcggacaaccacggccagcggaaaacugauuacagaauggugcugucgcuccugcacccucccuccgcugagauaccggggcgaggacggcuguugguaugggauggagaucagaccccuuaaggaaaaagaggaaaaucugguuaacucucucgugacagcuggacauggccagauugauaauuuuagccuggggguccugggaauggcgcuuuuccucgaggaaaugcugcgcacccgggugggcacaaagcacgccauccugcucguugcuguguccuuugucacccugauuacggggaacaugucuuucagagaccuuggacgcgugaugguuauggugggcgccaccaugacagaugacaucggcaugggggucaccuaccuggcccuccuggcugccuuuaaggugagaccuacauucgcggcuggacugcuucugcggaaacucaccagcaaggagcugaugaugacgacaaucggcauugugcuccugucccaaucuaccauccccgagacaauucuugaacugaccgaugcccucgcccuggggaugaugguccugaaaaucguucgcaauauggagaaguaucagcuugcugugaccauuauggccauccugugcgugccuaacgcggucauccuccagaaugcuuggaaagugagcuguacaacgcuggccguuguguccgucagcccccuccugcuuaccucuucccaacagaaggccgacuggauuccucuggcucucacaaucaagggacugaaccccaccgccauuuuucugacaacccuuagcagaacgucuaaaaagcgguccuggccgcugaaugaagcuaucauggccgugggcaugguuagcauucucgcgucuucccugcucaaaaacgauaucccuaugacagggccccugguggccggaggccuucugaccgucugcuacgugcugaccggccgcagcgcugaccucgagcuggaaagagccgcugacguccggugggaggagcaggccgaaaucuccgggagcucuccuauucuuagcaucacaauuuccgaggauggaucuaugagcaucaagaaugaagaggaggaacagacccugacaauucucauccgcacgggccugcucgugauuuccgggcuguuccccguuucuaucccgaucaccgccgcugcgugguaucuuugggaggugaaaaagcaaagagccggaguccugugggacgugccuucucccccucccguuggcaaagcugaacuggaggauggggccuaccggauuaagcagaagggaauccucggcuauucccagauuggcgccgggguguacaaagaaggaacauuucacaccauguggcaugucacacgcggcgcugugcugaugcacaaggggaaaagaaucgagcccuccugggccgacgugaagaaagaucuuauuagcuacggaggcggguggaagcuggagggagaauggaaggagggcgaagagguucagguccucgcgcuggaaccuggcaaaaacccgcgggcugugcaaaccaagcccggacucuucaaaacgaacaccggaaucaucggcgccgugucccuggacuuuagcccugggacaucuggaucccccauugucgauaagaaaggcaaggugguugggcuuuauggaaauggcguggucaccagaagcggcacauacgugucugccaucgcucagaccgagaaguccauugaggacaacccugaaaucgaggaugacauuuuccgcaaaaagcggcugacaaucauggaucugcaucccggggccggaaaaacgaagagauaucucccugcgaucguucgcgaagcuauuaaacggggccugagaacccuuauccuggccccgacacgcguggucgccgcugagauggaagaggcccuccgggggcugcccauuagauaccagaccccugcuauccgcgccgagcacaccggacgggaaauuguggaccucaugugucaugcgacauucacgaugagacugcuuagccccauccggguuccuaauuauaaccugauuaucauggaugaggcccacuuuaccgaccccgcuuccaucgccgcucgcggcuacauuucuacaagaguggaaaugggggaggccgccggcaucuucaugaccgcuacaccgccuggaagccgggaccccuuuccccaguccaaugcgccuauuauggaugaggaacgcgagauccccgaaagaagcuggaacucuggccacgagugggucaccgacuucaaggggaagacggugugguuugugccuuccauuaaagccggaaaugauaucgcugccugccugcggaagaacggcaaaaaggucauccaacucagcagaaaaacauucgacuuugaauauauuaagacccgcaccaaugauugggacuucguugugacaaccgauaucucugagaugggggccaacuuuaaggcugagcgggugauugacccgagacgcuguaugaaacccgucauccugacagauggagaagaacgggugauucuugccggcccuaugcccguuacccauagcuccgcggcucagagacgcgggcgggugggcagaaauccuaagaacgaaaaugaccaguacaucuacaugggagagccccuggaaaacgaugaggacugcgcccacuggaaagaggccaagaugcuccuggacaauaucaacacgccggaaggcauuaucccuucuauguucgagcccgaacgcgagaaagucgaugcuauugacggggaauauagacugcggggagaggcccgcaagacauuuguggaucucaugagacggggcgaccuuccuguuuggcuggcguaccgcguggccgcugaggggaucaacuaugccgauagacggugguguuucgacggagucaaaaauaaccaaauucuggaagagaauguggaagucgagaucuggaccaaggagggcgaaagaaagaaacucaagccccgcuggcuggaugcucggauuuacagcgacccucuugcccugaaagaguucaaggaauuugcugccgggagaaaaucccucacacugaaccugaucaccgagaugggccgccuccccacguucaugacccagaaggcgcggaaugcccuugauaaccuggcugugcugcauacagccgaagcuggaggcagagccuauaaucacgcccucucugagcugccggagacccuugaaacacugcuccugcugacccuccuugcuacaguuaccgggggaaucuuucuguuccugaugagcggcaaggggauuggaaaaaugacgcucggcaugugcugcaucauuacagcguccauccugcuuugguacgcccagauucagccucacuggaucgcugccagcaucauucuggaguuuuuccucaucgugcugcugauucccgaacccgagaagcaacggaccccucaggacaaccagcucaccuauguggucaucgccauucuuacaguuguggcugccaccauggcgaaugaaaugggcuuucuggagaaaacaaagaaagauuucgggcugggaucuaucacgacccagcaacucgaguccaacauccuggacauugaucuucgcccggccagcgcuuggacacuguacgccguggcuaccacauuuaucacccccaugcucagacauuccauugaaaauucuagcgucaacgugucccugacggccaucgcgaaucaggccaccguucugaugggccucgggaagggauggccucuuucuaagauggacauuggcgugccccugcuggcuaucggguguuacagccaggucaacccuauuacacucaccgccgcucugcuucugcucguggcccacuaugcuaucaucggacccggccugcaggccaaagcgacacgggaggcccaaaagcgcgcugccgcuggcauuaugaaaaauccuaccgucgacgggaucacggugauugaucuggacccgauccccuacgauccuaaguucgaaaaacagcucggacagguuaugcuucuggugcugugcgucacacaggugcucaugaugagaaccacaugggcccugugugaggcccuuacccuggcgaccggccccauuuccacacucugggaagggaacccuggacgguuuuggaauacgaccaucgcuguuagcauggccaacaucuuccgcggcucuuaucuggcuggggccggacugcucuuuuccauuaugaagaacacagccaauaccagacggggcacaggcaacaccggggagacgcuuggagagaaguggaaaaaucgccugaacgcucugggcaagagcgaguuccaaaucuacaaaaagucugggauucaggagguggacagaacacucgccaaagaaggaaucaagcggggcgagaccgaucaucacgcggucuccagagggagcgccaaacugcgcugguucguggagcggaaucuugugacccccgaaggaaagguugucgaccugggcugcggcagagggggauggucuuauuacuguggcgggcucaagaacgugaaagaggugaagggacugacaaaaggcgggccgggacaugaagaaccuauucccaugagcaccuauggcuggaaucugguccgccuccaguccggcguugauguguuuuucacacccccugaaaagugcgacacgcuucugugugauaucggggagucuagccccaacccuaccguggaggcuggacggacacugagaguccucaaucugguggaaaacuggcuuaauaacaauacccaauuuugcaucaaaguucugaacccguacaugcccuccgugauugagaagauggaagcccuccagcgcaaguacggcggggcucugguccggaauccucugagcagaaacuccacacacgagauguauugggugucuaacgccagcggaaauaucguuuccucugugaacaugauuagccgcaugcucaucaaucgguucaccaugagacacaaaaaggcgacguacgaacccgacgucgaucuuggcuccgggacccgcaacauuggaaucgagucugagacaccuaaucuggacaucauuggcaaacggaucgaaaagauuaaacaggagcaugaaaccagcuggcacuaugaucaggaccaucccuacaagacaugggccuaucacggcuccuacgagaccaagcaaacagggagcgcuucuuccauggugaacggaguggucagacugcucaccaaaccgugggacguuaucccuauggugacgcagauggccaugacagauaccacccccuuuggccagcagcgcguguucaaggaaaaagucgacacaagaacgcaagagccuaaggaggggaccaaaaagcugaugaagauuacagcugaauggcuuuggaaagagcugggaaagaaaaagacaccccggauguguacacgcgaagaguuuaccagaaaagugcggagcaaugccgcucucggcgccaucuucacagaugagaacaaguggaaaucugcgagagaagccguugaggacuccggguuuugggaacugguggauaaggagcggaaucugcaccucgaaggaaagugcgagaccugugucuauaacaugaugggcaaacgcgagaagaaacugggcgaguucgggaaggcuaaaggaagcagagccauuugguacauguggcuuggcgcucgguuucuggaguucgaagcccucggguuucugaaugaggaccauugguucucucgcgaaaacucccuuagcggaguggagggcgaggggcugcacaagcucggcuacauccugagagauguuuccaagaaagaaggaggcgccauguaugcggacgauacggcugggugggacacccggaucacacuggaggaucucaagaaugaagagauggugaccaaccauauggaaggagagcacaaacgccuggccgaggccauuuucagacuuacauaccagaauaaggucgugcggguucagcgcccuacccccagaggcacggugauggacaucauuagccggcgcgaccagagagggucuggacaagucgugacauauggccugaacaccuuuacaaacauggaagcucagcucauccggcagauggagggggaaggcgucuucaaaagcauucaacaucugaccgugacggaggagaucgccguuaagaauuggcuugcucgcgugggaagagaacggcuguccagaauggccaucucuggcgaugacugcgucgugaagccgcucgaugaccgcuuugcgagcgcccugaccgcucugaacgauauggggaaagugcggaaggacauucagcagugggagccuuccagaggauggaaugauuggacacagguucccuucugcucucaccacuuucaugaacucaucaugaaagacggccgcgugcuggucgugcccugucggaaccaagaugagcuuauugggagagcccgcaucagccagggagcuggcuggucccugcgggaaaccgccugccucgggaagucuuacgcgcagauguggagccugauguauuuccacagacgcgaccuucggcuggccgcuaaugccauuuguuccgcuguuccuagccauugggugccgacaucuagaaccacaugguccauccacgccacccacgaguggaugacgacagaggauaugcucaccgucuggaaccgcguguggauccaggaaaaucccuggauggaggacaaaaccccugucgaaagcugggaggaaauucccuaccugggcaagcgggaggaucaauggugcggaucucugaucggccucacauccagagcuaccugggccaagaacauucagacagcgaucaaucaggugcggagccugauugggaacgaggaauauacggacuacaugccuuccaugaaaagauuucgccgggaggaagaggaagccggaguucuuugguga

SEQ ID NO: 20208 - RNA, 9876 nt, Artificial Sequence
  derived and/or modified CDS sequence (opt5) from DENV-2__KC762658__SS-prME
accgccggcaucauuaucaugaugauucccaccgugauggcuuuccaccugacgacccggaacggggagccucauaugaucgucagccggcaggaaaagggaaagucccuccuguuuaagaccgagaauggcguuaacaugugcacccuuauggccauggaccugggggaacucugugaggauaccauuaccuacaauugcccccugcuucgccaaaacgaacccgaggacaucgauuguuggugcaauucuacaagcaccugggugacguauggaaccuguacagcgccuggcgagcaccggcgggaaaaacgcuccguggcucugguuccccauguggggaugggacucgagaccagaacagaaaccuggaugucuagcgagggcgccggcaagcacgcccagcggaucgagacguggguucugcgccauccuggguucacaauuauggcugccauccuggcuuacaccauuggaacaaccuauuuucagagagugcucaucuucauucugcuuaccgccgucacacccuccaugacgaugcggugcaucggcauuucuaaccgcgacuuuguggaagggguuagcggaggcuccuggguggauaucguccuggagcacgggagcugugugaccacaauggcgaaaaauaagccuacccucgacuucgaacugaucaagacagaggccaaacuuccggcuacccugagaaaguacugcauugaagccaaacucacgaacacaaccaccgcuucucggugucccacacagggagagccuucccugaaugaggaacaagauaagcgcuuugugugcaaacacagcauggucgacagaggcuggggcaacggguguggacuguucggcaaaggcgggaucguuaccugcgccauguuuacaugcaagaaaaauauggaggggaagauugugcagcccgaaaaccucgaguauacgaucgugauuaccccucauucuggggaagagaaugcggucggaaacgauacaggcaaacacggcaaggagaucaaagugacaccccaguccagcaucacagaagccgagcugaccggguacggaacgguuaccauggaauguucuccgcggacaggccuugacuucaaugagauggugcugcuccagauggaaaacaaggcuuggcugguccaucgccaaugguuucuugaucugccucuccccuggcugccuggggccgacacccagggauccaacuggauucagaaagagacacuggugaccuucaagaauccccacgcuaagaaacaggauguugugguccucggcagccaagagggggccaugcacacggcccugacaggcgcuaccgaaauccagauguccucuggaaaccuucuguuuacaggccaucucaagugcagacugcggauggacaaacuucagcugaaggggaugagcuauuccauguguaccggaaaauucaagguggucaaggagauugcggaaacccaacacggcacaaucgugauuagaguucaguacgagggggacggaagccccugcaaaaucccuuucgagaucauggaucucgaaaagcgccaugugcugggccggcugauuacggucaauccgaucgugaccgagaaagacucucccguuaacauugaagccgagccucccuuuggggauuccuacaucauuaucggcguggaaccuggacagcucaagcugagcugguucaaaaagggcucuagcauugggcagauguuugagacaaccaugagaggagcuaagcgcauggccauccuuggcgacacagccugggauuucgggucccugggaggcgucuuuaccucuaucgggaaagcucuccaccaaguguucggcgccauuuauggagcggcuuuuagcggcguguccuggacgaugaagauccugauugggguugucaucacauggauuggaaugaauagccggucuaccucccugagcgugucucuugugcucgucggcgugguuacccuguaccugggggugaugguccaggccgacuccggaugugugguuagcuggaaaaacaaggagcucaaaugcggcuccgggaucuucaucacagauaaugugcauaccuggacagaacaguauaaguuucagcccgagucuccgagcaagcuggccuccgcuauucaaaaagcccacgaagagggcaucuguggaauuagaucugucacgcgccuugaaaaccugauguggaagcagaucaccccugagcucaaucacauucugagcgagaacgaagugaaacugacaaucaugaccggcgacaucaaggggauuaugcaggcuggaaaacggucccuuagaccccagccuacagagcucaaguacagcuggaaaaccuggggcaaggccaagaugcugucuacggaacugcauaaucacaccuuccucaucgaugggcccgagacagcggaaugcccuaacaccaaucgcgccuggaacucccuggagguugaggacuauggauuuggcguguucacaaccaauauuuggcuuaaacugaaggaacggcaagaugucuuuugugacagcaaacucaugucugcugccaucaaggacaacagagcugugcaugccgauaugggcuacuggauugaguccgcgcugaacgacacauggaaaaucgaaaaggccagcuucaucgaggugaagucuugccacuggcccaaaagccacacccugugguccaaugggguccuugagagcgaaaugauuaucccgaagaacuucgcuggaccuguuucucagcauaauuaucgccccggcuaccacacgcagacagccgggcccuggcaucucggacggcuggagauggauuuugacuucugugaaggcaccaccgugguggucacagaggauugcgggaacagaggaccuucccugcggaccacgacagcuagcggcaaacucauuaccgaauggugcugucgcuccugcacacugccgccccuuagauaccggggcgaggacggguguugguauggaauggagaucagaccucugaaggaaaaagaggaaaaucucgugaacucucugguuaccgccggccacgggcagauugauaauuuuagccugggagugcuuggcauggcccucuuccuggaggaaaugcugcgcacacgggucgggaccaagcaugcuauccuccugguggcgguuuccuuugugacgcuuauuaccggaaacaugucuuucagagaccugggccgcgucauggugaugguuggcgccacaaugaccgaugacaucgggaugggagugacauaccucgcucugcuggccgccuuuaaggucagacccaccuucgcugccggccuucugcuccggaaacugacgagcaaggagcucaugaugacaaccaucgggauugugcugcuuucccaaucuacaaucccugagaccauucuggaacucaccgaugcgcuggcucugggaaugauggugcuuaaaaucguccgcaauauggagaaguaucagcuggccguuacaauuauggccauccucugcgugcccaacgcugugauccugcagaaugccuggaaagucagcuguacgacccucgcggugguuuccgugagcccucugcuucugacaucuucccaacagaaggcugacuggauuccccucgcccugaccaucaagggccugaacccgacagccauuuuucuuaccacgcugagcagaacaucuaaaaagcgguccuggccucucaaugaagcuaucauggccgucgggauggugagcauucuggcuucuucccuccugaaaaacgauauccccaugaccggaccucuuguugccggcggccugcugaccgugugcuacguccucacagggcgcagcgcggaccuggagcuugaaagagccgcugacgugcggugggaggagcaggccgaaaucuccggaagcucucccauucugagcaucaccauuuccgaggauggcucuaugagcaucaagaaugaagaggaggaacagacacucacgauucugauccgcaccgggcuccuggucauuuccggacuuuucccggugucuaucccuaucacagcugccgccugguaucugugggagguuaaaaagcaaagagcuggcgugcugugggacguccccagcccuccgcccguggggaaagcggaacucgaggauggagccuaccggauuaagcagaagggcauccugggcuauucccagauuggggcuggaguuuacaaagaaggcaccuuucacacaauguggcacgugacccgcggggccguccuuaugcauaagggaaaaagaaucgagccuucuugggccgacgugaagaaagaucugauuagcuacggcgggggauggaagcucgagggcgaauggaaggagggcgaagaggugcagguucuggcucucgaaccggggaaaaacccccgggccguccaaacgaagccuggacuguucaaaaccaacacaggcaccaucggggcggugucccuugacuuuagccccggaacaucuggcuccccuaucguggauaagaaagggaaggucgugggacuguauggcaauggcguugugaccagaagcgggacauacgucucugcuauugcccagacggagaaguccaucgaggacaaccccgaaauugaggaugacaucuuccgcaaaaagcggcugaccauuauggaucuccacccuggagccggcaaaacaaagagauaucugccggcuaucgugcgcgaagccaucaaacgggggcuuagaacccugauucucgcgcccacccgcguuguggcugccgagauggaagaggcccugcggggacucccuaucagauaccagacacccgcuauucgcgccgagcauacgggccgggaaaucgucgaccugaugugucacgcuaccuucacaaugagacuucugagcccuauucgggugcccaauuauaaccugaucauuauggaugaggcccauuuuaccgacccggcguccaucgccgcucgcggguacaucucuacaagaguugaaaugggcgaggccgcuggaauuuucaugaccgccacgccucccggcagccgggaccccuuuccucaguccaaugcccccaucauggaugaggaacgcgagauuccugaaagaagcuggaacucugggcacgagugggugacagacuucaagggaaagaccgucugguuugugccguccaucaaagcuggcaaugauauugcggccugccuccggaagaacgggaaaaaggugauccaacugagcagaaaaaccuucgacuuugaauauaucaagacacgcaccaaugauugggacuucgucguuacaaccgauauuucugagaugggagcuaacuuuaaggccgagcgggugaucgaccccagacgcuguaugaaaccugugauucuuacggauggcgaggaacgggucauccuggccgggcccaugccugugacacacagcuccgcugcccagagacgcggccggguuggaagaaaucccaagaacgaaaaugaccaguacauuuacaugggcgagccgcucgaaaacgaugaggacugcgcgcauuggaaagaggcuaagaugcugcuggacaauaucaacaccccugaagggaucauucccucuauguucgagccugaacgcgagaaaguggaugccaucgacggagaauauagacuccggggcgaggcccgcaagacauuugucgagcuuaugagaagaggggaucugcccguguggcuggcuuaccgcguugccgcggaaggaauuaacuaugccgacagacggugguguuucgauggcgugaaaaauaaccaaauccucgaggaaaaugucgagguggagauuuggaccaaggaaggggagagaaagaaacugaagccucgcuggcuugacgcucggaucuacagcgauccccuggcccucaaagaguucaaggaguuugcugccggcagaaaaucccugacgcugaaccucauuaccgaaaugggacgccuuccgacauucaugacccagaaggcucggaaugcccuggacaaccuggcgguccuccacacagccgaggcuggcgggagagccuauaaucaugcucugucugagcuuccugaaacccuggagacacuccugcugcucacccuucuggccacggugacaggaggcaucuuucuguuccucaugagcgggaagggaaucggcaaaaugacccugggcaugugcugcauuaucaccgccuccauucuucugugguacgcucagauccagccccacuggauugcggccagcaucauccucgaauuuuuccugauuguucugcucauccccgagccugaaaagcaacggacaccgcaggauaaccagcuuaccuauguggugauugcuauccugacagucguugccgccacgauggcuaaugagaugggguuucuggagaaaaccaagaaagacuucggacucggcucuauuacaacccagcaacccgaauccaacauccuggauaucgaccuucgcccugccagcgcguggacacuguacgccguggcuaccacguuuauuacccccaugcucagacacuccaucgaaaauucuagcgugaacgucucccugacagccauugcuaaucaggccaccgugcugauggggcucggaaagggcuggccucuuucuaagauggauaucgggguuccccugcuggcgauuggauguuacagccaggugaacccuaucacacucaccgccgcucugcuucugcucgucgcccauuaugcuauuaucggcccgggccugcaggccaaagcuacgcgggaagcccaaaagcgcgcggccgcugggaucaugaaaaaucccacaguggacggaauuaccgucaucgaccuggauccuauucccuacgacccuaaguucgagaaacagcucggccaggugaugcuucugguucugugcgugacacagguccucaugaugagaaccaccugggcccugugugaagcucuuacacuggccacggggcccaucuccacccucugggagggaaacccgggccgguuuuggaauacaaccauugccgugagcauggcgaacaucuuccgcgggucuuaucuggcuggagccggccugcucuuuuccaucaugaagaacacagcuaauaccagacggggcacggggaacacaggagagacccuuggcgaaaaguggaaaaaucgccugaacgcccugggaaagagcgaguuccaaauuuacaaaaagucuggaauccaggaaguugauagaacccucgccaaagagggcauuaagagaggggaaacagaccaccaugcuguguccagaggaagcgccaaacugcgcugguucgucgaacggaaucuugugaccccugagggcaaggugguugaucugggcugcgggagaggaggcuggucuuauuacugugggggacucaagaacgucaaagaagugaagggccugacaaaagggggacccggccacgaggaacccaucccuaugagcacguauggcuggaaucuggugcgccuccaguccggggucgacgucuuuuucacacccccugagaagugcgauacacuucugugugacauuggagagucuagcccgaaccccaccguggaagcgggccggacacugagagugcucaaucuggucgagaacuggcuuaauaacaauacccaauuuugcaucaaagugcugaacccuuacaugcccuccguuaucgaaaagauggaggcccuccagcgcaaguacgggggagcucuggugcggaauccucugagcagaaacuccacgcaugaaauguauugggucucuaacgccagcggcaauauuguguccucuguuaacaugaucagccgcaugcucauuaaucgguucaccaugagacacaaaaaggcuacauacgagcccgauguggaccuuggguccggaacccgcaacaucggcauugagucugaaacaccgaaucuggauaucaucggcaaacggauugagaagaucaaacaggaacacgagaccagcuggcauuaugaccaggaucacccuuacaagacaugggccuaucauggguccuacgaaaccaagcaaacgggaagcgcgucuuccauggucaacggcguggugagacugcucacaaaacccugggacgucauuccuaugguuacccagauggccaugaccgacacaacgcccuuugggcagcagcgcguguucaaggagaaaguggauaccagaacacaagagccuaaggaaggaaccaaaaagcugaugaagaucacagcugaguggcuuuggaaagaacugggcaagaaaaagacaccccggauguguacacgcgaggaguuuaccagaaaaguccggagcaaugccgcucucggggccauuuucacggacgaaaacaaguggaaaucugcuagagaggccguggaagauuccggauuuugggagcugguugacaaggaacggaaucugcaccucgagggcaagugcgagaccuguguguauaacaugaugggcaaacgcgaaaagaaacugggggaguucggaaaggcgaaaggcagcagagccaucugguacauguggcuuggggcucgguuucuggaguucgaggcccucggauuucugaaugaagaucacugguucucucgcgagaacucccuuagcggcgucgagggggaaggccugcauaagcucggauacauucugagagacguguccaagaaagagggcggggcuauguaugccgaugacacagccggaugggauacccggaucacacuggaagaccucaagaaugaggaaaugguuaccaaccacauggagggcgagcauaaaaagcuggcggaagcuaucuucaaacuuacguaccagaauaaggugguccgcgugcagagaccgacaccucgggggaccguuauggauauuaucagccgcagagaccagcggggaucuggccaaguggucacauaugggcugaacaccuuuacgaacauggaggcccagcucauucgccagauggaaggcgagggaguguucaagagcauccaacagcugaccgucacagaggaaauugccgugaaaaauuggcuuguuagagugggccgggagcgccuguccagaauggcuaucucuggggacgauugcgucgugaagccccucgacgaucgguuugccagcgcucugaccgcccugaacgacaugggaaaagugagaaaggauauccagcagugggaacccucccgcggcuggaaugacuggacacaaguuccuuucugcucucaccauuuucacgagcucauuaugaaagaugggcgggugcuggucgugccguguagaaaccaggacgaacuuaucggacgcgcgcggauuagccagggcgccggguggucccugagagagaccgcuugccucggcaagucuuacgcccagauguggagccugauguauuuccaccgccgggaucuuagacuggcugccaaugcgaucuguuccgccguucccagccauugggugccuacaucucgcaccacgugguccauucacgcuacacaugaguggaugaccaccgaagacaugcucacagucuggaaccggguguggauccaagagaaucccuggauggaagauaagaccccugucgagagcugggaagagauccccuaccugggaaaaagagaggaccaguggugcggcucucugauugggcucacaucccgcgccacgugggcuaagaacauccagaccgccauuaaucaggugcggagccugaucggaaacgaaaaauauacagauuacaugccuuccaugaagagauuucggagagaggaagaggaagcuggcguucuuugguga

SEQ ID NO: 20209 - RNA, 9876 nt, Artificial Sequence
  derived and/or modified CDS sequence (opt5) from DENV-2__KC762660__SS-prME
accgccggaaucauuaucaugaugauucccacagugauggcuuuccaccugacgaccagaaacggggagccucauaugaucgucagccggcaggaaaagggaaaaucccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagguggugcagccugaaaaccuggaguauaccauugucaucacaccccacucuggcgaagagaaugcgguggggaacgauaccggaaaacauggcaaggagauuaaaguuacaccucaguccagcaucaccgaagccgagcucacgggcuacgggaccgugacaauggaauguucuccccggaccggacuggacuucaaugagaugguccuucugcagauggaaaacaaggcuuggcucgugcaccgccaaugguuucuggaucuuccgcugccuuggcuccccggcgccgacacacagggguccaacuggauccagaaagagacccugguuacguucaagaauccucacgcuaagaaacaggauguggucgugcugggaagccaagagggcgccaugcauacagcccucaccggggcuacagaaauucagauguccucuggcaaccugcuuuuuaccggacaccugaagugcagacuccggauggacaaacugcagcuuaagggcaugagcuauuccauguguaccgggaaauucaaggucgugaaggagaucgcggaaacacaacauggaacgauuguuaucagagugcaguacgagggcgacgggagccccugcaaaauucccuucgagaucauggaucuggaaaagcgccacguccucggacggcugaucaccgugaauccuauuguuacagagaaagacucuccggugaacaucgaagccgagcccccuuuuggcgauuccuacauuaucauuggggucgaacccggccagcugaagcucagcugguucaaaaagggaucuagcaucggccagauguuugagaccacaaugagaggggcuaagcgcauggccauucugggagacaccgccugggauuucggcucccuugggggaguguuuacgucuaucggcaaagcucugcaucaaguguucggggccaucuauggcgcggcuuuuagcggaguuuccuggacaaugaagauucucaucggcgucgugauuaccuggaucgggaugaauagccggucuaccucccugagcgugucucugguccuugugggaguugugacacucuaccugggcgucauggugcaggccgacuccggguguguugugagcuggaaaaacaaggagcugaaaugcggauccggcauuuucaucaccgauaauguccacacauggacggaacaguauaaguuucagccugagucucccagcaagcucgccuccgcuauccaaaaagcccacgaagaggggauuuguggcaucagaucugugacccgccuggaaaaccuuauguggaagcagauuacaccggagcugaaucauauccucagcgagaacgaaguuaaacugaccauuaugacaggagacaucaagggcaucaugcaggcugggaaacggucccugagaccucagcccaccgagcuuaaguacagcuggaaaacguggggaaaggccaagaugcucucuaccgaacugcacaaucauacauuccugauugauggcccugagaccgcggaaugccccaacacaaaucgcgccuggaacucccucgagguggaggacuauggguuuggagucuucaccacaaauaucuggcugaaacuuaaggaacggcaagauguguuuugugacagcaaacugaugucugcugccauuaaggacaacagagcugugcacgccgauaugggcuacuggaucgaguccgcgcucaacgacaccuggaaaauugaaaaggccagcuucaucgaggucaagucuugccacuggccuaaaagccauacgcugugguccaauggcguucuggagagcgaaaugaucauucccaagaacuucgcugggccggugucucagcacaauuaucgcccuggauaccauacacagaccgccggccccuggcaccuugggcggcucgagauggauuuugacuucugugaaggaaccacaguggucgugaccgaggauugcggcaacagagggcccucccugcggacgacaaccgcuagcggaaaacugaucacagaauggugcugucgcuccugcacccucccuccgcugagauaccggggcgaggacggcuguugguaugggauggagauuagaccccuuaaggaaaaagaggaaaaucugguuaacucucucgugacagccggacauggccagaucgauaauuuuagccuggggguccugggaauggcccuuuuccucgaggaaaugcugcgcacccgggugggcacgaagcacgcuauucugcucguugcgguguccuuugucacccugaucacagggaacaugucuuucagagaccuuggacgcgugaugguuauggugggcgccaccaugacagaugacauuggcaugggggucaccuaccuggcucuccuggccgccuuuaaggugagaccuacguucgcugccggacugcuucugcggaaacucacaagcaaggagcugaugaugaccacaaucggcaucgugcuccugucccaaucuaccauucccgagagcauccuugaacugaccgaugcgcucgcucuggggaugaugguccugaaaauuguucgcaauauggagaaguaucagcuugccgugacaaucauggccauucugugcgugccuaacgcugucauccuccagaaugccuggaaaguguccuguacgacccuggcgguugugagcgucucuccccuccugcuuacauccagccaacagaaggcugacuggaucccucuggcccucaccauuaagggacugaaccccacagccaucuuucugaccacgcuuucuagaacauccaaaaagcggagcuggccgcugaaugaagcuauuauggccgugggcaugguuucuauccucgcuuccagccugcucaaaaacgauauuccuaugaccgggccccugguggccggaggccuucugaccgucugcuacgugcugacaggccgcuccgcggaccucgagcuggaaagagccgcugacguccggugggaggagcaggccgaaaucagcgggucuagcccuauccuuuccauuaccaucucugaggauggaagcauguccauuaagaaugaagaggaggaacagacacugacgauccucauucgcaccggccugcucgugaucucugggcuguuccccguuagcauuccgaucacagcugccgccugguaucuuugggaggugaaaaagcaaagagcuggaguccugugggacgugccuucucccccucccguuggcaaagcggaacuggaggauggggccuaccggaucaagcagaagggcauucucggcuauagccagaucggcgcugggguguacaaagaaggaaccuuucacacaauguggcaugucacccgcggcgccgugcugaugcacaaggggaaaagaauugagcccagcugggccgacgugaagaaagaucuuaucuccuacggaggcggguggaagcuggagggagaauggaaggagggcgaagagguucagguccucgcucuggaaccuggcaaaaacccgcgggccgugcaaacgaagcccggacucuucaaaaccaacacaggaaccauuggcgcggugagccuggacuuuucuccugggacauccggaagccccaucgucgauaagaaaggcaaggugguugggcuuuauggaaauggcguggucaccagaucuggcacauacguguccgcuaucgcccagacggaaaagagcauugaggacaacccugaaaucgaggaugacauuuuccgcaaaaagcggcugaccaucauggaucugcaucccggggccggaaaaacaaagagauaucucccugcuauuguucgcgaagccaucaaacggggccugagaacccuuauccuggcgccgacccgcguggucgcugccgagauggaagaggcccuccgggggcugcccauuagauaccagacgccugcuauccgcgccgagcacacgggacgggaaauuguggaccucaugugucaugcuaccuucacaaugagacugcuuucccccauccggguuccuaauuauaaccugauuaucauggaugaggcccacuuuauugaccccgcgucuaucgccgcucgcggcuacaucagcaccagaguggaaaugggggaggccgcuggcauuuucaugacagccaccccgccuggaucccgggaccccuuuccccagagcaaugccccuaucauggaugaggaacgcgagauucccgaaagaucuuggaacuccggccacgagugggucacggacuucaaggggaagacagugugguuugugccuagcaucaaagcuggaaaugauauugcggccugccugcggaagaacggcaaaaaggucauccaacucucuagaaaaaccuucgacuuugaauauaucaagacccgcacaaaugauugggacuucguugugaccacagauauuagcgagaugggggcuaacuuuaaggccgagcgggugaucgacccgagacgcuguaugaaacccgucauucugaccgauggagaagaacgggugauccuugccggcccuaugcccguuacgcauuccucugcugcccagagacgcgggcgggugggcagaaauccuaagaacgaaaaugaccaguacauuuacaugggagagccccuggaaaacgaugaggacugcgcgcacuggaaagaggcuaagaugcuccuggacaauaucaacacaccggaaggcaucauuccuagcauguucgagcccgaacgcgagaaagucgaugccaucgacggggaauauagacugcggggagaggcccgcaagaccuuuguggaucucaugagacggggcgaccuuccuguuuggcuggcuuaccgcguggccgcggaggggauuaacuaugccgauagacggugguguuucgacggagucaaaaauaaccaaauccuggaagagaauguggaagucgagauuuggacaaaggagggcgaaagaaagaaacucaagccccgcuggcuggaugcucggaucuacuccgacccucuugcccugaaagaguucaaggaauuugcugccgggagaaaaucucucacccugaaccugauuacggagaugggccgccuccccaccuucaugacacagaaggcuaagaaugcccuugauaaccuggcggugcugcauaccgccgaagcuggaggccgggccuauaaucacgcucucagcgagcugccggagacacuugaaacccugcuccugcugacacuccuugccaccguuacaggcgggaucuuucuguuccugauguccgggaaagggaucggaaagaugacacucggcaugugcugcauuaucaccgccagcauucugcuuugguacgcucagauccagccucacuggauugcggccucuaucauccuggaguuuuuccucauugugcugcugauccccgaacccgagaaacaaagaaccccucaggacaaccagcucacauauguggucauugcuauccuuaccguuguggccgccacaauggcuaaugaaaugggcuuucuggagaagacgaaaaaggauuucgggcugggauccauuaccacacagcaaccggagagcaacauccucgacaucgaucugcggcccgccuccgcguggacccuuuacgccguggcuacaaccuuuauuacgccuaugcugcgccauucuaucgaaaauagcuccgucaacgugucucucaccgccauugcuaaucaggccacaguucugaugggccuggggaagggauggccccucagcaaaauggacaucggcgugccucuucuggcgauuggguguuacucccaggucaaccccaucacccugacagccgcucuccugcuucugguggcccacuaugcuauuaucggaccuggccuccaggccaaggcuaccagagaggcccaaaaacgggcggccgcuggcaucaugaagaauccgacggucgacgggauuacagugaucgaucuggaccccauuccuuacgaucccaaauucgaaaagcagcugggacagguuaugcuccuugugcugugcgucacccaggugcugaugaugcgcacaaccugggcccucugugaggcucugacccuugccacaggcccuaucagcacgcugugggaagggaaccccggaagauuuuggaauaccacaauugccguuucuauggcgaacaucuuccggggcuccuaucucgcuggggccggacugcuguuuagcaucaugaagaacaccgcuaauacacgcagaggcaccggcaacacgggggagacacucggagagaaauggaagaaucggcuuaacgcccugggcaaaucugaguuccaaauuuacaagaaauccgggauccaggagguggaccgcacccuggccaaggaaggaauuaaaagaggcgagaccgaucaucacgcugucagccgggggucugccaagcucagaugguucguggagcgcaaucuggugacaccggaaggaaagguugucgaccuuggcugcggcagagggggauggagcuauuacuguggcgggcugaaaaacgugaaggaggugaaaggacucaccaagggcgggccuggacaugaagaacccauccccauguccacauauggcuggaaucuggucagacugcagucuggcguugauguguuuuucacgccucccgaaaaaugcgacacccuccuuugugauauuggggagagcuccccuaacccgacaguggaggcgggacgcacccugcggguccugaaucucguggaaaacuggcugaauaacaauacacaauuuugcaucaagguucuuaaccccuacaugccuagcgugaucgagaagauggaagcccugcagagaaaauacggcggggcucucguccgcaauccccugucccggaacucuacccacgagauguauugggugagcaacgccuccggaaauauuguuucuagcgugaacaugaucuccagaaugcugauuaaucgcuucacgaugcggcacaagaaagcuaccuacgaaccugacgucgaucucggcucugggacaagaaacaucggaauugagagcgagacccccaaucuugacaucaucggcaagcgcauugagaaaaucaagcaggagcaugaaacauccuggcacuaugaucaggaccauccguacaagaccugggccuaucacggcagcuacgagacaaaacaaaccgggucugcguccagcauggugaacggagugguccggcugcugacgaagccuugggacguuauucccauggugacacagauggccaugaccgauaccacaccuuuuggccagcagagaguguucaaagaaaaggucgacacgcgcacccaagagcccaaagaggggacaaagaagcucaugaaaaucaccgcugaauggcuguggaaggagcuuggcaaaaagaaaacaccuagaauguguacccgggaagaguuuacacgcaaggugagaucuaaugccgcucugggcgccauuuucaccgaugagaacaaauggaaguccgcucgggaagccguugaggacagcggguuuugggaacucguggauaaggagagaaaucugcaccuggaaggaaaaugcgagacgugugucuauaacaugaugggcaagcgggagaaaaagcucggcgaguucgggaaagcgaagggaucucgcgccaucugguacauguggcugggcgcuagauuucuugaguucgaagcccugggguuucucaaugaggaccauugguucucccgggaaaacagccuguccggaguggagggcgaggggcuucacaagcugggcuacauucuccgcgauguuagcaaaaaggaaggaggcgcuauguaugccgacgauaccgccgggugggacacaagaaucacccuggaggaucugaaaaaugaagagauggugacaaaccauauggaaggagagcacaagaaacucgcggaggcuaucuucaagcugaccuaccagaauaaggucgugcggguucagcgccccacgccgagaggcacagugauggacauuaucucucggcgcgaccagagagggagcggacaagucgugaccuauggccuuaacacauuuaccaacauggaagcccagcugauucggcagauggagggggaaggcgucuucaaauccauccaacagcucacggugaccgaggagauugccguuaagaauuggcuggugcgcgucggaagagaacggcuuucucgcauggcuaucagcggcgaugacugcguggugaaaccucuggaugacagauuugccuccgcucucacagcccugaacgauauggggaagguucggaaagacauccagcagugggagcccucuagaggauggaaugauuggacccaagugcccuucugcagccaucacuuucacgaacugauuaugaaggacggccgcguccucgugguuccuugucggaaccaggaugagcugaucgggagagcgcgcauuucccagggagccggcuggucucuucaggaaacagcuugccuggggaaguccuacgcccaaauguggucccucauguauuuccaucggagagaccugcgccuugcugccaaugcgaucuguagcgccgugccgucucacuggguccccaccucccggacaaccuggagcauucaugcuacgcacgaguggaugacaaccgaggauaugcugaccguguggaacagagucuggauccaggaaaauccuuggauggaggacaaaacacccguggaaucuugggaggaaaucccuuaccucggcaagcgcgaggaucaguggugcggaucccugauuggccugaccagccgggccacaugggcuaaaaacauccagacggccauuaaucaaguuagaucccucaucgggaacgaggaauauaccgacuacaugcccucuaugaagcgcuuucggagagaggaagaggaagcuggagugcugugguga

SEQ ID NO: 20210 - RNA, 9876 nt, Artificial Sequence
  derived and/or modified CDS sequence (opt5) from DENV-2__KC762676__SS-prME
accgccggaaucauuaucaugaugauucccacagugauggcuuuccaccugacgaccagaaacggggagccucauaugaucgugagccggcaggaaaagggaaaaagccuccuguuuaagaccgagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagauugugcagccugaaaaccuggaguacacgaucgugauuacaccccauucuggcgaagagaaugccgucgggaacgauacaggaaaacacggcaaggagaucaaagugaccccucaguccagcaucacagaagcugagcucaccggcuaugggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucaugccaagaaacaggauguugugguccugggaagccaagagggcgccaugcacacggcucucacaggggcgaccgaaauccagauguccucuggcaaccugcuuuuuacaggacaucugaagugcagacuccggauggacaaacugcagcuuaagggcaugagcuacuccauguguaccgggaaauucaagguggucaaggagauugccgaaacccaacacggaacaaucgugauuagaguucaguaugagggcgacgggagccccugcaaaauccccuucgagaucauggaucuggaaaagcgccaugugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaccaaguguucggggcgauuuacggcgcugccuuuagcggaguguccuggacgaugaagauccucauuggcguugucaucacauggauugggaugaauagccggucuaccucccugagcgugucucuggugcuugucggagugguuacccucuaucugggcgugaugguccaggccgacuccgggugugugguuagcuggaaaaacaaggagcugaaaugcggauccggcaucuucaucacagauaaugugcacaccuggacagaacaguacaaguuucagccugagucucccagcaagcucgcuuccgccauucaaaaagcucaugaagaggggaucuguggcauuagaucugucacgcgccuggaaaaccuuauguggaagcagaucaccccggagcugaaucacauucucagcgagaacgaagugaaacugacaaucaugaccggagacaucaagggcauuaugcaggccgggaaacggucccugagaccucagcccacagagcuuaaguauagcuggaaaaccuggggaaaggcgaagaugcucucuacggaacugcauaaucacaccuuccugaucgauggcccugagacagccgaaugccccaacaccaaucgcgcuuggaacucccucgagguugaggacuacggguuuggaguguucacaaccaauauuuggcugaaacuuaaggaacggcaagaugucuauugugacagcaaacugaugucugccgcuaucaaggacaacagagccgugcacgcggauaugggcuacuggauugaguccgcccucaacgacacauggaaaaucgaaaaggcuagcuuuaucgaggugaagucuugcuauuggccuaaaagccauacccugugguccaauggcguccuggagagcgaaaugauuauccccaagaacuucgccgggccgguuucucagcacaauuaccgcccuggauaccauacgcagacagcuggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaucggggcgaggacggcuguugguacgggauggagaucagaccccuuaaggaaaaagaggaaaaucuggugaacucucucguuaccgccggacauggccagauugauaauuucagccugggggugcugggaauggcucuuuuucucgaggaaaugcugcgcacacgggucggcaccaagcacgcgauccugcucguggccguuuccuucgugacgcugauuaccgggaacaugucuuuuagagaccuuggacgcgucauggugaugguuggcgcuacaaugaccgaugacaucggcaugggggugacauaucuggcccuccuggccgcuuucaaggucagaccuaccuuugccgcgggacugcuucugcggaaacucacgagcaaggagcugaugaugacaaccaucggcauugugcuccugucccaaucuacaauccccgagaccauucuugaacugaccgaugcucucgcccuggggaugauggcccugaaaaucgugcgcaauauggagaaguaccagcuugcugucacaauuauggccauccugugcguuccuaacgcggugauccuccagaaugcuuggaaagugagcuguacgacccuggccgucguguccguuagcccccuccugcuuacaucuucccaacagaaggccgacuggauuccucuggcucucaccaucaagggacugaaccccacagccauuuuccugaccacgcuuagcagaacaucuaaaaagcgguccuggccgcugaaugaagcuaucauggccgugggcauggucagcauucucgcgucuucccugcucaaaaacgauaucccuaugaccgggccccugguggccggaggccuucugaccguuugcuaugugcugacaggccgcagcgcugaccucgagcuggaaagagccgcugacguccggugggaggagcaggccgaaaucuccgggagcucuccuauucuuagcaucaccauuuccgaggauggaucuaugagcaucaagaaugaagaggaggaacagacacugacgauucucauccgcaccggccugcucgugauuuccgggcuguuucccgucucuaucccgaucacagccgcugcgugguaccuuugggaggugaaaaagcaaagagccggaguucugugggacgugccuucucccccucccgucggcaaagcugaacuggaggauggggccuaucggauuaagcagaagggaauccucggcuacucccagauuggcgccgggguguacaaagaaggaaccuuccacacaauguggcauguuacccgcggcgcugugcugaugcacaaggggaaaagaaucgagcccuccugggccgacgucaagaaagaucuuauuagcuauggaggcggguggaagcuggagggagaauggaaggagggcgaagagguccaggugcucgcgcuggaaccuggcaaaaacccgcgggcuguucaaacgaagcccgggcucuuuaaaaccaacacaggaaccaucggcgccgucucccuggacuucagcccugggacaucuggaucccccaucguggauaagaaaggcaagguggucgggcuuuacggaaauggcgugguuaccagaagcggcacauaugugucugccauugcucagacggagaaguccaucgaggacaacccugaaauugaggaugacaucuuucgcaaaaagcggcugaccauuauggaucugcaucccggggccggaaaaacaaagagauaccucccugcgaucguccgcgaagcuaucaaacggggccugagaacccuuauucuggccccgacccgcgugguugccgcugagauggaagaggcccuccgggggcugcccaucagauaucagaccccugcuauucgcgccgagcacacgggacgggaaaucguggaccucaugugucaugcgaccuucacaaugagacugcuuagccccauucgggucccuaauuacaaccugaucauuauggaugaggcccacuucaccgaccccgcuuccaucgccgcucgcggcuauaucucuacaagaguggaaaugggggaggccgccggcauuuuuaugaccgcuacgccgccuggaagccgggaccccuucccccaguccaaugcgccuaucauggaugaggaacgcgagauucccgaaagaagcuggaacucuggccacgaguggguuacagacuuuaaggggaagaccgugugguucgucccuuccaucaaagccggaaaugauauugcugccugccugcggaagaacggcaaaaaggugauccaacucagcagaaaaaccuuugacuucgaauacaucaagacacgcaccaaugauugggacuuuguggucacaaccgauauuucugagaugggggccaacuucaaggcugagcggguuaucgacccgagacgcuguaugaaacccgugauucugacggauggagaagaacgggugauccuugccggcccuaugcccgucacacauagcuccgcggcucagagacgcgggcgggugggcagaaauccuaagaacgaaaaugaccaguacauuuauaugggagagccccuggaaaacgaugaggacugcgcccacuggaaagaggccaagaugcuccuggacaauaucaacaccccggaaggcaucauuccuucuauguuugagcccgaacgcgagaaaguugaugcuaucgacggggaauacagacugcggggagaggcccgcaagacauucguggaucucaugagacggggcgaccuuccugucuggcuggcguaucgcguggccgcugaggggauuaacuacgccgauagacggugguguuuugacggaguuaaaaauaaccaaauccuggaagagaauguggaagucgagauuuggaccaaggagggcgaaagaaagaaacucaagccccgcuggcuggaugcucggaucuauagcgacccucuugcccugaaagaguucaaggaguucgcugccgggagaaaaucccucacgcugaaccugauuaccgagaugggccgccuccccacauuuaugacccagaaggcgcggaaugcccuugauaaccuggcugugcugcauacagccgaagcuggaggcagagccuacaaucacgcccucucugagcugccggagacccuugaaacacugcuccugcugacccuccuugcuacggucacagggggaaucuuccuguuucugaugagcggcaaggggaucggaaaaaugacccucggcaugugcugcauuaucaccgcguccauucugcuuugguaugcccagauccagccucacuggauugcugccagcaucauccuggaguucuuucucauugugcugcugauccccgaacccgagaagcaacggacaccucaggacaaccagcucaccuacguugugauugccauccuuacaguggucgcugccacgauggcgaaugaaaugggcuuccuggagaaaaccaagaaagauuuugggcugggaucuauuacaacccagcaaccggaguccaacauccucgacaucgaucugcgccccgccagcgcuuggacacuuuacgccguugcuaccacguucauuaccccuaugcugagacauuccaucgaaaauucuagcgugaacgugucccucacagccauugcgaaucaggccaccguccugaugggccuggggaagggauggccccucucuaagauggacaucggcgugagccuucuggcuauuggguguuauucccagguuaacccuaucacacugaccgccgcucuccugcuucugguggcccacuacgcuauuaucggacccggccuccaggccaaagcgacgcgggaggcccaaaagcgcgcugccgcuggcaucaugaaaaauccuacagucgacgggauuaccgugaucgaucuggacccgauucccuaugauccuaaguuugaaaaacagcugggacaggucaugcuccuugugcugugcguuacacaggugcugaugaugagaaccaccugggcccucugugaggcccugacacuugcgacgggccccaucagcacccugugggaagggaacccuggacgguucuggaauacaaccauugcugucucuauggccaacaucuuucgcggcuccuaccucgcuggggccggacugcuguucagcaucaugaagaacacagccaauaccagacggggcacgggcaacacaggggagacccucggagagaaguggaaaaaucgccuuaacgcucugggcaagucugaauuucaaauuuauaaaaaguccgggauccaggagguggacagaacccuggccaaagaaggaauuaagcggggcgagacagaucaucacgcgguuagcagagggucugccaaacuccgcugguucguggagcggaaucuggucacccccgaaggaaaggugguggaccuuggcugcggcagagggggauggagcuacuauuguggcgggcugaagaacguuaaagaggucaagggacucacaaaaggcgggccgggacaugaggaaccuauccccauguccacguacggcuggaaucuggugcgccugcagucuggcguggaugucuucuuuacacccccugaaaagugcgacacacuccuuugugauauuggggagagcucccccaacccuaccguugaggcuggacggacacugagagugcugaaucucguggaaaacuggcugaauaacaauacccaauucugcaucaaaguccuuaacccguacaugcccagcgugaucgagaagauggaagcccugcagcgcaaguauggcggggcucucguucggaauccucuguccagaaacucuacgcacgagauguacugggugagcaacgccuccggaaauauugucucuagcgugaacaugaucucccgcaugcugauuaaucgguuuaccaugagacacaaaaaggcgacauaugaacccgacguugaucucggcucugggacccgcaacaucggaauugagagcgagaucccuaaucuugacaucauuggcaaacggaucgaaaagauuaaacaggagcaugaaacauccuggcacuacgaucaggaccaucccuauagaaccugggccuaccacggcagcuaugagacaaagcaaaccgggucugcuuccagcauggugaacggagucgugcgccugcugacgaagccgugggacgugaucccuauggucacacagauggccaugaccgauaccacacccuucggccagcagagaguuuuuaaagaaaagguggacacgcggacccaagagccuaaagaggggacaaagaaacucaugaagauuaccgcugaauggcuguggaaggagcuuggcaaaaagaaaacaccccgcauguguaccagagaagaguucacacggaaggugagaucuaaugccgcucugggcgccaucuuuaccgaugagaacaaauggaaguccgcgcgggaagccgucgaggacagcggguucugggaacucguggauaaagagcgcaaucugcaccuggaaggaaagugcgagacguguguuuacaacaugaugggcaagagagagaaaaagcucggcgaauuugggaaagcuaagggaucucgggccauuugguacauguggcugggcgcucgcuuccuugaguuugaagcccugggguuccucaaugaggaccauugguuuuccagagaaaacagccuguccggaguggagggcgaggggcuucacaaacugggcuauauccuccgggaugucagcaagaaggaaggaggcgccauguacgcggacgauaccgcugggugggacacacgcaucacccuggaggaucugaaaaaugaagagauggugacaaaccauauggaaggagagcacaagaaacucgccgaggccauuuucaagcugaccuaucagaauaaaguugugagaguccagcggccuacgccccgcggcacagugauggacaucauuucuagacgggaccagcgcgggagcggacaaguugugaccuacggccuuaacacauucaccaacauggaagcucagcugaucagacagauggagggggaaggcgucuuuaaguccauucaacagcucacggugaccgaggagaucgccgucaagaauuggcuggugcggguuggacgcgaaagacuuucucggauggcuaucagcggcgaugacugcguggucaaaccgcuggaugacagauucgccaacgcgcucacagcccugaaugauauggggaaggugcgcaaagacauucagcagugggagccuucccggggauggaacgauuggacccaagugcccuuuugcucucaucacuuccacgaacugaucaugaaggacggcagaguucucgugguccccugucgcaaucaggaugagcugauugggcgggcuagaaucagccagggagccggcuggucccuucgcgaaacagcuugccuggggaaaucuuaugcccagauguggagccucauguacuuucaucggagagaccugcgccuugcggccaacgcuauuuguuccgccgugccuagccacuggguuccgaccucucggacaaccugguccauccaugcuacgcacgaguggaugacaaccgaggauaugcugaccguguggaauagagucuggauccaagaaaaccccuggauggaggacaagacaccuguggaaagcugggaggaaauucccuaucucggcaagcgcgaggaucaguggugcggaucucugaucggccugaccucccgggccacaugggcuaaaaauauucagacggccaucaaccaggucagaagccucauugggaaugaggaauacaccgacuacaugccuuccaugaagcgguucagacgcgaggaagaggaagcgggagugcugugguga

SEQ ID NO: 20211 - RNA, 9876 nt, Artificial Sequence
  derived and/or modified CDS sequence (opt5) from DENV-2__KC762662__SS-prME
acagccggcaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggaagcagaucacaccggagcugaaucauauucucagcgagaacgaagugaaacugaccaucaugacaggagacaucaagggcauuaugcaggcugggaaacggucccugagaccucagcccaccgagcuuaaguacagcuggaaaacguggggaaaggccaagaugcucucuaccgaacugcacaaucauacauuccugaucgauggcccugagaccgcggaaugccccaacgccaaucgcgcuuggaacucccucgagguugaggacuauggguuuggaguguucacaaccaauauuuggcugaaacuuaaggaacggcaagaugccuuuugugacagcaaacugaugucugcugccaucaaggacaacagagcgguccacgccgauaugggcuacuggauugaguccgcucucaacgacacauggaaaaucgaaaaggccagcuucaucgaggugaagucuugccacuggccuaaaagccauacccugugguccaauggcgugcuggagagcgaaaugauuauccccaagaacuucgcugggccggucucucagcacaauuaucgcccuggauaccauacgcagacagccggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgcuggacauggccagauugauaauuuuagccuggggguucugggaauggcgcuuuuccucgaggaaaugcugcgcacacgggugggcaccaagcacgccauccugcucgucgcuguguccuuuguuacgcugauuaccgggaacaugucuuucagagaccuuggacgcgugauggucauggugggcgccacaaugaccgaugacaucggcauggggguuacauaccuggcccuccuggcugccuuuaaggugagaccuaccuucgcggcuggacugcuucugcggaaacucacgagcaaggagcugaugaugacaaccaucggcauuacacuccugucccaaucuaccauccccgagaccauucuugaacugacagaugcccucgcccuggggaugaugguccugaaaaucgugcgcaauauggagaaguaucagcuugcugugacgauuauggccauccugugcgucccuaacgcgguuauccuccagaaugcuuggaaagugagcuguaccacacuggccguggucuccgugagcccccuccugcuuaccucuucccaacagaaggccgacuggauuccucuggcucucacaaucaagggacugaaccccaccgccauuuuucugacgacacuuagcagaaccucuaaaaagcgguccuggccgcugaaugaagcuaucauggccguuggcauggugagcauucucgcgucuucccugcucaaaaacgauaucccuaugaccgggccccuggucgccggaggccuucugacagugugcuacguucugaccggccgcagcgcugaccucgagcuggaaagagccgcugacgugcggugggaggagcaggccgaaaucuccgggagcucuccuauucuuagcaucacaauuuccgaggauggaucuaugagcaucaagaaugaagaggaggaacagacgcugaccauucucauccgcacaggccugcucgucauuuccgggcuguuccccgugucuaucccgaucaccgccgcugcgugguaucuuugggaggucaaaaagcaaagagccggagugcugugggacguuccuucucccccucccgugggcaaagcugaacuggaggauggggccuaccggauuaagcagaagggaauccucggcuauucccagauuggcgccggggucuacaaagaaggaacauuucacaccauguggcaugugacgcgcggcgcuguucugaugcacaaggggaaaagaaucgagcccuccugggccgacgugaagaaagaucuuauuagcuacggaggcggguggaagcuggagggagaauggaaggagggcgaagagguccaggugcucgcgcuggaaccuggcaaaaacccgcgggcugugcaaaccaagcccggacucuucaaaacauccaccggaacaaucggcgccguuagccuggacuuuucuccugggaccuccggaagccccaucgucgauaagaaaggcaaggugguggggcuuuauggaaacggcgucgugacaagaucuggcacguacguuuccgccauugcucagaccgaaaagagcaucgaggacaauccugaaauugaggaugacaucuuccgcaaaaagcggcugacaauuauggaucugcaucccggggccggaaaaaccaagagauaucucccugcgaucgugcgcgaagcuaucaaacggggccugagaacccuuauucuggccccgacacgcgucguggccgcugagauggaagaggcccuccgggggcugcccaucagauaccagacgccugcuauucgcgccgagcacaccggacgggaaaucguugaccucaugugucaugcgacauucaccaugagacugcuuucccccauucgggugccuaacuauaaucugaucauuauggaugaggcccacuuuacagaccccgcuucuaucgccgcucgcggcuacaucagcaccagagucgaaaugggggaggccgccggcauuuucaugacggcuacaccgccuggaucccgggaccccuuuccccagagcaacgcgccuaucauggaugaggaacgcgagauucccgaaagaucuuggaauagcggccacgagugggugaccgacuucaaggggaagaccguuugguuugugccuagcaucaaagccggaaacgauauugcugccugccugcggaagaauggcaaaaaggucauccaacucucuagaaaaacauucgacuuugaauauaucaagacccgcacaaacgauugggacuucguggugaccacggauauuagcgagaugggggccaauuuuaaggcugagcgggucaucgacccgagacgcuguaugaaacccguuauucugacagauggagaagaacgggugauccuugccggcccuaugcccgugacccauuccucugcggcucagagacgcgggcgggucggcagaaacccuaagaaugaaaacgaccaguacauuuacaugggagagccccuggaaaaugaugaggacugcgcccacuggaaagaggccaagaugcuccuggacaacaucaauacaccggaaggcaucauuccuagcauguucgagcccgaacgcgagaaaguggaugcuaucgacggggaauauagacugcggggagaggcccgcaagaccuuuguugaucucaugagacggggcgaccuuccuguguggcuggcguaccgcgucgccgcugaggggauuaacuaugccgauagacggugguguuucgacggagugaaaaacaaucaaauccuggaagagaacguugaaguggagauuuggacgaaggagggcgaaagaaagaaacucaagccccgcuggcuggaugcucggaucuacuccgacccucuugcccugaaagaguucaaggaauuugcugccgggagaaaaucucucacccugaaucugauuacagagaugggccgccuccccaccuucaugacacagaaggcgcggaacgcccuugauaaucuggcuguccugcauaccgccgaagcuggaggcagagccuauaaccacgcccucagcgagcugccggagacacuugaaacccugcuccugcugacgcuccuugcuacagugaccgggggaaucuuucuguuccugauguccggcaagggggucggaaaaaugacccucggcaugugcugcaucauuacagcgagcauccugcuuugguacgcccagauucagccucacuggaucgcugccucuauuauccuggaguuuuuccucaucgugcugcugauucccgaacccgagaagcaacggaccccucaggacaaucagcucacauauguugugaucgccauucuuacgguggucgcugccaccauggcgaacgaaaugggcuuucuggagaaaacaaagaaagauuucgggcugggauccaucaccacacagcaaccggagagcaauauucucgacaucgaucugcgccccgccuccgcuuggacccuuuacgccguugcuacgaccuuuaucacaccuaugcugagacauucuauugaaaacagcuccgugaaugugucucucaccgccaucgcgaaccaggccacaguccugaugggccuggggaagggauggccccucagcaagauggacauuggcgugccucuucuggcuaucggguguuacucccagguuaaucccauuacccugacggccgcucuccugcuucugguggcccacuaugcuaucauuggaccuggccuccaggccaaagcgacacgggaggcccaaaagcgcgcugccgcuggcaucaugaaaaacccgaccgucgacgggaucacagugauugaucuggaccccaucccuuacgaucccaaguucgaaaaacagcugggacaggucaugcuccuugugcugugcguuacccaggugcugaugaugagaaccacaugggcccucugugaggcccugacgcuugcgaccggcccuauuagcacacugugggaagggaaucccggacgguuuuggaacaccacaaucgcugucucuauggccaauauuuuccgcggcuccuaucucgcuggggccggacugcuguuuagcaucaugaagaacaccgccaacacgagacggggcacaggcaauaccggggagacccucggagagaaguggaaaaaccgccuuaaugcucugggcaagucugaguuccaaaucuacaaaaaguccgggauucaggagguggacagaacacuggccaaagaaggaaucaagcggggcgagaccgaucaucacgcgguuagcagagggucugccaaacuccgcugguucguggagcggaaccuggucacaccggaaggaaaggugguggaccuuggcugcggcagagggggauggagcuauuacuguggcgggcugaagaauguuaaagaggucaagggacucacgaaaggcgggccuggacaugaggaacccauucccauguccaccuauggcuggaaccuggugcgccugcagucuggcguggaugucuuuuucacaccucccgaaaagugcgacacccuccuuugugauaucggggagagcuccccuaauccgacaguugaggcuggacggacccugagagugcugaaccucguggaaaauuggcugaacaauaacacgcaauuuugcauuaaaguccuuaaucccuacaugccuagcgugaucgagaagauggaagcccugcagcgcaaguacggcggggcucucguucggaacccccuguccagaaauucuacccacgagauguauugggugagcaacgccuccggaaacaucgucucuagcgugaauaugauuucccgcaugcugaucaaccgguucacaaugagacacaaaaaggcgaccuacgaaccugacguugaucucggcucugggacacgcaauauuggaaucgagagcgagacccccaaccuugacauuaucggcaaacggaucgaaaagauuaaacaggagcaugaaacauccuggcacuaugaucaggaccauccguacaagaccugggccuaucacggcagcuacgagacgaagcaaacagggucugcuuccagcauggugaauggagucgugagacugcugaccaaaccuugggacgugauccccauggucacccagauggccaugacagauacgaccccuuuuggccagcagcgcguuuucaaggaaaaaguggacacaagaacccaagagcccaaggaggggaccaaaaagcucaugaagauuaccgcugaauggcuguggaaagagcuuggaaagaaaaagacaccucggauguguacccgcgaagaguuuacgagaaaagugcggucuaacgccgcucugggcgccaucuucaccgaugagaauaaguggaaauccgcgagagaagccgucgaggacagcggguuuugggaacucguggauaaggagcggaaccugcaccuggaaggaaagugcgagacauguguuuauaauaugaugggcaaacgcgagaagaaacucggcgaguucgggaaggcuaaaggaucuagagccauuugguacauguggcugggcgcucgguuucuugaguucgaagcccugggguuucucaacgaggaccauugguucucccgcgaaaauagccuguccggaguggagggcgaggggcuucacaagcugggcuacauccucagagaugucagcaagaaagaaggaggcgccauguaugcggacgauaccgcugggugggacacacggauuacccuggaggaucugaagaacgaagagauggugacgaaucauauggaaggagagcacaaaaagcucgccgaggccaucuucaaacugacauaccagaacaagguugugcgcguccagagacccaccccgcggggcacagugauggacaucauuucucgcagagaccagcgggggagcggacaaguugugaccuauggccuuaauacguuuaccaacauggaagcucagcugauccgccagauggagggggaaggcgucuucaaguccauucaacagcucacagugaccgaggagaucgccgucaaaaacuggcuggugacaguuggaagagaacggcuuucucgcauggcuauuagcggcgaugacugcguggucaagccucuggaugacagauuugccuccgcgcucaccgcccugaaugauauggggaaagugcggaaggacauccagcagugggagcccucuagaggauggaacgauuggacacaagugcccuucugcagccaucacuuucacgaacugaucaugaaagacggccgcguucucguggucccuugucggaaucaggaugagcugauugggagagcucgcaucucccagggagccggcuggucucuucgggaaaccgcuugccugggaaagagcuacgcccagauguggucccucauguauuuccauagacgcgaccugcggcuugcggccaacgcuauuuguagcgccgugccgucucacuggguucccacguccagaacaaccuggagcauccaugcuacccacgaguggaugacaaccgaggauaugcugacaguguggaaucgcgucuggauucaagaaaacccuuggauggaggacaagacgcccguggaaucuugggaggaaaucccuuaccucggcaaacgggaggaucaguggugcggaucccugaucggccugaccagcagagccacaugggcuaagaauauucagaccgccaucaaccagguccgcucccucauugggaaugaggaauauacagacuacaugcccucuaugaaacgguuuagacgggaggaagaggaagcgggagugcugugguga

SEQ ID NO: 20212 - RNA, 9876 nt, Artificial Sequence
  derived and/or modified CDS sequence (opt5) from DENV-2__KC762661__SS-prME
acagccggcaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggaagcagaucacaccggagcugaaucauauucucagcgagaacgaagugaaacugaccaucaugacaggagacaucaagggcauuaugcaggcugggaaacggucccugagaccucagcccaccgagcuuaaguacagcuggaaaacguggggaaaggccaagaugcucucuaccgaacugcacaaucauacauuccugaucgauggcccugagaccgcggaaugccccaacgccaaucgcgcuuggaacucccucgagguugaggacuauggguuuggaguguucacaaccaauauuuggcugaaacuuaaggaacggcaagaugccuuuugugacagcaaacugaugucugcugccaucaaggacaacagagcgguccacgccgauaugggcuacuggauugaguccgcucucaacgacacauggaaaaucgaaaaggccagcuucaucgaggugaagucuugccacuggccuaaaagccauacccugugguccaauggcgugcuggagagcgaaaugauuauccccaagaacuucgcugggccggucucucagcacaauuaucgcccuggauaccagacgcagacagccggccccuggcaucuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgcuggacacggccaaauugauaauuuuagccuggggguucugggaauggcgcuuuuccucgaggaaaugcugcgcacacgggugggcaccaagcaugccauccugcucgucgcuguguccuuuguuacgcugauuaccgggaacaugucuuucagagaccuuggacgcgugauggucauggugggcgccacaaugaccgaugacaucggcauggggguuacauaccuggcccuccuggcugccuuuaaggugagaccuaccuucgcggcuggacugcuucugcggaaacucacgagcaaggagcugaugaugacaaccaucggcauuacacuccugucccagucuaccauccccgagaccauucuugaacugacagaugcccucgcccuggggaugaugguccugaaaaucgugcgcaauauggagaaguaucagcuugcugugacgauuauggccauccugugcgucccuaacgcgguuauccuccaaaaugcuuggaaagugagcuguaccacacuggccguggucuccgugagcccccuccugcuuaccucuucccagcagaaggccgacuggauuccucuggcucucacaaucaagggacugaaccccaccgccauuuuucugacgacacuuagcagaaccucuaaaaagcgguccuggccgcugaaugaagcuaucauggccguuggcauggugagcauucucgcgucuucccugcucaaaaacgauaucccuaugaccgggccccuggucgccggaggccuucugacagugugcuacguucugaccggccgcagcgcugaccucgagcuggaaagagccgcugacgugcggugggaggagcaggccgaaaucuccgggagcucuccuauucuuagcaucacaauuuccgaggauggaucuaugagcaucaagaaugaagaggaggaacaaacgcugaccauucucauccgcacaggccugcucgucauuuccgggcuguuccccgugucuaucccgaucaccgccgcugcgugguaucuuugggaggucaaaaagcagagagccggagugcugugggacguuccuucucccccucccgugggcaaagcugaacuggaggauggggccuaccggauuaagcagaagggaauccucggcuauucccagauuggcgccggggucuacaaagaaggaacauuucacaccauguggcacgugacgcgcggcgcuguucugaugcauaaggggaaaagaaucgagcccuccugggccgacgugaagaaagaucuuauuagcuacggaggcggguggaagcuggagggagaauggaaggagggcgaagagguccaagugcucgcgcuggaaccuggcaaaaacccgcgggcugugcagaccaagcccggacucuucaaaacauccaccggaacaaucggcgccguuagccuggacuuuucuccugggaccuccggaagccccaucgucgauaagaaaggcaaggugguggggcuuuauggaaacggcgucgugacaagaucuggcacguacguuuccgccauugcucagaccgaaaagagcaucgaggacaauccugaaauugaggaugacaucuuccgcaaaaagcggcugacaauuauggaucugcaccccggggccggaaaaaccaagagauaucucccugcgaucgugcgcgaagcuaucaaacggggccugagaacccuuauucuggccccgacacgcgucguggccgcugagauggaagaggcccuccgggggcugcccaucagauaccagacgccugcuauucgcgccgagcauaccggacgggaaaucguugaccucaugugucacgcgacauucaccaugagacugcuuucccccauucgggugccuaacuauaaucugaucauuauggaugaggcccauuuuacagaccccgcuucuaucgccgcucgcggcuacaucagcaccagagucgaaaugggggaggccgccggcauuuucaugacggcuacaccgccuggaucccgggaccccuuuccccaaagcaacgcgccuaucauggaugaggaacgcgagauucccgaaagaucuuggaauagcggccacgagugggugaccgacuucaaggggaagaccguuugguuugugccuagcaucaaagccggaaacgauauugcugccugccugcggaagaauggcaaaaaggucauccagcucucuagaaaaacauucgacuuugaauauaucaagacccgcacaaacgauugggacuucguggugaccacggauauuagcgagaugggggccaauuuuaaggcugagcgggucaucgacccgagacgcuguaugaaacccguuauucugacagauggagaagaacgggugauccuugccggcccuaugcccgugacccacuccucugcggcucagagacgcgggcgggucggcagaaacccuaagaaugaaaacgaccaauacauuuacaugggagagccccuggaaaaugaugaggacugcgcccauuggaaagaggccaagaugcuccuggacaacaucaauacaccggaaggcaucauuccuagcauguucgagcccgaacgcgagaaaguggaugcuaucgacggggaauauagacugcggggagaggcccgcaagaccuuuguugaucucaugagacggggcgaccuuccuguguggcuggcguaccgcgucgccgcugaggggauuaacuaugccgauagacggugguguuucgacggagugaaaaacaaucagauccuggaagagaacguugaaguggagauuuggacgaaggagggcgaaagaaagaaacucaagccccgcuggcuggaugcucggaucuacuccgacccucuugcccugaaagaguucaaggaauuugcugccgggagaaaaucucucacccugaaucugauuacagagaugggccgccuccccaccuucaugacacagaaggcgcggaacgcccuugauaaucuggcuguccugcacaccgccgaagcuggaggcagagccuauaaccaugcccucagcgagcugccggagacacuugaaacccugcuccugcugacgcuccuugcuacagugaccgggggaaucuuucuguuccugauguccggcaaggggaucggaaaaaugacccucggcaugugcugcauuaucacagcgagcauucugcuuugguacgcccagauccaaccucacuggauugcugccucuaucauccuggaguuuuuccucauuguccugcugauccccgaacccgagaagcagcggaccccucaggacaaucagcucacauaugugguuauugccauccuuacggugguggcugccaccauggcgaacgaaaugggcuuucuggagaaaacaaagaaagauuucgggcugggauccauuaccacacaacagccggagagcaauauccucgacaucgaucugcgccccgccuccgcuuggacccuuuacgccgucgcuacgaccuuuauuacaccuaugcugagacacucuaucgaaaacagcuccguuaaugugucucucaccgccauugcgaaccaggccacagugcugaugggccuggggaagggauggccccucagcaagauggacaucggcgucccucuucuggcuauuggguguuacucccaggugaaucccaucacccugacggccgcucuccugcuucugguugcccauuaugcuauuaucggaccuggccuccaagccaaagcgacacgggaggcccagaagcgcgcugccgcuggcaucaugaaaaacccgaccguggacgggauuacagucaucgaucuggaccccauuccuuacgaucccaaguucgaaaaacagcugggacaggugaugcuccuuguccugugcgugacccaaguucugaugaugagaaccacaugggcccucugugaggcccugacgcuugcgaccggcccuaucagcacacugugggaagggaaucccggacgguuuuggaacaccacaauugcugugucuauggccaauaucuuccgcggcuccuaucucgcuggggccggacugcuguuuagcaucaugaagaacaccgccaacacgagacggggcacaggcaauaccggggagacccucggagagaaguggaaaaaccgccuuaaugcucugggcaagucugaguuccagauuuacaaaaaguccgggauccaggaggucgacagaacacuggccaaagaaggaauuaagcggggcgagaccgaucaccaugcggugagcagagggucugccaaacuccgcugguucguugagcggaaccuggugacaccggaaggaaaggucguggaccuuggcugcggcagagggggauggagcuauuacuguggcgggcugaagaaugugaaagagguuaagggacucacgaaaggcgggccuggacacgaggaacccauccccauguccaccuauggcuggaaccugguccgccugcaaucuggcguggauguguuuuucacaccucccgaaaagugcgacacccuccuuugugauauuggggagagcuccccuaauccgacagucgaggcuggacggacccugagaguucugaaccucguggaaaauuggcugaacaauaacacgcaguuuugcaucaaagugcuuaaucccuacaugccuagcgucaucgagaagauggaagcccugcagcgcaaguacggcggggcucucgugcggaacccccuguccagaaauucuacccaugagauguauuggguuagcaacgccuccggaaacauugugucuagcgucaauaugaucucccgcaugcugauuaaccgguucacaaugagacacaaaaaggcgaccuacgaaccugacguggaucucggcucugggacacgcaauaucggaauugagagcgagacccccaaccuugacaucaucggcaaacggauugaaaagaucaaacaggagcacgaaacauccuggcauuaugaucaagaccacccguacaagaccugggccuaucauggcagcuacgagacgaagcagacagggucugcuuccagcaugguuaauggaguggucagacugcugaccaaaccuugggacgugauucccauggugacccagauggccaugacagauacgaccccuuuuggccagcaacgcgucuucaaggaaaaaguugacacaagaacccaggagcccaaggaggggaccaaaaagcucaugaagaucaccgcugaauggcuguggaaagagcuuggaaagaaaaagacaccucggauguguacccgcgaagaguuuacgagaaaagugcggucuaacgccgcucugggcgccauuuucaccgaugagaauaaguggaaauccgcgagagaagccguggaggacagcggguuuugggaacucgucgauaaggagcggaaccugcaccuggaaggaaagugcgagacauguguguauaauaugaugggcaaacgcgagaagaaacucggcgaguucgggaaggcuaaaggaucuagagccaucugguacauguggcugggcgcucgguuucuugaguucgaagcccugggguuucucaacgaggaccacugguucucccgcgaaaauagccuguccggaguugagggcgaggggcuucauaagcugggcuacauucucagagaugugagcaagaaagaaggaggcgccauguaugcggacgauaccgcugggugggacacacggaucacccuggaggaucugaagaacgaagagauggucacgaaucacauggaaggagagcauaaaaagcucgccgaggccaucuucaaacugacauaccagaacaaggugguucgcgugcagagacccaccccgcggggcacagucauggacauuaucucucgcagagaccaacgggggagcggacaggugguuaccuauggccuuaauacguuuaccaacauggaagcucagcugauucgccaaauggagggggaaggcguguucaaguccauccagcagcucacagucaccgaggagauugccgugaaaaacuggcuggucagagugggacgggaacgccuuucuagaauggcuaucagcggcgaugacugcguugugaagccucuggaugaccgguuugccuccgcgcucacagcccugaaugauauggggaaagucagaaaggacauccagcaaugggagcccucucgcggauggaacgauuggacccaggugcccuucugcagccaccauuuucacgaacugauuaugaaagacggccgggugcucguugugccuuguagaaaucaggaugagcugaucgggcgcgcucggauuucccagggagccggcuggucucuuagagaaacagcuugccugggaaagagcuacgcccaaauguggucccucauguauuuccaccgccgggaccugagacuugcggccaacgcuaucuguagcgccgucccgucucauugggugcccaccucccgcacgacauggagcauucacgcuacccaugaguggaugaccacagaggauaugcugaccguuuggaaucggguguggauccaggaaaacccuuggauggaggacaagacacccgucgaaucuugggaggaaaucccuuaccucggcaaaagagaggaucaguggugcggaucccugauuggccugacgagccgcgccaccugggcuaagaauauccagacagccauuaaccaagugcggucccucaucgggaaugaggaauauaccgacuacaugcccucuaugaaaagauuucggagagaggaagaggaagcgggaguccugugguga

SEQ ID NO: 20213 - RNA, 9876 nt, Artificial Sequence
  derived and/or modified CDS sequence (opt5) from DENV-2__KC762655__SS-prME
acagccggaaucauuaucaugaugauucccacagugauggcuuuccaccugacgaccagaaacggggaaccucauaugaucgucagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagguggugcagccugaaaaccuggaguauaccauugucaucacaccccacucuggcgaagagaaugcgguggggaacgauaccggaaaacauggcaaggagauuaaaguuacaccucaguccagcaucaccgaagccgagcucacgggcuacgggaccgugacaauggaauguucuccccggaccggacuggacuucaaugagaugguccuucugcagauggaaaacaaggcuuggcucgugcaccgccaaugguuucuggaucuuccgcugccuuggcuccccggcgccgacacacagggguccaacuggauccagaaagagacccugguuacguucaagaauccucacgcuaagaaacaggauguggucgugcugggaagccaagagggcgccaugcauacagcccucaccggggcuacagaaauucagauguccucuggcaaccugcuuuuuaccggacaccugaagugcagacuccggauggacaaacugcagcuuaagggcaugagcuauuccauguguaccgggaaauucaaggucgugaaggagaucgcggaaacacaacauggaacgauuguuaucagagugcaguacgagggcgacgggagccccugcaaaauucccuucgagaucauggaucuggaaaagcgccacguccucggacggcugaucaccgugaauccuauuguuacagagaaagacucuccggugaacaucgaagccgagcccccuuuuggcgauuccuacauuaucauuggggucgaacccggccagcugaagcucagcugguucaaaaagggaucuagcaucggccagauguuugagaccacaaugagaggggcuaagcgcauggccauucugggagacaccgccugggauuucggcucccuugggggaguguuuacgucuaucggcaaagcucugcaucaaguguucggggccguuuauggcgcggcuuuuagcggagucuccuggacaaugaagauccucauuggcguggugaucaccuggauugggaugaauagccggucuaccucccugagcgucucucuggugcuuguuggaguggucacacucuaccugggcgugaugguucaggccgacuccggguguguggucagcuggaaaaacaaggagcugaaaugcggauccggcaucuucauuaccgauaaugugcacacauggacggaacaguauaaguuucagccugagucucccagcaagcucgccuccgcuauccaaaaagcccacgaagaggggaucuguggcauuagaucuguuacccgccuggaaaaccuuauguggaagcagaucacaccggagcugaaucauauucucagcgagaacgaagugaaacugaccaucaugacaggagacauuaagggcaucaugcaggcugggaaacggucccugagaccucagcccaccgagcuuaaguacagcuggaaagccuggggaaaggcgaagaugcucucuacggaacugcacaaucauaccuuccugaucgauggcccugagacagccgaaugccccaacaccaaucgcgcuuggaacucccucgaggucgaggacuauggguuuggaguguucacaaccaauauuuggcugaaacuuaaggaacggcaagauguguuuugugacagcaaacugaugucugccgcuaucaaggacaacaaagccguccacgcggauaugggcuacuggauugaguccgcccucaacgacacauggaagaucgaaaaggcuagcuucauugagguuaaaucuugccacuggccuaagagccauacccugugguccaauggcgugcuggagagcgaaaugaucauccccaaaaacuucgccgggccggugucucagcacaauuauagaccuggauaccauacgcagacagcuggccccuggcaccuugggcgccucgagauggauuuugacuucugugaaggaaccaccgucgugguuacagaggauugcggcaaccgggggcccucccugagaaccacgacagccagcggaaagcugauuaccgaauggugcugucgguccugcacacucccuccgcugcgcuacagaggcgaggacggcuguugguaugggauggagauccggccccuuaaagaaaaggaggaaaaucuggugaacucucucgucaccgccggacauggccagauugauaauuuuagccugggggugcugggaauggcucuuuuccucgaggaaaugcugagaacacgcguuggcaccaagcacgcgauccugcucguggccgucuccuuugugacgcugauuaccgggaacaugucuuuccgggaccuuggaagaguuauggugauggucggcgcuacaaugaccgaugacaucggcaugggggugacauaccuggcccuccuggccgcuuuuaaagugcgcccuaccuucgccgcgggacugcuucugagaaagcucacgagcaaagagcugaugaugacaaccauuggcaucguccuccugucccaaucuacaauccccgagaccauucuugaacugaccgaugcucucgcccuggggaugaugguucugaagaucgugcggaauauggagaaauaucagcuugccgugacaauuauggcuauccugugcgucccuaacgccgugauucuccagaaugcguggaagguuagcuguacgacccuggcuguggucuccgugagcccccuccugcuuacaucuucccaacagaaggccgacuggaucccucuggcccucaccaucaaaggacugaaccccacagcuauuuuucugaccacgcuuagccgcacaucuaagaaaagauccuggccgcugaaugaagccaucauggcuguuggcauggugagcauucucgccucuucccugcucaagaacgauaucccuaugaccgggccccuggucgcgggaggccuucugaccgugugcuacguccugacaggccggagcgccgaccucgagcuggaacgcgcugccgacgugagaugggaggagcaggcugaaauuuccgggagcucuccuauccuuagcaucaccauuuccgaggauggaucuaugagcaucaaaaaugaagaggaggaacagacacugacgauucucauccggaccggccugcucguuauuuccgggcuguuccccgugucuaucccgauuacagccaccgccugguaucuuugggaggucaagaaacaacgcgcuggagugcugugggacguuccuucucccccucccgugggcaaggcggaacuggaggauggggccuacagaaucaagcagaaaggaauccucggcuauucccagauuggcgcuggggucuacaaggaaggaacauuucacaccauguggcaugugacgcggggcgccgugcugaugcacaaagggaagcgcaucgagcccuccugggccgacguuaaaaaggaucuuauuagcuacggaggcggguggaagcuggagggagaauggaaagagggcgaagagguccaggugcucgcucuggaaccuggcaagaacccgagagccgugcaaaccaaacccggacucuucaagacaaacaccggaacaaucggcgcggucucccuggacuuuagcccugggaccucuggaucccccauuguggauaaaaagggcaagguuguggggcuuuauggaaauggcgucgugacacggagcggcacguacguuucugcuaucgcccagaccgagaaauccaucgaggacaacccugaaauugaggaugacaucuucagaaagaaacgccugacaauuauggaucugcaucccggggccggaaagaccaaacgguaucucccugcuaucgugagagaagccauuaagcgcggccugcggacccuuauccuggcgccgacaagagucguggcugccgagauggaagaggcccuccgcgggcugcccauccgguaccagacgccugcuauuagagccgagcacaccggacgcgaaaucguugaccucaugugucaugcuacauucaccaugcggcugcuuagccccauuagagugccuaauuauaaccugaucauuauggaugaggcccacuuuacagaccccgcguccaucgccgcucggggcuacauuucuacccgcgucgaaaugggggaggccgcuggcaucuucaugacggccacaccgccuggaagcagagaccccuuuccccaguccaaugccccuaucauggaugaggaacgggagauucccgaacgcagcuggaacucuggccacgagugggugaccgacuucaaggggaaaaccgugugguuugucccuuccaucaaggcuggaaaugauauugcggccugccugcgcaaaaacggcaagaaaguuauccaacucagccggaagacauucgacuuugaauauauuaagaccagaacaaaugauugggacuucguggugaccacggauaucucugagaugggggcuaacuuuaaagccgagcgcgucaucgacccgcggagauguaugaagcccgugauucugacagauggagaagaaagaguuauccuugccggcccuaugcccgugacccauagcuccgcugcccagcggagagggcgcgucggccggaauccuaaaaacgaaaaugaccaguacauuuacaugggagagccccuggaaaacgaugaggacugcgcgcacuggaaggaggcuaaaaugcuccuggacaauaucaacacaccggaaggcauuaucccuucuauguucgagcccgaaagagagaagguggaugccaucgacggggaauaucgccugagaggagaggcccggaaaaccuuuguugaucucaugcgcagaggcgaccuuccuguguggcuggcuuaccgggucgccgcggaggggauuaacuaugccgaucgcagaugguguuucgacggagugaagaauaaccaaauccuggaagagaaugucgaaguggagauuuggacgaaggagggcgaacggaaaaagcucaaacccagauggcuggaugcucgcaucuacagcgacccucuugcccugaaggaguucaaagaauuugcugccgggcggaagucccucacccugaaccugauuacagagaugggcagacuccccaccuucaugacacagaaggcucgcaaugcccuugauaaccuggcgguucugcauaccgccgaagcuggaggccgggccuauaaucacgcucucucugagcugccggagacacuugaaacccugcuccugcugacgcuccuugccacagugaccgggggaaucuuucuguuccugaugagcggcaaagggauuggaaagaugacccucggcaugugcugcaucaucacagccuccauucugcuuugguacgcucagauccagccucacuggauugcggccagcaucauucuggaguuuuuccucaucgugcugcugauccccgaacccgagaaacaaagaaccccucaggacaaccagcucacauaugucguuauugcuauccuuacggugguggccgccaccauggcuaaugaaaugggcuuucuggagaagaccaaaaaggauuucgggcugggaucuauugccacccagcaaccggaguccaacauccucgacauugaucugcggcccgcgagcgccuggacacuuuacgcugucgccaccacguuuaucaccccuaugcugcgccauuccaucgaaaauucuagcgugaacguuucccucacagcuauugccaaucaggcgaccgugcugaugggccuggggaagggauggccccucucuaaaauggacaucggcgucccucuucuggccauuggguguuacagccaggugaaccccaucacacugaccgcugcccuccugcuucuggucgcucacuaugccauuaucggaccuggccuccaggcuaaggccacgagagaggcgcaaaaacgggccgcugccggcauuaugaagaauccgacaguggacgggaucaccguuaucgaucuggaccccauuccuuacgaucccaaauucgaaaagcagcugggacaggugaugcuccuuguccugugcgugacacagguucugaugaugcgcaccaccugggcucucugugaggcccugacacuugccacgggcccuaucuccacccugugggaagggaaccccggaagauuuuggaauacaaccauugcggugagcauggcuaacaucuuccggggcucuuaucucgccggggcuggacugcuguuuuccauuaugaagaacacagccaauacccgcagaggcacgggcaacacaggggagacccucggagagaaauggaagaaucggcuuaacgcccugggcaaaagcgaguuccaaaucuacaagaaaucugggauccaggaggucgaccgcacccuggcuaaggaaggaauuaaaagaggcgagacagaucaucacgccgugucccgggggagcgcgaagcucagaugguucguggagcgcaaucugguuaccccggaaggaaaggucguggaccuuggcugcggcagaggcggguggucuuauuacuguggagggcugaaaaacgugaaggaggucaaagggcucacaaagggcgggccuggacaugaagaacccauccccaugagcacguauggcuggaaucugguuagacugcaguccggcguggauguguuuuucaccccucccgaaaaaugcgacacacuccuuugugauauuggggagucuagcccuaacccgaccgucgaggccggacgcacacugcgggugcugaaucucguugaaaacuggcugaauaacaauacccaauuuugcaucaaggugcuuaaccccuacaugccuuccgucauugagaagauggaagcucugcagagaaaauacggcggggcccucgugcgcaauccccugagccggaacuccacgcacgagauguauuggguuucuaacgcuagcggaaauaucguguccucugucaacaugaucagcagaaugcugauuaaucgcuucaccaugcggcacaagaaagccacauacgaaccugacguggaucucggcuccgggaccagaaacaucggaauugagucugagacacccaaucuugacaucauuggcaagcgcaucgagaaaaucaagcaggagcaugaaaccagcuggcacuaugaucaggaccauccguacaagacaugggcguaucacggcuccuacgagaccaaacaaacggggagcgccucuuccauggugaacggagucguucggcugcugacaaagccuugggacgugauucccauggugacccagauggcuaugaccgauacaacgccuuuuggccagcagagagucuucaaagaaaagguggacacccgcacacaagagcccaaagaggggaccaagaagcucaugaaaaucacagccgaauggcuguggaaggagcuuggcaaaaagaaaaccccuagaauguguacacgggaagaguuuacccgcaagguuagaagcaaugcugcccugggcgcuauuuucacggaugagaacaaauggaagucugcccgggaagcgguggaggacuccggguuuugggaacucgucgauaaggagagaagccugcaccuggaaggaaaaugcgagaccuguguguauaauaugaugggcaagcgggagaaaaagcucggcgaguucgggaaagccaagggaucucgcgcuaucugguacauguggcugggcgccagauuucuugaguucgaagcucugggguuucucaacgaggaccauugguucucccgggaaaauagccuguccggaguugagggcgaggggcuucacaagcugggcuacauucuccgcgaugugagcaaaaaggaaggaggcgccauguaugccgacgauacagcggggugggacaccagaaucacacuggaggaucugaaaaacgaagagauggucaccaaucauauggaaggagagcacaagaaacucgcugaggccauuuucaagcugacguaccagaacaaggugguucgggugcagcgccccacaccgagaggcaucgucauggacaucauuucucggcgcgaccagagagggagcggacaaguggucaccuauggccuuaauacauuuaccaacauggaagcccagcugauccggcagauggagggggaaggcguguucaaauccauucaacagcucacgguuaccgaggagaucgcugugaagaacuggcuggcccgcgucggaagagaacggcuuucucgcauggcuauuagcggcgaugacugcguggugaaaccucuggaugacagauuugccuccgcgcucacagcccugaaugauauggggaagguucggaaagacauccagcagugggagcccucuagaggauggaacgauuggacccaagugcccuucugcagccaucacuuucacgaacugaucaugaaggacggccgcguccucgugguuccuugucggaaucaggaugagcugauugggagagcucgcaucucccagggagccggcuggucucuucgggaaacagcuugccugggaaagagcuacgcccagauguggucccucauguauuuccauagacgcgaccugcggcuugcggccaacgcuauuuguagcgccgugccgucucacuggguccccaccuccagaacaaccuggagcauccaugcuacgcacgaguggaugacaaccgaggauaugcugaccguguggaaucgcgucuggauucaagaaaacccuuggauggaggacaaaacacccguggaaucuugggaggaaaucccuuaccucggcaagcgggaggaucaguggugcggaucccugaucggccugaccagcagagccacaugggcucgcaauauucagacggccaucaaccagguucggucccucauugggaaugaggaauauaccgacuacaugcccucuaugaaaagauuucggagagaggaagaggaagcgggagugcugugguga

SEQ ID NO: 20214 - RNA, 9876 nt, Artificial Sequence
  derived and/or modified CDS sequence (opt5) from DENV-2__KC762656__SS-prME
acagccggcaucauuaucaugaugauucccacagugauggcuuuccaccugacgaccagaaacggggagccucauaugaucgucagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagagccgaaaccuggaugucuagcgagggcgccuggaagcacgcucagcggaucgagacguggguucugcgccaucccggcuucacaauuauggccgcuauccuggccuacaccauugggacaaccuauuuucagagagugcucaucuucauucugcuuaccgcggucacaccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucgggacgaucuauggcgcggcuuuuagcggaguuuccuggacaaugaagauucucaucggcgucgugauuaccuggaucgggaugaauagccggucuaccucccugagcgugucucugguccuugugggaguugugacacucuaccugggcgucauggugcaggccgacuccggguguguugugagcuggaaaaacaaggagcugaaaugcggauccggcauuuucaucaccgauaauguccacacauggacggaacaguauaaguuucagccugagucucccagcaagcucgccuccgcuauccaaaaagcccacgaagaggggauuuguggcaucagaucugugacccgccuggaaaaccuuauguggaagcagauuacaccggagcugaaucauauccucagcgagaacgaaguuaaacugaccauuaugacaggagacaucaagggcaucaugcaggcugggaaacggucccugagaccucagcccaccgagcuuaaguacagcuggaaagccuggggaaaggcgaagaugcucucuacggaacugcacaaucauaccuuccugauugauggcccugagacagccgaaugccccaacaccaaucgcgcuuggaacucccucgagguggaggacuauggguuuggagucuucacaaccaauaucuggcugaaacuuaaggaacggcaagauguguuuugugacagcaaacugaugucugccgcuauuaaggacaacagagccgugcacgcggauaugggcuacuggaucgaguccgcccucaacgacacauggaaaauugaaaaggcuagcuucaucgaggucaagucuugccaguggccuaaaagccacacccugugguccaauggcguucuggagagcgaaaugaucauucccaagaacuucgccgggccggugucucagcauaauuaucgcccuggauaccacacgcagacagcuggccccuggcaucuugggcggcucgagauggauuuugacuucugugaaggaaccaccguggucgugacagaggauugcggcaacagagggcccucccugcggaccacgacagccagcggaaaacugaucaccgaauggugcugucgcuccugcacacucccuccgcugagauaccggggcgaggacggcuguugguaugggauggagauuagaccccuuaaggaaaaagaggaaaaucugguuaacucucucgugaccgccggacacggccaaaucgauaauuuuagccuggggguccugggaauggcucuuuuccucgaggaaaugcugcgcacacgggugggcaccaagcaugcgauucugcucguugccguguccuuugucacgcugaucaccgggaacaugucuuucagagaccuuggacgcgugaugguuauggugggcgcuacaaugaccgaugacauuggcaugggggucacauaccuggcccuccuggccgcuuuuaaggugagaccuaccuucgccgcgggacugcuucugcggaaacucacgagcaaggagcugaugaugacaaccaucggcaucgugcuccugucccagucuacaauucccgagaccauccuugaacugaccgaugcucucgcccuggggaugaugguccugaaaauuguucgcaauauggagaaguaucagcuugccgugacaaucauggcuauucugugcgugccuaacgccgucauccuccaaaaugcguggaaagugagcuguacgacccuggcuguuguguccgucagcccccuccugcuuacaucuucccagcagaaggccgacuggaucccucuggcccucaccauuaagggacugaaccccacagcuaucuuucugaccacgcuuagcagaacaucuaaaaagcgguccuggccgcugaaugaagccauuauggcugugggcaugguuagcauccucgccucuucccugcucaaaaacgauauuccuaugaccgggccccugguggcgggaggccuucugaccgucugcuacgugcugacaggccgcagcgccgaccucgagcuggaaagagcugccgacguccggugggaggagcaggcugaaaucuccgggagcucuccuauccuuagcauuaccaucuccgaggauggaucuaugagcauuaagaaugaagaggaggaacaaacacugacgauccucauucgcaccggccugcucgugguuuccgggcuguuccccgugucuaucccgauuacagccgccgcuugguaucuuugggaggucaaaaagcagagagcgggagugcugugggacguuccuucucccccucccgugggcaaagccgaacuggaggauggggcuuaccggaucaagcagaagggaauccucggcuauucccagauuggcgccggggucuacaaagaaggaaccuuucacacaauguggcacgugacccgcggcgccgugcugaugcauaaggggaaaagaaucgagcccuccugggcugacguuaagaaagaucuuauuagcuacggaggcggguggaagcuggagggagaauggaaggagggcgaagagguccaagugcucgcccuggaaccuggcaaaaacccgcgggcggugcagacgaagcccggacucuucaaaaccaacacaggaaccaucggcgcugucucccuggacuuuagcccugggacaucuggaucccccauuguggauaagaaaggcaagguuguggggcuuuauggaaauggcgucgugaccagaagcggcacauacguuucugccaucgcccagacggagaaguccaucgaggacaacccugaaauugaggaugacaucuuccgcaaaaagcggcugaccauuauggaucugcaccccggggcuggaaaaacaaagagauaucucccugccaucgugcgcgaagcgauuaaacggggccugagaacccuuauccuggcuccgacccgcgucguggccgccgagauggaagaggcucuccgggggcugcccaucagauaccagaccccugccauucgcgcugagcauacgggacgggaaaucguugaccucaugugucacgccaccuucacaaugagacugcuuagccccauucgggugccuaauuauaaccugaucauuauggaugaggcgcauuuuaccgaccccgccuccaucgcugcccgcggcuacauuucuacaagagucgaaaugggggaggcugccggcaucuucaugaccgccacgccgccuggaagccgggaccccuuuccccaauccaaugcuccuaucauggaugaggaacgcgagauucccgaaagaagcuggaacucuggccacgagugggugacagacuucaaggggaagaccgugugguuugucccuuccaucaaagcgggaaaugauauugccgcuugccugcggaagaacggcaaaaagguuauccagcucagcagaaaaaccuucgacuuugaauauauuaagacacgcaccaaugauugggacuucguggugacaaccgauaucucugagaugggggccaacuuuaaggccgagcgggucaucgacccgagacgcuguaugaaacccgugauucugacggauggagaagaacggguuauccuugcuggcccuaugcccgugacacacagcuccgccgcgcagagacgcgggcgggucggcagaaauccuaagaacgaaaaugaccaauacauuuacaugggagagccccuggaaaacgaugaggacugcgcucauuggaaagaggccaagaugcuccuggacaauaucaacaccccggaaggcauuaucccuucuauguucgagcccgaacgcgagaaaguggaugccaucgacggggaauauagacugcggggagaggcucgcaagacauuuguugaucucaugagacggggcgaccuuccuguguggcuggccuaccgcgucgcggccgaggggauuaacuaugcugauagacggugguguuucgacggagugaaaaauaaccagauccuggaagagaaugucgaaguggagauuuggaccaaggagggcgaaagaaagaaacucaagccccgcuggcuggaugcccggaucuacagcgacccucuugcucugaaagaguucaaggaauuugccgcugggagaaaaucccucacgcugaaccugauuaccgagaugggccgccuccccacauucaugacccagaaggcccggaaugcgcuugauaaccuggccguucugcacacagcugaagccggaggcagagcuuauaaucaugcccucucugagcugccggagacccuugaaacacugcuccugcugacccuccuugccacggugacagggggaaucuuucuguuccugaugagcggcaaggggauuggaaaaaugacccucggcaugugcugcaucaucaccgcuuccauucugcuuugguacgcgcagauccaaccucacuggauugccgcuagcaucauucuggaguuuuuccucaucgugcugcugauccccgaacccgagaagcagcggacaccucaggacaaccagcucaccuaugucguuauugccauccuuacagugguggccgcuacgauggccaaugaaaugggcuuucuggagaaaaccaagaaagauuucgggcugggaucuauugcgacacaacagccggaguccaacauccucgacauugaucugcgccccgccagcgcuuggacccuuuacgccgucgcuacaaccuuuaucacgccuaugcugagacacuccaucgaaaauucuagcgugaacguuucccucaccgccauugcgaaucaggccacagugcugaugggccuggggaagggauggccccucucuaagauggacaucggcgucccucuucuggcuauuggguguuacagccaggugaaccccaucacccugacagccgcucuccugcuucuggucgcccauuaugcuauuaucggaccuggccuccaagccaaagcgacccgggaggcccagaagcgcgcugccgcuggcauuaugaaaaauccgacgguggacgggaucacaguuaucgaucuggaccccauuccuuacgaucccaaguucgaaaaacagcugggacaggugaugcuccuuguccugugcgugacccaaguucugaugaugagaacaaccugggcccucugugaggcccugacccuugcgacaggcccuaucuccacgcugugggaagggaaccccggacgguuuuggaauaccacaauugcugugagcauggccaacaucuuccgcggcucuuaucucgcuggggccggacugcuguuuuccauuaugaagaacaccgccaauacaagacggggcaccggcaacacgggggagacacucggagagaaguggaaaaaucgccuuaacgcucugggcaagagcgaguuccagaucuacaaaaagucugggauccaggaggucgacagaacccuggccaaagaaggaauuaagcggggcgagaccgaucaccaugcgguguccagagggagcgccaaacuccgcugguucguggagcggaaucugguuacaccggaaggaaaggucguggaccuuggcugcggcagagggggauggucuuauuacuguggcgggcugaagaacgugaaagaggucaagggacucaccaaaggcgggccuggacacgaagaacccauccccaugagcacauauggcuggaaucugguucgccugcaauccggcguggauguguuuuucacgccucccgaaaagugcgacacccuccuuugugauauuggggagucuagcccuaacccgacagucgaggcuggacggacccugagagugcugaaucucguugaaaacuggcugaauaacaauacacaguuuugcaucaaagugcuuaaccccuacaugccuuccgucauugagaagauggaagcccugcagcgcaaguacggcggggcucucgugcggaauccccugagcagaaacuccacccaugagauguauuggguuucuaacgccagcggaaauaucguguccucugucaacaugaucagccgcaugcugauuaaucgguucacgaugagacacaaaaaggcgaccuacgaaccugacguggaucucggcuccgggacacgcaacaucggaauugagucugagacccccaaucuugacaucauuggcaaacggaucgaaaagaucaaacaggagcacgaaacaagcuggcauuaugaucaagaccacccguacaagaccugggccuaucauggcuccuacgagacaaagcagaccgggagcgcuucuuccauggugaacggagucguuagacugcugacgaaaccuugggacgugauucccauggugacacagauggccaugaccgauaccacaccuuuuggccagcaacgcgucuucaaggaaaaaguggacacgagaacccaggagcccaaggaggggaccaaaaagcucaugaagaucaccgcugaauggcuguggaaagagcuuggaaagaaaaagacaccucggauguguacccgcgaagaguuuacaagaaaaguucggagcaaugccgcucugggcgccauuuucaccgaugagaacaaguggaaaucugcgagagaagccguggaggacuccggguuuugggaacucgucgauaaggagcggaaucugcaccuggaaggaaagugcgagacguguguguauaacaugaugggcaaacgcgagaagaaacucggcgaguucgggaaggcuaaaggaagcagagccaucugguacauguggcugggcgcucgguuucuugaguucgaagcccugggguuucucaaugaggaccacugguucucucgcgaaaacucccugagcggaguugagggcgaggggcuucauaagcugggcuacauucucagagauguguccaagaaagaaggaggcgccauguaugcggacgauaccgcugggugggacacacggaucacccuggaggaucugaagaaugaagagauggucacaaaccacauggaaggagagcauaaaaagcucgccgaggccauuuucaaacugaccuaccagaauaaggugguucgcgugcagagacccacgccgcggggcacagucauggacaucaucagccgcagagaccaacgggggucuggacagguggucaccuauggccuuaacacauuuaccaacauggaagcucagcugauucgccaaauggagggggaaggcguguucaagagcauccagcagcucacgguuaccgaggagauugccgugaaaaauuggcuggucagagugggacgggaacgccuuuccagaauggcuaucucuggcgaugacugcgugguuaagccucuggaugaccgguuugccagcgcgcucacagcccugaacgauauggggaaagugagaaaggacauucagcaaugggagcccucccgcggauggaaugauuggacccagguccccuucugcucucaccauuuucacgaacugaucaugaaagacggccgggugcucguugugccuuguagaaaccaggaugagcugaucgggcgcgcucggauuagccagggagccggcuggucccuuagagaaacagcuugccuggggaagucuuacgcccaaauguggagccucauguauuuccaccgccgggaccugagacuugcggccaaugcuaucuguuccgccgucccgagccauugggugcccaccucucgcacaaccugguccauucacgcuacgcaugaguggaugacaaccgaggauaugcugaccgucuggaaccggguguggauccaggaaaauccuuggauggaggacaagacacccguugaaagcugggaggaaauuccuuaccucggcaaaagagaggaucaguggugcggaucucugaucggccugaccucccgcgccacaugggcuaagaacauccagacggccauuaaucaagugcggagccucaucgggaacgaggaauauaccgacuacaugcccuccaugaaaagauuucggagagaggaagaggaagcgggaguccugugguga

SEQ ID NO: 20215 - RNA, 9876 nt, Artificial Sequence
  derived and/or modified CDS sequence (opt5) from DENV-2__KC762673__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagauugugcagccugaaaaccuggaguacacgaucgugauuaccccccauucuggcgaagagaaugccgucgggaacgauacaggaaaacacggcaaggagaucaaagugaccccucaguccagcaucacagaagcugagcucaccggcuaugggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucaugccaagaaacaggauguugugguccugggaagccaagagggcgccaugcacacggcucucacaggggcgaccgaaauccagauguccucuggcaaccugcuuuuuacaggacaucugaagugcagacuccggauggacaaacugcagcuuaagggcaugagcuacuccauguguaccgggaaauucaagguggucaaggagauugccgaaacccaacacggaacaaucgugauuagaguucaguaugagggcgacgggagccccugcaaaauccccuucgagaucauggaucuggaaaagcgccaugugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaccaaguguucggggcgauuuacggcgcugccuuuagcggaguguccuggacgaugaagauccucauuggcguugucaucacauggauugggaugaauagccggucuaccccucuguccgugagccuggugcuugucggagugguuacccucuaucugggcgugaugguccaggccgacucugggugugugguuuccuggaaaaacaaggagcugaaaugcggaagcggcaucuucaucacagauaaugugcacaccuggacagaacaguacaaguuucagcccgaguccccgucuaagcucgcuagcgccauucaaaaagcucaugaagaggggaucuguggcauuagauccgucacgcgccuggaaaaccuuauguggaagcagaucaccccugagcugaaucacauucucucugagaacgaagugaaacugacaaucaugaccggagacaucaagggcauuaugcaggccgggaaacggagccugagaccccagccuacagagcuuaaguauuccuggaaaaccuggggaaaggcgaagaugcucagcacggaacugcauaaucacaccuuccugaucgauggccccgagacagccgaaugcccuaacaccaaucgcgcuuggaacucucucgagguugaggacuacggguuuggaguguucacaaccaauauuuggcugaaacuuaaggaacggcaagaugucuauugugacuccaaacugaugagcgccgcuaucaaggacaacagagccgugcacgcggauaugggcuacuggauugagucugcccucaacgacacauggaaaaucgaaaaggcuuccuuuaucgaggugaagagcugcuauuggcccaaaucucauacccuguggagcaauggcguccuggaguccgaaaugauuaucccgaagaacuucgccgggccuguuagccagcacaauuaccgccccggauaccauacgcagacagcuggccccuggcaccuugggcggcucgagauggauuucgacuuuugugaaggaaccaccgugguggucacagaggauugcggcaacagagggccuucucugcggaccacgacagccuccggaaaacugauuaccgaauggugcugucgcagcugcacacucccgccccugagauaucggggcgaggacggcuguugguacgggauggagaucagaccucuuaaggaaaaagaggaaaaucuggugaacucccucguuaccgccggacauggccagauugauaauuucucucugggggugcugggaauggcucuuuuucucgaggaaaugcugcgcacacgggucggcaccaagcacgcgauccugcucguggccguuagcuucgugacgcugauuaccgggaacauguccuuuagagaccuuggacgcgucauggugaugguuggcgcuacaaugaccgaugacaucggcaugggggugacauaucuggcccuccuggccgcuuucaaggucagacccaccuuugccgcgggacugcuucugcggaaacucacgucuaaggagcugaugaugacaaccaucggcauugugcuccugagccaauccacaaucccugagaccauucuugaacugaccgaugcucucgcccuggggaugauggcccugaaaaucgugcgcaauauggagaaguaccagcuugcugucacaauuauggccauccugugcguucccaacgcggugauccuccagaaugcuuggaaagugucuuguacgacccuggccgucgugagcguuuccccucuccugcuuacaagcucucaacagaaggccgacuggauuccccuggcucucaccaucaagggacugaacccgacagccauuuuccugaccacgcuuuccagaacaagcaaaaagcggucuuggccucugaaugaagcuaucauggccgugggcauggucuccauucucgcgagcucucugcucaaaaacgauauccccaugaccgggccucugguggccggaggccuucugaccguuugcuaugugcugacaggccgcuccgcugaccucgagcuggaaagagccgcugacguccggugggaggagcaggccgaaaucagcggguccagccccauucuuucuaucaccauuagcgaggauggauccaugucuaucaagaaugaagaggaggaacagacacugacgauucucauccgcaccggccugcucgugauuagcgggcuguuuccggucuccaucccuaucacagccgcugcgugguaccuuugggaggugaaaaagcaaagagccggaguucugugggacgugcccucuccuccccccgucggcaaagcugaacuggaggauggggccuaucggauuaagcagaagggaauccucggcuacagccagauuggcgccgggguguacaaagaaggaaccuuccacacaauguggcauguuacccgcggcgcugugcugaugcacaaggggaaaagaaucgagccuuccugggccgacgucaagaaagaucuuauuucuuauggaggcggguggaagcuggagggagaauggaaggagggcgaagaggugcaggugcucgcgcuggaaccgggcaaaaacccccgggcuguucaaacgaagccugggcucuuuaaaaccaacacaggaaccaucggcgccgucagccuggacuucucccccgggacaagcggaucuccuaucguggauaagaaaggcaagguggucgggcuuuacggaaauggcgugguuaccagauccggcacauaugugagcgccauugcucagacggagaagucuaucgaggacaaccccgaaauugaggaugacaucuuucgcaaaaagcggcugaccauuauggaucugcauccuggggccggaaaaacaaagagauaccucccggcgaucguccgcgaagcuaucaaacggggccugagaacccuuauucuggcccccacccgcgugguugccgcugagauggaagaggcccuccgggggcugccuaucagauaucagacacccgcuauuaaggccgagcacacgggacgcgaaaucguggaccucaugugucaugcgaccuucacaaugcggcugcuuuccccuauuagaguccccaauuacaaccugaucauuauggaugaggcccacuucaccgacccggcuagcaucgccgcucggggcuauaucuccacacgcguggaaaugggggaggccgccggcauuuuuaugaccgcuacgccucccggaucuagagaccccuucccucagagcaaugcgcccaucauggaugaggaacgggagauuccugaacgcuccuggaacagcggccacgaguggguuacagacuuuaaggggaaaaccgugugguucgucccgucuaucaaggccggaaaugauauugcugccugccugagaaaaaacggcaagaaagugauccaacucucccggaagaccuuugacuucgaauacaucaagacaagaaccaaugauugggacuuuguggucacaaccgauauuagcgagaugggggccaacuucaaagcugagcgcguuaucgacccccggagauguaugaagccugugauucugacggauggagaagagcgcgugauccuugccggccccaugccugucacacauucuagcgcggcucagcggagagggcgcgugggccggaaucccaaaaacgaaaaugaccaguacauuuauaugggagagccgcuggaaaacgaugaggacugcgcccacuggaaggaggccaaaaugcuccuggacaauaucaacaccccugaaggcaucauucccuccauguuugagccugaaagagagaagguugaugcuaucgacggggaauaccgccugagaggagaggcccggaaaacauucguggaucucaugcgcagaggcgaccuucccgucuggcuggcguaucggguggccgcugaggggauuaacuacgccgaucgcagaugguguuuugacggaguuaagaauaaccaaauccuggaagagaauguggaagucgagauuuggaccaaggagggcgaacggaaaaagcucaaaccuagauggcuggaugcucgcaucuauucugacccccuugcccugaaggaguucaaagaauucgcugccgggcggaagagccucacgcugaaccugauuaccgagaugggcagacucccgacauuuaugacccagaaggcgcgcaaugcccuugauaaccuggcugugcugcauacagccgaagcuggaggccgggccuacaaucacgcccucuccgagcugccugagacccuugaaacacugcuccugcugacccuccuugcuacggucacagggggaaucuuccuguuucugaugucuggcaaagggaucggaaagaugacccucggcaugugcugcauuaucaccgcgagcauucugcuuugguaugcccagauccagccccacuggauugcugccuccaucauccuggaguucuuucucauugugcugcugauccccgaaccugagaaacaaagaacaccgcaggacaaccagcucaccuacguugugauugccauccuuacaguggucgcugccacgauggcgaaugaaaugggcuuccuggagaagaccaaaaaggauuuugggcugggaagcauuacaacccagcaacccgagucuaacauccucgacaucgaucugcggccugccuccgcuuggacacuuuacgccguugcuaccacguucauuacccccaugcugcgccauagcaucgaaaauuccucugugaacgugagccucacagccauugcgaaucaggccaccguccugaugggccuggggaagggauggccucucuccaaaauggacaucggcgugccccuucuggcuauuggguguuauucucagguuaacccuaucacacugaccgccgcucuccugcuucugguggcccacuacgcuauuaucggaccgggccuccaggccaaggcgacgagagaggcccaaaaacgggcugccgcuggcaucaugaagaaucccacagucgacgggauuaccgugaucgaucuggacccuauucccuaugauccuaaauuugaaaagcagcugggacaggucaugcuccuugugcugugcguuacacaggugcugaugaugcgcaccaccugggcccucugugaggcccugacacuugcgacgggccccaucagcacccugugggaagggaacccgggaagauucuggaauacaaccauugcugucuccauggccaacaucuuucggggcagcuaccucgcuggggccggacugcuguucucuaucaugaagaacacagccaauacccgcagaggcacgggcaacacaggggagacccucggagagaaauggaagaaucggcuuaacgcucugggcaaauccgaauuucaaauuuauaagaaaagcgggauccaggagguggaccgcacccuggccaaggaaggaauuaaaagaggcgagacagaucaucacgcgguuucucggggguccgccaagcucagaugguucguggagcgcaaucuggucaccccugaaggaaaggugguggaccuuggcugcggccgggggggauggagcuacuauuguggcgggcugaaaaacguuaaggaggucaaaggacucacaaagggcgggcccggacaugaagagcccaucccuaugucuacguacggcuggaaucuggugagacugcagagcggcguggaugucuucuuuacccccccugaaaaaugcgacacacuccuuugugauauuggggaguccucuccgaaccccaccguugaggcuggacgcacacugcgggugcugaaucucguggaaaacuggcugaauaacaauacccaauucugcaucaagguccuuaacccuuacaugcccagcgugaucgagaagauggaagcccugcagagaaaauauggcggggcucucguucgcaauccucugucccggaacagcacgcacgagauguacuggguguccaacgccucuggaaauauugucagcuccgugaacaugaucucuagaaugcugauuaaucgcuuuaccaugcggcacaagaaagcgacauaugaacccgacguugaucucggcagcgggaccagaaacaucggaauugaguccgagaucccgaaucuugacaucauuggcaagcgcaucgaaaaaauuaagcaggagcaugaaacaucuuggcacuacgaucaggaccauccuuaucggaccugggccuaccacggcagcuaugagacaaagcaaaccggguccgcuagcucuauggugaacggagucgugagacugcugacgaaacccugggacgugaucccuauggucacacagauggccaugaccgauaccacacccuucggccagcagcgcguuuuuaaggaaaaaguggacacgagaacccaagagccuaaggaggggacaaaaaagcucaugaagauuaccgcugaauggcuguggaaagagcuuggaaagaaaaagacaccccggauguguacccgcgaagaguucacaagaaaagugcgguccaaugccgcucugggcgccaucuuuaccgaugagaacaaguggaaaagcgcgagagaagccgucgaggacucuggguucugggaacucguggauaaggagcggaaucugcaccuggaaggaaagugcgagacguguguuuacaacaugaugggcaaacgcgagaagaaacucggcgaauuugggaaggcuaaaggauccagagccauuugguacauguggcugggcgcucgguuccuugaguuugaagcccugggguuccucaaugaggaccauugguuuagccgcgaaaacucucuguccggaguggagggcgaggggcuucacaagcugggcuauauccucagagaugucagcaagaaagaaggaggcgccauguacgcggacgauaccgcugggugggacacacggaucacccuggaggaucugaagaaugaagagauggugacaaaccauauggaaggagagcacaaaaagcucgccgaggccauuuucaaacugaccuaucagaauaagguugugcgcguccagagaccgacgccucggggcacagugauggacaucauuucccgcagagaccagcgggggagcggacaaguugugaccuacggccuuaacacauucaccaacauggaagcucagcugauccgccagauggagggggaaggcgucuuuaagucuauucaacagcucacggugaccgaggagaucgccgucaaaaauuggcuggugagaguuggacgggaacgccuuagcagaauggcuaucuccggcgaugacugcguggucaagccccuggaugaccgguucgccucugcgcucacagcccugaacgauauggggaaagugagaaaggacauucagcagugggagcccagccgcggauggaaugauuggacccaagugccuuuuugcucccaucacuuccacgaacugaucaugaaagacggccggguucucguggucccguguagaaaccaggaugagcugauugggcgcgcucggaucucucagggagccggcuggagccuuagagaaacagcuugccuggggaaguccuaugcccagauguggucucucauguacuuucaucgccgggaccugagacuugcggccaaugcuauuuguagcgccgugcccucccacuggguuccuaccagccgcacaaccuggucuauccaugcuacgcacgaguggaugacaaccgaggauaugcugaccguguggaaccgggucuggauccaagaaaaucccuggauggaggacaagacaccuguggaauccugggaggaaauucccuaucucggcaaaagagaggaucaguggugcggaagccugaucggccugaccucucgcgccacaugggcuaagaacauucagacggccaucaaucagguccggucccucauugggaacgaggaauacaccgacuacaugccuagcaugaaaagauuccggagagaggaagaggaagcgggagugcugugguga

SEQ ID NO: 20216 - RNA, 9876 nt, Artificial Sequence
  derived and/or modified CDS sequence (opt5) from DENV-2__KC762663__SS-prME
accgccggaaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucaccgaucuggaaaagcgccacgugcucggacggcugauuacagucaauccuaucgugaccgagaaagacucuccgguuaacauugaagccgagcccccuuuuggcgauuccuacaucauuaucgggguggaacccggccagcugaagcucagcugguucaaaaagggaucuagcauuggccagauguuugagacaaccaugagaggggcuaagcgcauggccauccugggagacacggccugggauuucggcucccuugggggagucuuuacaucuaucggcaaagcucugcaucaaguguucggggccauuuauggcgcggcuuuuagcggaguguccuggaccaugaagauccucauuggcguugucaucaccuggauugggaugaauagccggucuacaucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacacguggaccgaacaguauaaguuucagccugagucucccagcaagcucgccuccgcuauucaaaaagcccacgaagaggggaucuguggcauuagaucugucacacgccuggaaaaccuuauguggaagcagaucaccccggagcugaaucauauucucagcgagaacgaagugaaacugacaaucaugaccggagacaucaagggcauuaugcaggcugggaaacggucccugagaccucagcccacggagcuuaaguacagcuggaaaaccuggggaaaggccaagaugcucucuacagaacugcacaaucauaccuuccugaucgauggcccugagacagcggaaugccccaacgccaaucgcgcuuggaacucccucgagguugaggacuauggguuuggaguguucaccacaaauauuuggcugaaacuuaaggaacggcaagaugccuuuugugacagcaaacugaugucugcugccaucaaggacaacagagcgguccacgccgauaugggcuacuggauugaguccgcucucaacgacaccuggaaaaucgaaaaggccagcuucaucgaggugaagucuugccacuggccuaaaagccauacgcugugguccaauggcgugcuggagagcgaaaugauuauccccaagaacuucgcugggccggucucucagcacaauuaucgcccuggauaccauacacagaccgccggccccuggcaccuugggcggcucgagauggauuuugacuucugugaaggaaccacaguuguggugaccgaggauugcggcaacagagggcccucccugcggacgacaaccgccagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcuggacauggccagauugauaauuuuagccuggggguucugggaauggcgcuuuuccucgaggaaaugcugcgcacccgggugggcacgaagcacgccauccugcucgucgcuguguccuuuguuacccugauuacagggaacaugucuuucagagaccuuggacgcgugauggucauggugggcgccaccaugacagaugacaucggcauggggguuaccuaccuggcccuccuggcugccuuuaaggugagaccuacguucgcggcuggacugcuucugcggaaacucacaagcaaggagcugaugaugaccacaaucggcauuacccuccugucccaaucuaccauccccgagacaauucuugaacugacggaugcccucgcccuggggaugaugguccugaaaaucgugcgcaauauggagaaguaucagcuugcugugaccauuauggccauccugugcgucccuaacgcgguuauccuccagaaugcuuggaaagugagcuguacaacccuggccguggucuccgugagcccccuccugcuuacaucuucccaacagaaggccgacuggauuccucuggcucucaccaucaagggacugaaccccacggccauuuuucugacaacccuuagcagaaccucuaaaaagcgguccuggccgcugaaugaagcuaucauggccguuggcauggugagcauucucgcgucuucccugcucaaaaacgauaucccuaugacagggccccuggucgccggaggccuucugaccgugugcuacguucugacaggccgcagcgcugaccucgagcuggaaagagccgcugacgugcggugggaggagcaggccgaaaucuccgggagcucuccuauucuuagcaucacgauuuccgaggauggaucuaugagcaucaagaaugaagaggaggaacagacccugacaauucucauccgcaccggccugcucgucauuuccgggcuguuccccgugucuaucccgaucacagccgcugcgugguaucuuugggaggucaaaaagcaaagagccggagugcugugggacguuccuucucccccucccguggaaaaagcugagcuggaagauggcgccuaccggauuaagcagaaggggauccucggauauucccagauuggcgccggcgucuacaaagaggggaccuuucacacgauguggcaugugacccgcggagcuguucugaugcacaagggcaaaagaaucgagcccuccugggccgacgugaagaaagaucuuauuagcuacgggggaggcuggaagcuggaaggggaguggaaggaaggagaggaaguccaggugcucgcgcuggagccuggcaaaaacccgcgggcugugcaaacaaagcccggccucuucaaaaccuccacagggaccaucggagccguuagccuggacuuuucuccuggcacauccgggagccccaucgucgauaagaaaggaaagguggugggccuuuaugggaacggagucgugacgagaucuggcaccuacguuuccgccauugcucagacagaaaagagcaucgaagacaauccugagauugaagaugacaucuuccgcaaaaagcggcugaccauuauggaucugcaucccggcgccgggaaaaccaagagauaucucccugcgaucgugcgcgaggcuaucaaacggggacugagaacacuuauucuggccccgacgcgcgucguggccgcugaaauggaggaggcccuccggggccugcccaucagauaccagaccccugcuauucgcgccgaacacacagggcgggagaucguugaccucaugugucaugcgaccuucacaaugagacugcuuucccccauucgggugccuaacuauaaucugaucauuauggaugaagcccacuuuaccgaccccgcuucuaucgccgcucgcggauacaucagcacgagagucgagaugggcgaggccgccgggauuuucaugacagcuaccccgccuggcucccgggaccccuuuccccagagcaacgcgccuaucauggaugaagaacgcgaaauucccgagagaucuuggaauagcggacacgaaugggugaccgacuucaagggcaagacaguuugguuugugccuagcaucaaagccgggaacgauauugcugccugccugcggaagaauggcaaaaaggucauccaacucucuagaaaaaccuucgacuuugaguauaucaagacacgcaccaacgauugggacuucguggugacgacagauauuagcgagaugggcgccaauuuuaaggcugaacgggucaucgacccgagacgcuguaugaaacccguuauucugaccgauggggaggaacgggugauccuugccggaccuaugcccgugacacauuccucugcggcucagagacgcggccgggucgggagaaacccuaagaaugagaacgaccaguacauuuacaugggcgaaccccuggagaaugaugaggacugcgcccacuggaaagaagccaagaugcuccuggacaacaucaauaccccggagggaaucauuccuagcauguucgaacccgagcgcgaaaaaguggaugcuaucgacggcgaguauagacugagaggggaggcccgcaagacguuuguugaucucaugagacggggagaccuuccuguguggcuggcguaccgcgucgccgcugaaggcauuaacuaugccgauagacggugguguuucgacggggugaaaaacaaucaaauccuggaggaaaacguugagguggagauuuggaccaaggaaggagagagaaagaaacucaagccccgcuggcuggaugcucggaucuacuccgacccucuugcccugaaagaguucaaggaguuugcugccggcagaaaaucucucacacugaaucugauuaccgaaauggggcgccuccccacauucaugacccagaaggcgcggaacgcccuugauaaucuggcuguccugcauacagccgaggcuggcgggcgggccuauaaccacgcccucagcgagcugccggaaacccuugagacgcugcuccugcugacacuccuugcuaccgugaccggcgggaucuuucuguuccugauguccggaaagggcaucgggaaaaugacacucggaaugugcugcauuaucaccgcgagcauucugcuuugguacgcccagauccagccucacuggauugcugccucuaucauccuggaauuuuuccucauuguccugcugauccccgagcccgaaaagcaacggacaccucaggacaaucagcucacguaugugguuauugccauccuuaccgugguggcugccacaauggcgaacgagaugggcuuucuggagaaaaccaagaaagauuucggccugggguccauuacaacccagcaaccggaaagcaauauccucgacaucgaucugcgccccgccuccgcuuggacgcuuuacgccgucgcuaccacauuuauuaccccuaugcugagacauucuaucgagaacagcuccguuaaugugucucucacagccauugcgaaccaggccaccgugcugaugggacugggcaagggguggccccucagcaagauggacaucggagucccucuucuggcuauuggcuguuacucccaggugaaucccaucacgcugacagccgcucuccugcuucugguugcccacuaugcuauuaucgggccuggacuccaggccaaagcgacccgggaagcccaaaagcgcgcugccgcuggcaucaugaaaaacccgacaguggacggcauuaccgucaucgaucuggaccccauuccuuacgaucccaaguucgagaaacagcugggacaggugaugcuccuuguccugugcgugacccagguucugaugaugagaacaacgugggcccucugugaagcccugacccuugcgacaggaccuaucagcacccugugggagggcaaucccgggcgguuuuggaacacaaccauugcugugucuauggccaauaucuuccgcggauccuaucucgcuggcgccgggcugcuguuuagcaucaugaagaacacggccaacacaagacggggaaccggcaauaccggcgagacacucggggaaaaguggaaaaaccgccuuaaugcucugggaaagucugaguuccaaauuuacaaaaaguccggcauccaggaagucgacagaacccuggccaaagaggggauuaagcggggagagacagaucaucacgcggugagcagaggcucugccaaacuccgcugguucguugaacggaaccuggugacgccggaggggaaggucguggaccuuggaugcggcagaggcggguggagcuauuacuguggaggccugaagaaugugaaagaaguuaaggggcucaccaaaggaggcccugggcaugaggaacccauccccauguccacauauggauggaaccugguccgccugcagucuggcguggauguguuuuucaccccucccgagaagugcgacacacuccuuugugauauuggcgagagcuccccuaauccgaccgucgaagcugggcggacgcugagaguucugaaccucguggagaauuggcugaacaauaacacccaauuuugcaucaaagugcuuaaucccuacaugccuagcgucaucgaaaagauggaggcccugcagcgcaaguacggaggcgcucucgugcggaacccccuguccagaaauucuacacacgaaauguauuggguuagcaacgccuccgggaacauugugucuagcgucaauaugaucucccgcaugcugauuaaccgguucaccaugagacacaaaaaggcgacauacgagccugacguggaucucggaucuggcacccgcaauaucgggauugagagcgaaacacccaaccuugacaucaucggaaaacggauugagaagaucaaacaggaacaugagaccuccuggcacuaugaucaggaccauccguacaagacgugggccuaucacggcagcuacgaaacaaagcaaaccggcucugcuuccagcaugguuaaugggguggucagacugcugaccaaaccuugggacgugauucccauggugacacagauggccaugacggauaccacaccuuuuggacagcagcgcgucuucaaggagaaaguugacaccagaacacaagagcccaaggaaggcaccaaaaagcucaugaagaucacagcugaguggcuguggaaagaacuugggaagaaaaagaccccucggauguguacgcgcgaggaguuuaccagaaaagugcggucuaacgccgcucugggagccauuuucacagaugaaaauaaguggaaauccgcgagagaggccguggaagacagcggcuuuugggagcucgucgauaaggaacggaaccugcaccuggaggggaagugcgagaccuguguguauaauaugaugggaaaacgcgaaaagaaacucggcgaguucggcaaggcuaaagggucuagagccaucugguacauguggcugggagcucgguuucuugaguucgaggcccugggcuuucucaacgaagaccauugguucucccgcgagaauagccuguccgggguugagggagaaggccuucacaagcugggguacauucucagagaugugagcaagaaagagggcggagccauguaugcggacgauacagcuggcugggacacccggaucacgcuggaagaucugaagaacgaggaaauggucacaaaucauauggagggggagcacaaaaagcucgccgaagccaucuucaaacugaccuaccagaacaaggugguucgcgugcagagacccacaccgcggggaaccgucauggacauuaucucucgcagagaccagcggggcagcgggcaagugguuacguauggacuuaauaccuuuacaaacauggaggcucagcugauucgccagauggaaggcgaggggguguucaaguccauccaacagcucaccgucacagaggaaauugccgugaaaaacuggcuggucaccgugggcagagagcggcuuucucgcauggcuaucagcggagaugacugcguugugaagccucuggaugacagauuugccuccgcgcucacagcccugaaugauaugggcaaaguccggaaggacauccagcagugggaacccucuagaggguggaacgauuggacccaagugcccuucugcagccaucacuuucacgagcugauuaugaaagacggacgcgugcucguugugccuugucggaaucaggaugaacugaucggcagagcucgcauuucccagggggccggauggucucuucgggagacggcuugccugggcaagagcuacgcccagauguggucccucauguauuuccauagacgcgaccugcggcuugcggccaacgcuaucuguagcgccgucccgucucacugggugcccacauccagaaccaccuggagcauucaugcuacacacgaguggaugaccacagaagauaugcugacgguuuggaaucgcguguggauccaagagaacccuuggauggaagacaagacccccgucgagucuugggaagagaucccuuaccucgggaaacgggaggaucaguggugcggcucccugauuggacugacaagcagagccaccugggcuaagaauauccagacagccauuaaccaggugcgcucccucaucggcaaugaagaguauaccgacuacaugcccucuaugaaacgguuuagacgggaagaggaagaggcggggguccugugguga

SEQ ID NO: 20217 - RNA, 9876 nt, Artificial Sequence
  derived and/or modified CDS sequence (opt5) from DENV-2__KC762675__SS-prME
acagccggcaucauuaucaugaugauucccacagugauggcuuuccaccugacgaccagaaacggggagccucauaugaucgugagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagauugugcagccugaaaaccuggaguacacgaucgugauuacaccccauucuggcgaagagaaugccgucgggaacgauacaggaaaacacggcaaggagaucaaagugaccccucaguccagcaucacagaagcugagcucaccggcuaugggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucaugccaagaaacaggauguugugguccugggaagccaagagggcgccaugcacacggcucucacaggggcgaccgaaauccagauguccucuggcaaccugcuuuuuacaggacaucugaagugcagacuccggauggacaaacugcagcuuaagggcaugagcuacuccauguguaccgggaaauucaagguggucaaggagauugccgaaacccaacacggaacaaucgugauuagaguucaguaugagggcgacgggagccccugcaaaauccccuucgagaucauggaucuggaaaagcgccaugugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaccaaguguucggggcgauuuacggcgcugccuuuagcggaguguccuggacgaugaagauccucauuggcguugucaucacauggauugggaugaauagccggucuaccucccugagcgugucucuggugcuugucggagugguuacccucuaucugggcgugaugguccaggccgacuccgggugugugguuagcuggaaaaacaaggagcugaaaugcggauccggcaucuucaucacagauaaugugcacaccuggacagaacaguacaaguuucagccugagucucccagcaagcucgcuuccgccauucaaaaagcucaugaagaggggaucuguggcauuagaucugucacgcgccuggaaaaccuuauguggaagcagaucaccccggagcugaaucacauucucagcgagaacgaagugaaacugacaaucaugaccggagacaucaagggcauuaugcaggccgggaaacggucccugagaccucagcccacagagcuuaaguauagcuggaaaaccuggggaaaggcgaagaugcucucuacggaacugcauaaucacaccuuccugaucgauggcccugagacagccgaaugccccaacaccaaucgcgcuuggaacucccucgagguugaggacuacggguuuggaguguucacaaccaauauuuggcugaaacuuaaggaacggcaagaugucuauugugacagcaaacugaugucugccgcuaucaaggacaacagagccgugcacgcggauaugggcuacuggauugaguccgcccucaacgacacauggaaaaucgaaaaggcuagcuuuaucgaggugaagucuugcuauuggccuaaaagccauacccugugguccaauggcguccuggagagcgaaaugauuauccccaagaacuucgccgggccgguuucucagcacaauuaccgcccuggauaccauacgcagacagcuggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaucggggcgaggacggcuguugguacgggauggagaucagaccccuuaaggaaaaagaggaaaaucuggugaacucucucguuaccgccggacauggccagauugauaauuucagccugggggugcugggaauggcucuuuuucucgaggaaaugcugcgcacacgggucggcaccaagcacgcgauccugcucguggccguuuccuucgugacgcugauuaccgggaacaugucuuuuagagaccuuggacgcgucauggugaugguuggcgcuacaaugaccgaugacaucggcaugggggugacauaucuggcccuccuggccgcuuucaaggucagaccuaccuuugccgcgggacugcuucugcggaaacucacgagcaaggagcugaugaugacaaccaucggcauugugcuccugucccaaucuacaauccccgagaccauucuugaacugaccgaugcucucgcccuggggaugauggcccugaaaaucgugcgcaauauggagaaguaccagcuugcugucacaauuauggccauccugugcguuccuaacgcggugauccuccagaaugcuuggaaagugagcuguacgacccuggccgucguguccguuagcccccuccugcuuacaucuucccaacagaaggccgacuggauuccucuggcucucaccaucaagggacugaaccccacagccauuuuccugaccacgcuuagcagaacaucuaaaaagcgguccuggccgcugaaugaagcuaucauggccgugggcauggucagcauucucgcgucuucccugcucaaaaacgauaucccuaugaccgggccccugguggccggaggccuucugaccguuugcuaugugcugacaggccgcagcgcugaccucgagcuggaaagagccgcugacguccggugggaggagcaggccgaaaucuccgggagcucuccuauucuuagcaucaccauuuccgaggauggaucuaugagcaucaagaaugaagaggaggaacagacacugacgauucucauccgcaccggccugcucgugauuuccgggcuguuucccgucucuaucccgaucacagccgcugcgugguaccuuugggaggugaaaaagcaaagagccggaguucugugggacgugccuucucccccucccgucggcaaagcugaacuggaggauggggccuaucggauuaagcagaagggaauccucggcuacucccagauuggcgccgggguguacaaagaaggaaccuuccacacaauguggcauguuacccgcggcgcugugcugaugcacaaggggaaaagaaucgagcccuccugggccgacgucaagaaagaucuuauuagcuauggaggcggguggaagcuggagggagaauggaaggagggcgaagagguccaggugcucgcgcuggaaccuggcaaaaacccgcgggcuguucaaacgaagcccgggcucuuuaaaaccaacacaggaaccaucggcgccgucucccuggacuucagcccugggacaucuggaucccccaucguggauaagaaaggcaagguggucgggcuuuacggaaauggcgugguuaccagaagcggcacauaugugucugccauugcucagacggagaaguccaucgaggacaacccugaaauugaggaugacaucuuucgcaaaaagcggcugaccauuauggaucugcaucccggggccggaaaaacaaagagauaccucccugcgaucguccgcgaagcuaucaaacggggccugagaacccuuauucuggccccgacccgcgugguugccgcugagauggaagaggcccuccgggggcugcccaucagauaucagaccccugcuauucgcgccgagcacacgggacgggaaaucguggaccucaugugucaugcgaccuucacaaugagacugcuuagccccauucgggucccuaauuacaaccugaucauuauggaugaggcccacuucaccgaccccgcuuccaucgccgcucgcggcuauaucucuacaagaguggaaaugggggaggccgccggcauuuuuaugaccgcuacgccgccuggaagccgggaccccuucccccaguccaaugcgccuaucauggaugaggaacgcgagauucccgaaagaagcuggaacucuggccacgaguggguuacagacuuuaaggggaagaccgugugguucgucccuuccaucaaagccggaaaugauauugcugccugccugcggaagaacggcaaaaaggugauccaacucagcagaaaaaccuuugacuucgaauacaucaagacacgcaccaaugauugggacuuuguggucacaaccgauauuucugagaugggggccaacuucaaggcugagcggguuaucgacccgagacgcuguaugaaacccgugauucugacggauggagaagaacgggugauccuugccggcccuaugcccgucacacauagcuccgcggcucagagacgcgggcgggugggcagaaauccuaagaacgaaaaugaccaguacauuuauaugggagagccccuggaaaacgaugaggacugcgcccacuggaaagaggccaagaugcuccuggacaauaucaacaccccggaaggcaucauuccuucuauguuugagcccgaacgcgagaaaguugaugcuaucgacggggaauacagacugcggggagaggcccgcaagacauucguggaucucaugagacggggcgaccuuccugucuggcuggcguaucgcguggccgcugaggggauuaacuacgccgauagacggugguguuuugacggaguuaaaaauaaccaaauccuggaagagaauguggaagucgagauuuggaccaaggagggcgaaagaaagaaacucaagccccgcuggcuggaugcucggaucuauagcgacccucuugcccugaaagaguucaaggaguucgcugccgggagaaaaucccucacgcugaaccugauuaccgagaugggccgccuccccacauuuaugacccagaaggcgcggaaugcccuugauaaccuggcugugcugcauacagccgaagcuggaggcagagccuacaaucacgcccucucugagcugccggagacccuugaaacacugcuccugcugacccuccuugcuacggucacagggggaaucuuccuguuucugaugagcggcaaggggaucggaaaaaugacccucggcaugugcugcauuaucaccgcguccauucugcuuugguaugcccagauccagccucacuggauugcugccagcaucauccuggaguucuuucucauugugcugcugauccccgaacccgagaagcaacggacaccucaggacaaccagcucaccuacguugugauugccauccuuacaguggucgcugccacgauggcgaaugaaaugggcuuccuggagaaaaccaagaaagauuuugggcugggaucuauuacaacccagcaaccggaguccaacauccucgacaucgaucugcgccccgccagcgcuuggacacuuuacgccguugcuaccacguucauuaccccuaugcugagacauuccaucgaaaauucuagcgugaacgugucccucacagccauugcgaaucaggccaccguccugaugggccuggggaagggauggccccucucuaagauggacaucggcgugccucuucuggcuauuggguguuauagccagguuaaccccaucacacugaccgccgcucuccugcuucugguggcccacuacgcuauuaucggaccuggccuccaggccaaagcgacgcgggaggcccaaaagcgcgcugccgcuggcaucaugaaaaauccgacagucgacgggauuaccgugaucgaucuggaccccauuccuuaugaucccaaguuugaaaaacagcugggacaggucaugcuccuugugcugugcguuacacaggugcugaugaugagaaccaccugggcccucugugaggcccugacacuugcgacgggcccuaucuccacccugugggaagggaaccccggacgguucuggaauacaaccauugcugucagcauggccaacaucuuucgcggcucuuaccucgcuggggccggacugcuguucuccaucaugaagaacacagccaauaccagacggggcacgggcaacacaggggagacccucggagagaaguggaaaaaucgccuuaacgcucugggcaagagcgaauuucaaauuuauaaaaagucugggauccaggagguggacagaacccuggccaaagaaggaauuaagcggggcgagacagaucaucacgcgguuuccagagggagcgccaaacuccgcugguucguggagcggaaucuggucaccccggaaggaaaggugguggaccuuggcugcggcagagggggauggucuuacuauuguggcgggcugaagaacguuaaagaggucaagggacucacaaaaggcgggccuggacaugaggaacccauccccaugagcacguacggcuggaaucuggugcgccugcaguccggcguggaugucuucuuuaccccucccgaaaagugcgacacacuccuuugugauauuggggagucuagcccuaacccgaccguugaggcuggacggacacugagagugcugaaucucguggaaaacuggcugaauaacaauacccaauucugcaucaaaguccuuaaccccuacaugccuuccgugaucgagaagauggaagcccugcagcgcaaguauggcggggcucucguucggaauccccugagcagaaacuccacgcacgagauguacugggugucuaacgccagcggaaauauugucuccucugugaacaugaucagccgcaugcugauuaaucgguuuaccaugagacacaaaaaggcgacauaugaaccugacguugaucucggcuccgggacccgcaacaucggaauugagucugagauccccaaucuugacaucauuggcaaacggaucgaaaagauucagcaggagcaugaaacaagcuggcacuacgaucaagaccauccguauagaaccugggccuaccacggcuccuaugagacaaaacagaccgggagcgcuucuuccauggugaacggagucgugcgccugcugacgaagccuugggacgugauccccauggucacacagauggccaugaccgauaccacaccuuucggccagcaaagaguuuuuaaggaaaaaguggacacgcggacccaggagcccaaggaggggaccaaaaagcucaugaaaauuaccgcugaauggcuguggaaggagcuuggaaagaaaaagacaccucgcauguguaccagagaagaguucacacggaaagugagaagcaaugccgcucugggcgccaucuuuaccgaugagaacaaguggaaaucugcgcgggaagccgucgaggacuccggguucugggaacucguggauaaggagcgcaaucugcaccuggaaggaaaaugcgagacguguguuuacaacaugaugggcaagagagagaagaaacucggcgaauuugggaaggcuaaaggaagccgggccauuugguacauguggcugggcgcucgcuuccuugaguuugaagcccugggguuccucaaugaggaccauugguuuucuagagaaaacucccugagcggaguggagggcgaggggcuucacaagcugggcuauauccuccgggaugucuccaaaaaggaaggaggcgccauguacgcggacgauaccgcugggugggacacacgcaucacccuggaggaucugaagaaagaagagauggugacaaaucauauggaaggagagcacaagaaacucgccgaggccauuuucaagcugaccuaucagaacaaaguugugagaguccagcggcccacgccgcgcggcacagugauggacaucauuagcagacgggaccaacgcgggucuggacagguugugaccuacggccuuaauacauucaccaacauggaagcucagcugaucagacaaauggagggggaaggcgucuuuaagagcauucagcagcucacggugaccgaggagaucgccgucaagaacuggcuggugcggguuggacgcgaaagacuuucccggauggcuaucucuggcgaugacugcguggucaaaccucuggaugacagauucgccagcgcgcucacagcccugaaugauauggggaaggugcgcaaagacauucagcaaugggagcccucccggggauggaacgauuggacccaggugcccuuuugcucucaucacuuccacgaacugaucaugaaggacggcagaguucucguggucccuugucgcaaucaggaugagcugauugggcgggcuagaaucagccagggagccggcuggucccuucgcgaaacagcuugccuggggaaaucuuaugcccaaauguggagccucauguacuuucaucggagagaccugcgccuugcggccaacgcuauuuguuccgccgugccgagccacuggguucccaccucucggacaaccugguccauccaugcuacgcacgaguggaugacaaccgaggauaugcugaccguguggaauagagucuggauccaggaaaacccuuggauggaggacaagacacccguggaaagcugggaggaaauuccuuaucucggcaagcgcgaggaucaguggugcggaucucugaucggccugaccucccgggccacaugggcuaaaaauauucagacggccaucaaccaagucagaagccucauugggaaugaggaauacaccgacuacaugcccuccaugaagcgguucagacgcgaggaagaggaagcgggagugcugugguga

SEQ ID NO: 20218 - RNA, 9876 nt, Artificial Sequence
  derived and/or modified CDS sequence (opt5) from DENV-2__KC762671__SS-prME
accgccggcaucauuaucaugaugauucccacggugauggcuuuccaccugacgaccagaaauggggagccucauaugaucgugagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaagcguggggaaaggccaagaugcucucuaccgaacugcacaaucauacguuccugaucgauggcccugagaccgcugaaugccccaacacaaaucgcgccuggaacucccucgagguugaggacuauggguuuggaguguucaccacaaauauuuggcugaaacuuaaggaacggcaagaugucuuuugugacagcaaacugaugucugcugccaucaaggacuccagagcggugcacgccgauaugggcuacuggauugagagcgcucucaacgacaccuggaaaaucgaaaaggccucuuucaucgaggucaagagcugccacuggccuaaaucccauacacuguggagcaacggcguccuggagucugaaaugauuauccccaagaauuucgcugggccgguuucccagcacaacuaucgcccuggauaccauacccagacggccggccccuggcaccuugggcggcucgagauggauuuugacuucugugaaggaacaaccgugguggucaccgaggauugcggcaauagagggcccagccugcggacaaccacggccuccggaaaacugauuacagaauggugcugucgcucuugcacccucccuccgcugagauaccggggcgaggacggcuguugguaugggauggagaucagaccccuuaaggaaaaagaggaaaaccuggugaauagccucguuacagcuggacauggccagauugauaacuuuucccugggggugcugggaauggcgcuuuuccucgaggaaaugcugcgcacccgggucggcacaaagcacgccauccugcucguggcuguuucuuuugugacccugauuacggggaauaugagcuucagagaccuuggacgcgucauggugaugguuggcgccaccaugacagaugacaucggcaugggggugaccuaccuggcccuccuggcugccuuuaaggucagaccuacauucgcggcuggacugcuucugcggaaacucaccuccaaggagcugaugaugacgacaaucggcauugugcuccugucucaagccaccauccccgagacaauucuugaacugaccgaugcccucgcucuggggaugauggugcugaaaaucguccgcaacauggagaaguaucagcuugccguuaccauuauggcgauccugugcgugccuaaugcugugauccuccagaacgccuggaaagucagcuguacaacgcuggccgugguuuccgugagcccccuccugcuuaccucuucccaacagaaggcugacuggauuccucuggcccucacaaucaagggacugaaucccaccgcuauuuuucugacaacccuuagcagaacgucuaaaaagcgguccuggccgcugaacgaagccaucauggcggucggcauggugagcauucucgccucuucccugcucaaaaaugauaucccuaugacagggccccugguugcuggaggccuucugaccgugugcuacguccugaccggccgcagcgccgaccucgagcuggaaagagcugccgacgugcggugggaggagcaggccgaaaucuccgggagcucuccuauucuuagcaucacaauuuccgaggauggaucuaugagcaucaagaacgaagaggaggaacagacccugacaauucucauccgcacgggccugcucgucauuuccgggcuguuccccgugucuaucccgaucaccgcugcggccugguaucuuugggagguuaaaaagcaaagagcuggagugcugugggacgucccuucucccccucccgugggcaaagccgaacuggaggauggggccuaccggauuaagcagaagggaauccucggcuauucccagauuggcgcugggguuuacaaagaaggaacauuucacaccauguggcaugugacacgcggcgccguccugaugcacaaggggaaaagaaucgagcccuccugggcggacgugaagaaagaucuuauuagcuacggaggcggguggaagcuggagggagaauggaaggagggcgaagaggugcagguucucgcucuggaaccuggcaaaaauccgcgggccguccaaaccaagcccggacucuucaaaacgaacaccggaacaaucggcgccgugucccuggacuuuagcccugggaccucuggaucccccaucguggauaagaaaggcaaggucguggggcuuuauggaaacggcguugugacaagaagcggcaccuacgucucugcuauugcccagacagagaaguccaucgaggacaauccugaaauugaggaugacaucuuccgcaaaaagcggcugacgauuauggaucugcaucccggggcgggaaaaaccaagagauaucucccugcuaucgugcgcgaagccaucaaacggggccugagaacacuuauucuggccccgacccgcguuguggcugccgagauggaagaggcucuccgggggcugcccaucagauaccagaccccugccauucgcgcggagcacacaggacgggaaaucgucgaccucaugugucaugccacguucaccaugagacugcuuagccccauucgggugccuaacuauaaucugaucauuauggaugaggcucacuuuacagaccccgccuccaucgcugcccgcggcuacaucucuaccagaguugaaaugggggaggccgcuggcauuuucaugacagcgaccccgccuggaagccgggaccccuuuccccaguccaacgccccuaucauggaugaggaacgcgagauucccgaaagaagcuggaacucuggccacgagugggugacggacuucaaggggaagacagucugguuugugccuuccaucaaagcuggaaacgauauugccgccugccugcggaagaauggcaaaaaggugauccaacucagcagaaaaaccuucgacuuugaauauaucaagacccgcacaaacgauugggacuucgucguuaccacagauauuucugagaugggggcuaauuuuaaggccgagcgggugaucgacccgagacgcuguaugaaacccgugauucugaccgauggagaagaacgggucauccuugcgggcccuaugcccgugacgcauagcuccgcugcccagagacgcgggcggguuggcagaaacccuaagaaugaaaacgaccaguacauuuacaugggagagccccuggaaaaugaugaggacugcgcccacuggaaagaggcuaagaugcuccuggacaacaucaauacaccggaaggcaucauuccuucuauguucgagcccgaacgcgagaaaguggaugccaucgacggggaauauagacugcggggagaggcgcgcaagaccuuugucgaucucaugagacggggcgaccuuccuguguggcuggccuaccgcguugcugccgaggggauuaacuaugcugauagacggugguguuucgacggagugaaaaacaaucaaauccuggaagagaacgucgaaguggagauuuggacaaaggagggcgaaagaaagaaacucaagccccgcuggcuggaugcccggaucuacagcgacccucuugcucugaaagaguucaaggaauuugccgcggggagaaaaucccucacccugaaucugauuacggagaugggccgccuccccaccuucaugacacagaaggcccggaacgcucuugauaaucuggccguccugcauaccgcugaagccggaggcagagccuauaaccacgcucucucugagcugccggagacacuugaaacccugcuccugcugacacuccuugcgaccgugacaggcgggaucuuucuguuccugaugagcgggaaggggaucggaaaaaugacacucggcaugugcugcauuaucaccgccuccauucugcuuugguacgcucagauccagccucacuggauugccgccagcaucauccuggaguuuuuccucauuguucugcugauccccgaacccgagaagcaacggaccccucaggacaaucagcucacauauguggugauugcuauccuuaccgucguugccgcgacaauggccaacgaaaugggcuuucuggagaaaacgaagaaagauuucgggcugggaucuauuaccacacagcaaccggaguccaauauccucgacaucgaucugcgccccgcuagcgccuggacccuuuacgcuguggccacaaccuuuauuacgccuaugcugagacauuccaucgaaaacucuagcgugaaugucucccucaccgcgauugccaaccaggcuacagugcugaugggccuggggaagggauggccccucucuaagauggacaucggcguuccucuucuggccauuggguguuacagccaggugaaucccaucacccugacagcugcccuccugcuucuggucgcucacuaugccauuaucggaccuggccuccaggcgaaagccacccgggaggcucaaaagcgcgccgcugccggcaucaugaaaaacccgacgguggacgggauuacagucaucgaucuggaccccauuccuuacgaucccaaguucgaaaaacagcugggacaggugaugcuccuuguucugugcgugacccagguccugaugaugagaacaaccugggcccucugugaggcgcugacccuugcuacaggcccuaucuccacgcugugggaagggaaucccggacgguuuuggaacaccacaauugccgugagcauggcuaauaucuuccgcggcucuuaucucgccggggccggacugcuguuuuccaucaugaagaacaccgcuaacacaagacggggcaccggcaauacgggggagacacucggagagaaguggaaaaaccgccuuaaugcccugggcaagagcgaguuccaaauuuacaaaaagucugggauccaggagguugacagaacccuggcgaaagaaggaauuaagcggggcgagaccgaucaucacgccguguccagagggagcgcuaaacuccgcugguucgucgagcggaaccuggugacaccggaaggaaaggugguugaccuuggcugcggcagagggggauggucuuauuacuguggcgggcugaagaaugucaaagaggugaagggacucaccaaaggcgggccuggacaugaagaacccauccccaugagcacauauggcuggaaccuggugcgccugcaguccggcgucgaugucuuuuucacgccucccgaaaagugcgacacccuccuuugugauauuggggagucuagcccuaauccgacaguggaggccggacggacccugagagugcugaaccucgucgaaaauuggcugaacaauaacacacaauuuugcaucaaagugcuuaaucccuacaugccuuccguuaucgagaagauggaagcucugcagcgcaaguacggcggggcccucgugcggaacccccugagcagaaauuccacccacgagauguauugggucucuaacgcgagcggaaacauuguguccucuguuaauaugaucagccgcaugcugauuaaccgguucacgaugagacacaaaaaggccaccuacgaaccugacguggaucucggcuccgggacacgcaauaucggaauugagucugagacccccaaccuugacaucaucggcaaacggauugaaaagaucaaacaggagcaugaaacaagcuggcacuaugaucaggaccauccguacaagaccugggcuuaucacggcuccuacgagacaaagcaaaccgggagcgccucuuccauggucaauggaguggugagacugcugacgaaaccuugggacgucauucccaugguuacacagauggcuaugaccgauaccacaccuuuuggccagcagcgcguguucaaggaaaaaguggacacgagaacccaagagcccaaggaggggaccaaaaagcucaugaagaucaccgccgaauggcuguggaaagagcuuggaaagaaaaagacaccucggauguguacccgcgaagaguuugcuagaaaaguccggagcaacgccgcgcugggcgccauuuucacagaugagaauaaguggaaaucugcuagagaagccguggaggacuccggguuuugggaacucguugauaaggagcggaaccugcaccuggaaggaaagugcgagaccuguguguauaauaugaugggcaaacgcgagaagaaacucggcgaguucgggaaggcuaaaggaagcagagccaucugguacauguggcugggcgcccgguuucuugaguucgaagcgcugggguuucucaacgaggaccauugguucucucgcgaaaauucccugagcggagucgagggcgaggggcuucacaagcugggcuacauucucagagauguguccaugaaggaaggaggcgcuauguaugccgacgauacggccgggugggacacccggaucacacuggaggaucugaaaaacgaagagaugguuaccaaucauauggaaggagagcacaagaaacucgcugaggccaucuucaagcugacauaccagaacaaagugguccgcgugcagagacccaccccgcggggcacgguuauggacauuaucagccgcagagaccagcgggggucuggacaaguggucacauauggccuuaauaccuuuacaaacauggaagcucagcugauucgccagauggagggggaaggcguguucaagagcauccaacagcucaccgucacggaggagauugccgugaagaacuggcugguuagagugggacgggaacgccuuuccagaauggcgaucucuggcgaugacugcgucgugaaaccucuggaugaccgguuugccagcgcucucaccgcccugaaugauauggggaaggugagaaaagacauccagcagugggagcccucccgcggauggaacgauuggacacaaguucccuucugcucucaucacuuucacgaacugauuaugaaggacggccgggugcucgucgugccuuguagaaaucaggaugagcugaucgggcgcgcucggauuagccagggagccggcuggucccuuagagaaaccgcgugccuggggaaaucuuacgcccagauguggagccucauguauuuccaucgccgggaccugagacuugcugccaacgcuaucuguuccgccguuccgagccacugggugcccacaucucgcaccacaugguccauucaugcuacccacgaguggaugacgacagaggauaugcugaccgucuggaaucggguguggauccaagaaaacccuuggauggaggacaagacccccgucgaaagcugggaggaaaucccuuaccucggcaagagagaggaucaguggugcggaucucugauuggccugacaucccgcgccaccugggcgaaaaauauccagacagccauuaaccaggugcggagccucaucgggaaugaggaauauacggacuacaugcccuccaugaagagauuucggagagaggaagaggaagcuggaguucugugguga

SEQ ID NO: 20219 - RNA, 9876 nt, Artificial Sequence
  derived and/or modified CDS sequence (opt5) from DENV-2__KC762664__SS-prME
accgccggaaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucaccgaucuggaaaagcgccacggacucggccggcugauuacagugaauccuaucgucaccgagaaagacucuccggugaacauugaagccgagcccccuuuuggggauuccuacaucauuaucggcguugaacccggacagcugaagcucagcugguucaaaaagggcucuagcauugggcagauguuugagacaaccaugagaggagcuaagcgcauggccauccugggcgacacggccugggauuucgggucccuuggaggcguguuuacaucuaucgggaaagcucugcaucaagucuucggcgccauuuauggagcggcuuuuagcggcguguccuggaccaugaagauccucauuggggugguuaucaccuggauuggaaugaauagccggucuacaucccugagcgucucucuggugcuugugggcgucgugacccucuaccuggggguuauggugcaggccgacuccggaugugucgugagcuggaaaaacaaggagcugaaaugcggcuccgggaucuucaucacagauaauguucacacguggaccgaacaguauaaguuucagccugagucucccagcaagcucgccuccgcuauucaaaaagcccacgaagagggcaucuguggaauuagaucugugacacgccuggaaaaccuuauguggaagcagaucaccccggagcugaaucauauucucagcgagaacgaagucaaacugacaaucaugaccggcgacaucaaggggauuaugcaggcuggaaaacggucccugagaccucagcccacggagcuuaaguacagcuggaaaaccuggggcaaggccaagaugcucucuacagaacugcacaaucauaccuuccugaucgaugggccugagacagcggaaugccccaacgccaaucgcgcuuggaacucccucgagguggaggacuauggauuuggcguuuucaccacaaauauuuggcugaaacuuaaggaacggcaagaugccuuuugugacagcaaacugaugucugcugccaucaaggacaacagagcggugcacgccgauaugggcuacuggauugaguccgcucucaacgacaccuggaaaaucgaaaaggccagcuucaucgaggucaagucuugccacuggccuaaaagccauacgcugugguccaauggggugcuggagagcgaaaugauuauccccaagaacuucgcuggaccggugucucagcacaauuaucgcccuggcuaccauacacagaccgccgggcccuggcaccuuggacggcucgagauggauuuugacuucugugaaggcaccacagucguugugaccgaggauugcgggaacagaggacccucccugcggacgacaaccgccagcggcaaacugauuacagaauggugcugucgcuccugcacccucccuccgcugagauaccggggcgaggacggguguugguauggaauggagaucagaccccuuaaggaaaaagaggaaaaucuggugaacucucucgucacagcuggccaugggcagauugauaauuuuagccugggagugcugggcauggcgcuuuuccucgaggaaaugcugcgcacccggguugggacgaagcacgccauccugcucguggcugucuccuuugugacccugauuacaggaaacaugucuuucagagaccuuggccgcguuauggugauggucggcgccaccaugacagaugacaucgggaugggagugaccuaccuggcccuccuggcugccuuuaagguuagaccuacguucgcggcuggccugcuucugcggaaacucacaagcaaggagcugaugaugaccacaaucgggauuacccuccugucccaaucuaccauccccgagacaauucuugaacugacggaugcccucgcccugggaaugauggugcugaaaaucguccgcaauauggagaaguaucagcuugcugugaccauuauggccauccugugcgugccuaacgcggucauccuccagaaugcuuggaaaguuagcuguacaacccuggccgugguguccgucagcccccuccugcuuacaucuucccaacagaaggccgacuggauuccucuggcucucaccaucaagggccugaaccccacggccauuuuucugacaacccuuagcagaaccucuaaaaagcgguccuggccgcugaaugaagcuaucauggccguggggaugguuagcauucucgcgucuucccugcucaaaaacgauaucccuaugacaggaccccugguggccggcggccuucugaccgucugcuacgugcugacagggcgcagcgcugaccucgagcuggaaagagccgcugacguucggugggaggagcaggccgaaaucuccggaagcucuccuauucuuagcaucacgauuuccgaggauggcucuaugagcaucaagaaugaagaggaggaacagacccugacaauucucauccgcaccgggcugcucgugauuuccggacuguuccccgucucuaucccgaucacagccgcugcgugguaucuuugggaggugaaaaagcaaagagccggcguccugugggacgugccuucucccccucccguugaaaaagcugagcuggaagauggggccuaccggauuaagcagaagggaauccucggcuauucccagauuggcgccgggguguacaaagagggaaccuuucacacgauguggcaugucacccgcggcgcugugcugaugcacaaggggaaaagaaucgagcccuccugggccgacguuaagaaagaucuuauuagcuacggaggcggguggaagcuggaaggagaguggaaggaaggcgaggaagugcagguccucgcgcuggagccuggcaaaaacccgcgggcugugcaaacaaagcccggacucuucaaaaccuccacaggaaccaucggcgccgugagccuggacuuuucuccugggacauccggaagccccaucguugauaagaaaggcaaggucguggggcuuuauggaaacggcguggucacgagaucuggcaccuacguguccgccauugcucagacagaaaagagcaucgaagacaauccugagauugaagaugacaucuuccgcaaaaagcggcugaccauuauggaucugcaucccggggccggaaaaaccaagagauaucucccugcgaucguucgcgaggcuaucaaacggggccugagaacacuuauucuggccccgacgcgcguggucgccgcugaaauggaggaggcccuccgggggcugcccaucagauaccagaccccugcuauucgcgccgaacacacaggacgggagaucguggaccucaugugucaugcgaccuucacaaugagacugcuuucccccauucggguuccuaacuauaaucugaucauuauggaugaagcccacuuuaccgaccccgcuucuaucgccgcucgcggcuacaucagcacgagaguggagauggggaaggccgccggcauuuucaugacagcuaccccgccuggaucccgggaccccuuuccccagagcaacgcgccuaucauggaugaggaacgcgagauucccgaaagaucuuggaauagcggccacgagugggucaccgacuucaaggggaaaacagugugguuuguuccuagcaucaaggccggaaacgauauugcugccugccugcggaaaaauggcaagaaagugauccaacucucuagaaagaccuucgacuuugaauauaucaagacacgcaccaacgauugggacuucgucgugacgacagauauuagcgagaugggggccaauuuuaaagcugagcgggugaucgacccgagacgcuguaugaagcccgucauucugaccgauggagaagaacggguuauccuugccggcccuaugcccgugacacauuccucugcggcucagagacgcgggcgggugggcagaaacccuaaaaaugaaaacgaccaguacauuuacaugggagagccccuggaaaaugaugaggacugcgcccacuggaaggaggccaaaaugcuccuggacaacaucaauaccccggaaggcaucauuccuagcauguucgagcccgaacgcgagaaggucgaugcuaucgacggggaauauagacugcggggagaggcccgcaaaacguuuguggaucucaugagacggggcgaccuuccuguuuggcuggcguaccgcguggccgcugaggggauuaacuaugccgauagacggugguguuucgacggagucaagaacaaucaaauccuggaagagaacguggaaguugagauuuggaccaaggagggcgaacgcaaaaagcucaaaccccgcuggcuggaugcucggaucuacuccgacccucuugcccugaaggaguucaaagaauuugcugccgggagaaagucucucacacugaaucugauuaccgagaugggccgccuccccacauucaugacccagaaggcgcggaacgcccuugauaaucuggcugugcugcauacagccgaagcuggaggcagagccuauaaccacgcccucagcgagcugccggagacccuugaaacgcugcuccugcugacacuccuugcuaccgucaccgggggaaucuuucuguuccugauguccggcaaagggaucggaaagaugacacucggcaugugcugcauuaucaccgcgagcauucugcuuugguacgcccagauccagccucacuggauugcugccucuaucauccuggaguuuuuccucauugugcugcugauccccgaacccgagaaacaacggacaccucaggacaaucagcucacguaugucgugauugccauccuuaccguuguggcugccacaauggcgaacgaaaugggcuuucuggagaagaccaaaaaggauuucgggcugggauccauuacaacccagcaaccggagagcaauauccucgacaucgaucugcgccccgccuccgcuuggacgcuuuacgccguggcuaccacauuuauuaccccuaugcugagacauucuaucgaaaacagcuccgucaauguuucucucacagccauugcgaaccaggccaccgugcugaugggccuggggaagggauggccccucagcaaaauggacaucggcgugccucuucuggcuauuggguguuacucccaggucaaucccaucacgcugacagccgcucuccugcuucugguggcccacuaugcuauuaucggaccuggccuccaggccaaggcgacccgggaggcccaaaaacgcgcugccgcuggcaucaugaagaacccgacaguugacgggauuaccgugaucgaucuggaccccauuccuuacgaucccaaauucgaaaagcagcugggacaggucaugcuccuugugcugugcgucacccaggugcugaugaugagaacaacgugggcccucugugaggcccugacccuugcgacaggcccuaucagcacccugugggaagggaaucccggacgguuuuggaacacaaccauugcuguuucuauggccaauaucuuccgcggcuccuaucucgcuggggccggacugcuguuuagcaucaugaagaacacggccaacacaagacggggcaccggcaauaccggggagacacucggagagaaauggaagaaccgccuuaaugcucugggcaaaucugaguuccaaauuuacaagaaauccgggauccaggagguggacagaacccuggccaaggaaggaauuaaacggggcgagacagaucaucacgcggucagcagagggucugccaagcuccgcugguucguggagcggaaccugguuacgccggaaggaaagguggucgaccuuggcugcggcagagggggauggagcuauuacuguggcgggcugaaaaaugugaaggaggugaaaggacucaccaagggcgggccuggacaugaagaacccauccccauguccacauauggcuggaaccugguucgccugcagucuggcgucgauguguuuuucaccccucccgaaaaaugcgacacacuccuuugugauauuggggagagcuccccuaauccgaccguggaggcuggacggacgcugagaguccugaaccucguugaaaauuggcugaacaauaacacccaauuuugcaucaaggugcuuaaucccuacaugccuagcgugaucgagaagauggaagcccugcagcgcaaauacggcggggcucucguccggaacccccuguccagaaauucuacacacgagauguauugggugagcaacgccuccggaaacauuguuucuagcgugaauaugaucucccgcaugcugauuaaccgguucaccaugagacacaagaaagcgacauacgaaccugacgucgaucucggcucugggacccgcaauaucggaauugagagcgagacacccaaccuugacaucaucggcaagcggauugagaaaaucaagcaggagcaugaaaccuccuggcacuaugaucaggaccauccguacaagacgugggccuaucacggcagcuacgagacaaaacaaaccgggucugcuuccagcauggugaauggaguugugagacugcugaccaagccuugggacgucauucccauggugacacagauggccaugacggauaccacaccuuuuggccagcagcgcguguucaaagaaaaggucgacaccagaacacaagagcccaaagaggggaccaagaagcucaugaaaaucacagcugaauggcuguggaaggagcuuggcaaaaagaaaaccccucggauguguacgcgcgaagaguuuaccagaaagguucggucuaacgccgcucugggcgccauuuucacagaugagaauaaauggaaguccgcgagagaagccguggaggacagcggguuuugggaacucguggauaaggagcggaaccugcaccuggaaggaaaaugcgagaccugugucuauaauaugaugggcaagcgcgagaaaaagcucggcgaguucgggaaagcuaagggaucuagagccaucugguacauguggcugggcgcucgguuucuugaguucgaagcccugggguuucucaacgaggaccauugguucucccgcgaaaauagccuguccggaguggagggcgaggggcuucacaagcugggcuacauucucagagauguuagcaaaaaggaaggaggcgccauguaugcggacgauacagcugggugggacacccggaucacgcuggaggaucugaaaaacgaagagauggugacaaaucauauggaaggagagcacaagaaacucgccgaggccaucuucaagcugaccuaccagaacaaggucgugcgcguucagagacccacaccgcggggcaccgugauggacauuaucucucgcagagaccagcgggggagcggacaagucgugacguauggccuuaauaccuuuacaaacauggaagcucagcugauucgccagauggagggggaaggcguuuucaaauccauccaacagcucaccgugacagaggagauugccgucaagaacuggcuggugaccgucggaagagaacggcuuucucgcauggcuaucagcggcgaugacugcgugguuaaaccucuggaugacagauuugccuccgcgcucacagcccugaaugauauggggaaggugcggaaagacauccagcagugggagcccucuagaggauggaacgauuggacccaaguccccuucugcagccaucacuuucacgaacugauuaugaaggacggccgcgugcucgugguuccuugucggaaucaggaugagcugaucgggagagcucgcauuucccagggagccggcuggucucuucgggaaacggcuugccugggaaagagcuacgcccagauguggucccucauguauuuccauagacgcgaccugcggcuugcggccaacgcuaucuguagcgccgugccgucucacuggguccccacauccagaaccaccuggagcauucaugcuacacacgaguggaugaccacagaggauaugcugacgguguggaaucgcguuuggauccaagaaaacccuuggauggaggacaaaacccccgugggcucuugggaagagaucccuuaccucggaaagcgggaagaucaguggugcggcucccugauugggcugacaagcagagccaccugggcuaaaaauauccagacagccauuaaccagguccgcucccucaucggaaaugaggaguauaccgacuacaugcccucuaugaagcgguuuagacgggaagaggaagaggcgggcgugcugugguga

SEQ ID NO: 20220 - RNA, 9876 nt, Artificial Sequence
  derived and/or modified CDS sequence (opt5) from DENV-2__KC762674__SS-prME
acagccggcaucauuaucaugaugauucccacagugauggcuuuccaccugacgaccagaaacggggagccucauaugaucgugagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagauugugcagccugaaaaccuggaguacacgaucgugauuacaccccauucuggcgaagagaaugccgucgggaacgauacaggaaaacacggcaaggagaucaaagugaccccucaguccagcaucacagaagcugagcucaccggcuaugggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucaugccaagaaacaggauguugugguccugggaagccaagagggcgccaugcacacggcucucacaggggcgaccgaaauccagauguccucuggcaaccugcuuuuuacaggacaucugaagugcagacuccggauggacaaacugcagcuuaagggcaugagcuacuccauguguaccgggaaauucaagguggucaaggagauugccgaaacccaacacggaacaaucgugauuagaguucaguaugagggcgacgggagccccugcaaaauccccuucgagaucauggaucuggaaaagcgccaugugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaccaaguguucggggcgauuuacggcgcugccuuuagcggaguguccuggacgaugaagauccucauuggcguugucaucacauggauugggaugaauagccggucuaccucccugagcgugucucuggugcuugucggagugguuacccucuaucugggcgugaugguccaggccgacuccgggugugugguuagcuggaaaaacaaggagcugaaaugcggauccggcaucuucaucacagauaaugugcacaccuggacagaacaguacaaguuucagccugagucucccagcaagcucgcuuccgccauucaaaaagcucaugaagaggggaucuguggcauuagaucugucacgcgccuggaaaaccuuauguggaagcagaucaccccggagcugaaucacauucucagcgagaacgaagugaaacugacaaucaugaccggagacaucaagggcauuaugcaggccgggaaacggucccugagaccucagcccacagagcuuaaguauagcuggaaaaccuggggaaaggcgaagaugcucucuacggaacugcauaaucacaccuuccugaucgauggcccugagacagccgaaugccccaacaccaaucgcgcuuggaacucccucgagguugaggacuacggguuuggaguguucacaaccaauauuuggcugaaacuuaaggaacggcaagaugucuauugugacagcaaacugaugucugccgcuaucaaggacaacagagccgugcacgcggauaugggcuacuggauugaguccgcccucaacgacacauggaaaaucgaaaaggcuagcuuuaucgaggugaagucuugcuauuggccuaaaagccauacccugugguccaauggcguccuggagagcgaaaugauuauccccaagaacuucgccgggccgguuucucagcacaauuaccgcccuggauaccauacgcagacagcuggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaucggggcgaggacggcuguugguacgggauggagaucagaccccuuaaggaaaaagaggaaaaucuggugaacucucucguuaccgccggacauggccagauugauaauuucagccugggggugcugggaauggcucuuuuucucgaggaaaugcugcgcacacgggucggcaccaagcacgcgauccugcucguggccguuuccuucgugacgcugauuaccgggaacaugucuuuuagagaccuuggacgcgucauggugaugguuggcgcuacaaugaccgaugacaucggcaugggggugacauaucuggcccuccuggccgcuuucaaggucagaccuaccuuugccgcgggacugcuucugcggaaacucacgagcaaggagcugaugaugacaaccaucggcauugugcuccugucccaaucuacaauccccgagaccauucuugaacugaccgaugcucucgcccuggggaugauggcccugaaaaucgugcgcaauauggagaaguaccagcuugcugucacaauuauggccauccugugcguuccuaacgcggugauccuccagaaugcuuggaaagugagcuguacgacccuggccgucguguccguuagcccccuccugcuuacaucuucccaacagaaggccgacuggauuccucuggcucucaccaucaagggacugaaccccacagccauuuuccugaccacgcuuagcagaacaucuaaaaagcgguccuggccgcugaaugaagcuaucauggccgugggcauggucagcauucucgcgucuucccugcucaaaaacgauaucccuaugaccgggccccugguggccggaggccuucugaccguuugcuaugugcugacaggccgcagcgcugaccucgagcuggaaagagccgcugacguccggugggaggagcaggccgaaaucuccgggagcucuccuauucuuagcaucaccauuuccgaggauggaucuaugagcaucaagaaugaagaggaggaacagacacugacgauucucauccgcaccggccugcucgugauuuccgggcuguuucccgucucuaucccgaucacagccgcugcgugguaccuuugggaggugaaaaagcaaagagccggaguucugugggacgugccuucucccccucccgucggcaaagcugaacuggaggauggggccuaucggauuaagcagaagggaauccucggcuacucccagauuggcgccgggguguacaaagaaggaaccuuccacacaauguggcauguuacccgcggcgcugugcugaugcacaaggggaaaagaaucgagcccuccugggccgacgucaagaaagaucuuauuagcuauggaggcggguggaagcuggagggagaauggaaggagggcgaagagguccaggugcucgcgcuggaaccuggcaaaaacccgcgggcuguucaaacgaagcccgggcucuuuaaaaccaacacaggaaccaucggcgccgucucccuggacuucagcccugggacaucuggaucccccaucguggauaagaaaggcaagguggucgggcuuuacggaaauggcgugguuaccagaagcggcacauaugugucugccauugcucagacggagaaguccaucgaggacaacccugaaauugaggaugacaucuuucgcaaaaagcggcugaccauuauggaucugcaucccggggccggaaaaacaaagagauaccucccugcgaucguccgcgaagcuaucaaacggggccugagaacccuuauucuggccccgacccgcgugguugccgcugagauggaagaggcccuccgggggcugcccaucagauaucagaccccugcuauucgcgccgagcacacgggacgggaaaucguggaccucaugugucaugcgaccuucacaaugagacugcuuagccccauucgggucccuaauuacaaccugaucauuauggaugaggcccacuucaccgaccccgcuuccaucgccgcucgcggcuauaucucuacaagaguggaaaugggggaggccgccggcauuuuuaugaccgcuacgccgccuggaagccgggaccccuucccccaguccaaugcgccuaucauggaugaggaacgcgagauucccgaaagaagcuggaacucuggccacgaguggguuacagacuuuaaggggaagaccgugugguucgucccuuccaucaaagccggaaaugauauugcugccugccugcggaagaacggcaaaaaggugauccaacucagcagaaaaaccuuugacuucgaauacaucaagacacgcaccaaugauugggacuuuguggucacaaccgauauuucugagaugggggccaacuucaaggcugagcggguuaucgacccgagacgcuguaugaaacccgugauucugacggauggagaagaacgggugauccuugccggcccuaugcccgucacacauagcuccgcggcucagagacgcgggcgggugggcagaaauccuaagaacgaaaaugaccaguacauuuauaugggagagccccuggaaaacgaugaggacugcgcccacuggaaagaggccaagaugcuccuggacaauaucaacaccccggaaggcaucauuccuucuauguuugagcccgaacgcgagaaaguugaugcuaucgacggggaauacagacugcggggagaggcccgcaagacauucguggaucucaugagacggggcgaccuuccugucuggcuggcguaucgcguggccgcugaggggauuaacuacgccgauagacggugguguuuugacggaguuaaaaauaaccaaauccuggaagagaauguggaagucgagauuuggaccaaggagggcgaaagaaagaaacucaagccccgcuggcuggaugcucggaucuauagcgacccucuugcccugaaagaguucaaggaguucgcugccgggagaaaaucccucacgcugaaccugauuaccgagaugggccgccuccccacauuuaugacccagaaggcgcggaaugcccuugauaaccuggcugugcugcauacagccgaagcuggaggcagagccuacaaucacgcccucucugagcugccggagacccuugaaacacugcuccugcugacccuccuugcuacggucacagggggaaucuuccuguuucugaugagcggcaaggggaucggaaaaaugacccucggcaugugcugcauuaucaccgcguccauucugcuuugguaugcccagauccagccucacuggauugcugccagcaucauccuggaguucuuucucauugugcugcugauccccgaacccgagaagcaacggacaccucaggacaaccagcucaccuacguugugauugccauccuuacaguggucgcugccacgauggcgaaugaaaugggcuuccuggagaaaaccaagaaagauuuugggcugggaucuauuacaacccagcaaccggaguccaacauccucgacaucgaucugcgccccgccagcgcuuggacacuuuacgccguugcuaccacguucauuaccccuaugcugagacauuccaucgaaaauucuagcgugaacgugucccucacagccauugcgaaucaggccaccguccugaugggccuggggaagggauggccccucucuaagauggacaucggcgugccucuucuggcuauuggguguuauagccagguuaaccccaucacacugaccgccgcucuccugcuucugguggcccacuacgcuauuaucggaccuggccuccaggccaaagcgacgcgggaggcccaaaagcgcgcugccgcuggcaucaugaaaaauccgacagucgacgggauuaccgugaucgaucuggaccccauuccuuaugaucccaaguuugaaaaacagcugggacaggucaugcuccuugugcugugcguuacacaggugcugaugaugagaaccaccugggcccucugugaggcccugacacuugcgacgggcccuaucuccacccugugggaagggaaccccggacgguucuggaauacaaccauugcugucagcauggccaacaucuuucgcggcucuuaccucgcuggggccggacugcuguucuccaucaugaagaacacagccaauaccagacggggcacgggcaacacaggggagacccucggagagaaguggaaaaaucgccuuaacgcucugggcaagagcgaauuucaaauuuauaaaaagucugggauccaggagguggacagaacccuggccaaagaaggaauuaagcggggcgagacagaucaucacgcgguuuccagagggagcgccaaacuccgcugguucguggagcggaaucuggucaccccggaaggaaaggugguggaccuuggcugcggcagagggggauggucuuacuauuguggcgggcugaagaacguuaaagaggucaagggacucacaaaaggcgggccuggacaugaggaacccauccccaugagcacguacggcuggaaucuggugcgccugcaguccggcguggaugucuucuuuaccccucccgaaaagugcgacacacuccuuugugauauuggggagucuagcccuaacccgaccguugaggcuggacggacacugagagugcugaaucucguggaaaacuggcugaauaacaauacccaauucugcaucaaaguccuuaaccccuacaugccuuccgugaucgagaagauggaagcccugcagcgcaaguauggcggggcucucguucggaauccccugagcagaaacuccacgcacgagauguacugggugucuaacgccagcggaaauauugucuccucugugaacaugaucagccgcaugcugauuaaucgguuuaccaugagacacaaaaaggcgacauaugaaccugacguugaucucggcuccgggacccgcaacaucggaauugagucugagauccccaaucuugacaucauuggcaaacggaucgaaaagauuaaacaggagcaugaaacaagcuggcacuacgaucaggaccauccguauaagaccugggccuaccacggcuccuaugagacaaagcaaaccgggagcgcuucuuccauggugaacggagucgugagacugcugacgaaaccuugggacgugauccccauggucacacagauggccaugaccgauaccacaccuuucggccagcagcgcguuuuuaaggaaaaaguggacacgagaacccaagagcccaaggaggggaccaaaaagcucaugaagauuaccgcugaauggcuguggaaagagcuuggaaagaaaaagacaccucggauguguacccgcgaagaguucacaagaaaagugcggagcaaugccgcucugggcgccaucuuuaccgaugagaacaaguggaaaucugcgagagaagccgucgaggacuccggguucugggaacucguggauaaggagcggaaucugcaccuggaaggaaagugcgagacguguguuuacaacaugaugggcaaacgcgagaagaaacucggcgaauuugggaaggcuaaaggaagcagagccauuugguacauguggcugggcgcucgguuccuugaguuugaagcccugggguuccucaaugaggaccauugguuuucucgcgaaaacucccugagcggaguggagggcgaggggcuucacaagcugggcuauauccucagagaugucuccaagaaagaaggaggcgccauguacgcggacgauaccgcugggugggacacacggaucacccuggaggaucugaagaaugaagagauggugacaaaccauauggaaggagagcacaaaaagcucgccgaggccauuuucaaacugaccuaucagaauaagguugugcgcguccagagacccacgccgcggggcacagugauggacaucauuagccgcagagaccagcgggggucuggacaaguugugaccuacggccuuaacacauucaccaacauggaagcucagcugauccgccagauggagggggaaggcgucuuuaagagcauucaacagcucacggugaccgaggagaucgccgucaaaaauuggcuggugagaguuggacgggaacgccuuuccagaauggcuaucucuggcgaugacugcguggucaagccucuggaugaccgguucgccagcgcgcucacagcccugaacgauauggggaaagugagaaaggacauucagcagugggagcccucccgcggauggaaugauuggacccaagugcccuuuugcucucaucacuuccacgaacugaucaugaaagacggccggguucucguggucccuuguagaaaccaggaugagcugauugggcgcgcucggaucagccagggagccggcuggucccuuagagaaacagcuugccuggggaagucuuaugcccagauguggagccucauguacuuucaucgccgggaccugagacuugcggccaaugcuauuuguuccgccgugccgagccacuggguucccaccucucgcacaaccugguccauccaugcuacgcacgaguggaugacaaccgaggauaugcugaccguguggaaccgggucuggauccaagaaaauccuuggauggaggacaagacacccguggaaagcugggaggaaauuccuuaucucggcaaaagagaggaucaguggugcggaucucugaucggccugaccucccgcgccacaugggcuaagaacauucagacggccaucaaucagguccggagccucauugggaacgaggaauacaccgacuacaugcccuccaugaaaagauuccggagagaggaagaggaagcgggagugcugugguga

SEQ ID NO: 20221 - RNA, 9876 nt, Artificial Sequence
  derived and/or modified CDS sequence (opt5) from DENV-2__KC762672__SS-prME
accgccggaaucauuaucaugaugauucccaccgugauggcuuuccaccugacgaccagaaauggggaaccucauaugaucgugagccggcaggaaaagggaaaaucccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcugggagaacaaagaacugaagugcggauccggcaucuucaucacagauaaugugcacaccuggacagagcaguauaaauuucagccugaaucucccagcaagcucgcuuccgccauucaaaaggcucacgaggaagggaucuguggcauuagaucugucacgcgccuggagaaccuuauguggaaacagaucaccccggagcugaaucauauucucagcgaaaacgaggugaagcugacaaucaugaccggagacaucaaaggcauuaugcaggccgggaagcggucccugagaccucagcccacagaacuuaaauacagcuggaaggcguggggaaaagccaagaugcucucuaccgagcugcacaaucauacguuccugaucgauggcccugaaaccgcugagugccccaacacaaaucgcgccuggaacucccucgagguugaagacuauggguuuggaguguucaccacaaauauuuggcugaaacuuaaagagcggcaagaugucuuuugugacagcaagcugaugucugcugccaucaaagacuccagagcggugcacgccgauaugggcuacuggauugaaagcgcucucaacgacaccuggaagaucgagaaagccucuuucaucgaggucaagagcugccacuggccuaagucccauacacuguggagcaacggcguccuggaaucugagaugauuauccccaaaaauuucgcugggccgguuucccagcacaacuaucgcccuggauaccauacccagacggccggccccuggcaccuugggcggcucgaaauggauuuugacuucugugagggaacaaccgugguggucaccgaagauugcggcaauagagggcccagccugcggacaaccacggccuccggaaagcugauuacagaguggugcugucgcucuugcacccucccuccgcugagauaccggggcgaggacggcuguugguaugggauggaaaucagaccccuuaaagagaaggaagagaaccuggugaauagccucguuacagcuggacauggccagauugauaacuuuucccugggggugcugggaauggcgcuuuuccucgaagagaugcugcgcacccgggucggcacaaaacacgccauccugcucguggcuguuucuuuugugacccugauuacggggaauaugagcuucagagaccuuggacgcgucauggugaugguuggcgccaccaugacagaugacaucggcaugggggugaccuaccuggcccuccuggcugccuuuaaggucagaccuacauucgcggcuggacugcuucugcggaagcucaccuccaaagagcugaugaugacgacaaucggcauugugcuccugucucaagccaccauccccgaaacaauucuugagcugaccgaugcccucgcucuggggaugauggugcugaagaucguccgcaacauggaaaaauaucagcuugccguuaccauuauggcgauccugugcgugccuaaugcugugauccuccagaacgccuggaaggucagcuguacaacgcuggccgugguuuccgugagcccccuccugcuuaccucuucccaacagaaagcugacuggauuccucuggcccucacaaucaagggacugaaucccaccgcuauuuuucugacaacccuuagcagaacgucuaagaaacgguccuggccgcugaacgaggccaucauggcggucggcauggugagcauucucgccucuucccugcucaagaaugauaucccuaugacagggccccugguugcuggaggccuucugaccgugugcuacguccugaccggccgcagcgccgaccucgaacuggagagagcugccgacgugcggugggaggaacaggccgagaucuccgggagcucuccuauucuuagcaucacaauuuccgaagauggaucuaugagcaucaaaaacgaggaggaagaacagacccugacaauucucauccgcacgggccugcucgucauuuccgggcuguuccccgugucuaucccgaucaccgcugcggccugguaucuuugggaaguuaagaaacaaagagcuggagugcugugggacgucccuucucccccucccgugggcaaggccgagcuggaagauggggccuaccggauuaaacagaagggaauccucggcuauucccagauuggcgcugggguuuacaaggagggaacauuucacaccauguggcaugugacacgcggcgccguccugaugcacaaagggaagagaaucgagcccuccugggcggacgugaaaaaggaucuuauuagcuacggaggcggguggaaacuggaaggagaguggaaggaaggcgaggaagugcagguucucgcucuggagccuggcaagaauccgcgggccguccaaaccaaacccggacucuucaagacgaacaccggaacaaucggcgccgugucccuggacuuuagcccugggaccucuggaucccccaucguggauaaaaagggcaaagucguggggcuuuauggaaacggcguugugacaagaagcggcaccuacgucucugcuauugcccagacagagaaguccaucgaagacaauccugagauugaagaugacaucuuccgcaagaaacggcugacgauuauggaucugcaucccggggcgggaaagaccaaaagauaucucccugcuaucgugcgcgaggccaucaagcggggccugagaacacuuauucuggccccgacccgcguuguggcugccgaaauggaggaggcucuccgggggcugcccaucagauaccagaccccugccauucgcgcggaacacacaggacgggagaucgucgaccucaugugucaugccacguucaccaugagacugcuuagccccauucgggugccuaacuauaaucugaucauuauggaugaagcucacuuuacagaccccgccuccaucgcugcccgcggcuacaucucuaccagaguugagaugggggaggccgcuggcauuuucaugacagcgaccccgccuggaagccgggaccccuuuccccaguccaacgccccuaucauggaugaagaacgcgaaauucccgagagaagcuggaacucuggccacgaaugggugacggacuucaaagggaagacagucugguuugugccuuccaucaaggcuggaaacgauauugccgccugccugcggaaaaauggcaagaaagugauccaacucagcagaaagaccuucgacuuugaguauaucaaaacccgcacaaacgauugggacuucgucguuaccacagauauuucugagaugggggcuaauuuuaaggccgaacgggugaucgacccgagacgcuguaugaagcccgugauucugaccgauggagaggaacgggucauccuugcgggcccuaugcccgugacgcauagcuccgcugcccagagacgcgggcggguuggcagaaacccuaaaaaugagaacgaccaguacauuuacaugggagaaccccuggagaaugaugaggacugcgcccacuggaaggaagcuaaaaugcuccuggacaacaucaauacaccggagggcaucauuccuucuauguucgaacccgagcgcgaaaagguggaugccaucgacggggaguauagacugcggggagaggcgcgcaaaaccuuugucgaucucaugagacggggcgaccuuccuguguggcuggccuaccgcguugcugccgaagggauuaacuaugcugauagacggugguguuucgacggagugaagaacaaucaaauccuggaggaaaacgucgagguggagauuuggacaaaagaaggcgagagaaagaagcucaaaccccgcuggcuggaugcccggaucuacagcgacccucuugcucugaaggaguucaaagaguuugccgcggggagaaagucccucacccugaaucugauuacggaaaugggccgccuccccaccuucaugacacagaaagcccggaacgcucuugauaaucuggccguccugcauaccgcugaggccggaggcagagccuauaaccacgcucucucugagcugccggaaacacuugagacccugcuccugcugacacuccuugcgaccgugacaggcgggaucuuucuguuccugaugagcgggaaggggaucggaaagaugacacucggcaugugcugcauuaucaccgccuccauucugcuuugguacgcucagauccagccucacuggauugccgccagcaucauccuggaauuuuuccucauuguucugcugauccccgagcccgaaaaacaacggaccccucaggacaaucagcucacauauguggugauugcuauccuuaccgucguugccgcgacaauggccaacgagaugggcuuucuggagaagacgaaaaaggauuucgggcugggaucuauuaccacacagcaaccggaauccaauauccucgacaucgaucugcgccccgcuagcgccuggacccuuuacgcuguggccacaaccuuuauuacgccuaugcugagacauuccaucgagaacucuagcgugaaugucucccucaccgcgauugccaaccaggcuacagugcugaugggccuggggaaaggauggccccucucuaagauggacaucggcguuccucuucuggccauuggguguuacagccaggugaaucccaucacccugacagcugcccuccugcuucuggucgcucacuaugccauuaucggaccuggccuccaggcgaaggccacccgggaagcucaaaaacgcgccgcugccggcaucaugaagaacccgacgguggacgggauuacagucaucgaucuggaccccauuccuuacgaucccaaauucgagaagcagcugggacaggugaugcuccuuguucugugcgugacccagguccugaugaugagaacaaccugggcccucugugaagcgcugacccuugcuacaggcccuaucuccacgcugugggaggggaaucccggacgguuuuggaacaccacaauugccgugagcauggcuaauaucuuccgcggcucuuaucucgccggggccggacugcuguuuuccaucaugaaaaacaccgcuaacacaagacggggcaccggcaaugccggggagacgcucggagaaaaguggaagaaccgccuuaaugcgcugggcaaaagcgaguuccaaauuuacaagaaaucugggauccaggaaguugacagaacacuggccaaggagggaauuaaacggggcgagaccgaucaucacgcuguguccagagggagcgccaagcuccgcugguucgucgaacggaaccuggugaccccggagggaaaagugguugaccuuggcugcggcagagggggauggucuuauuacuguggcgggcugaagaaugucaaggaagugaaaggacucacaaagggcgggccuggacaugaggaacccauccccaugagcaccuauggcuggaaccuggugcgccugcaguccggcgucgaugucuuuuucacaccucccgagaaaugcgacacgcuccuuugugauauuggggagucuagcccuaauccgaccguggaagcuggacggacacugagagugcugaaccucgucgagaauuggcugaacaauaacacccaauuuugcaucaaggugcuuaaucccuacaugccuuccguuaucgagaagauggaggcccugcagcgcaaguacggcggggcgcucgugcggaacccccugagcagaaauuccacacacgaaauguauugggucucuaacgccagcggaaacauuguguccucuguuaauaugaucagccgcaugcugauuaaccgguucaccaugagacacaagaaagcuacguacgagccugacguggaucucggcuccgggacccgcaauaucggaauugagucugaaacacccaaccuugacaucaucggcaagcggauugagaaaaucaagcaggaacaugagaccagcuggcacuaugaucaggaccauccguacaaaacaugggccuaucacggcuccuacgaaaccaagcaaacagggagcgcuucuuccauggucaauggaguggugagacugcugaccaagccuugggacgucauucccaugguuacgcagauggccaugacagauaccaccccuuuuggccagcagcgcguguucaaagagaagguggacacaagaacgcaagagcccaaagaagggaccaagaaacucaugaagaucacagcugaguggcuguggaaggaacuuggcaaaaagaaaaccccucggauguguacacgcgaggaguuugccagaaagguccggagcaacgcggcccugggcgcuauuuucaccgaugaaaauaaauggaagucugccagagaggcuguggaagacuccggguuuugggagcucguugauaaagaacggaaccugcaccuggagggaaagugcgagacauguguguauaauaugaugggcaagcgcgagaaaaagcucggcgaguucgggaaagccaagggaagcagagccaucugguacauguggcugggcgcgcgguuucuugaguucgaggcucugggguuucucaacgaagaccauugguucucucgcgaaaauagccugagcggagucgagggcgaagggcuucacaaacugggcuacauucucagagauguguccaugaaggagggaggcgccauguaugccgacgauaccgcugggugggacacgcggaucacccuggaagaucugaagaacgaggaaaugguuacaaaucauauggagggagagcacaaaaagcucgccgaagcuaucuucaaacugaccuaccagaacaaggugguccgcgugcagagacccacaccgcggggcaccguuauggacauuaucagccgcagagaccagcgggggucuggacaaguggucacguauggccuuaauacauuuaccaacauggaggcccagcugauucgccagauggaaggggagggcguguucaaaagcauccaacagcucacagucaccgaggaaauugcggugaagaacuggcugguuagagugggacgggagcgccuuuccagaauggccaucucuggcgaugacugcgucgugaagccucuggaugaccgguuugcuagcgcccucacggcucugaaugauauggggaaagugagaaaggacauccagcagugggaacccucccgcggauggaacgauuggacccaaguucccuucugcucucaucacuuucacgagcugauuaugaaagacggccgggugcucgucgugccuuguagaaaucaggaugaacugaucgggcgcgcccggauuagccagggagcgggcuggucccuuagagagacagccugccuggggaagucuuacgcucagauguggagccucauguauuuccaucgccgggaccugagacuugccgcuaacgccaucuguuccgcuguuccgagccacugggugcccaccucucgcacaaccugguccauucaugccacacacgaguggaugaccacggaagauaugcugacagucuggaaucggguguggauccaagagaacccuuggauggaagacaaaacccccgucgagagcugggaagagaucccuuaccucggcaagagagaggaucaguggugcggaucucugauuggccugaccucccgcgcgacaugggccaagaauauccagaccgcuauuaaccaggugcggagccucaucgggaaugaagaguauacagacuacaugcccuccaugaaaagauuucggagagaagaggaagaggccggaguucugugguga

SEQ ID NO: 20222 - RNA, 9876 nt, Artificial Sequence
  derived and/or modified CDS sequence (opt5) from DENV-2__KC762667__SS-prME
acagccggaaucauuaucaugaugauucccacagugauggcuuuccaccugacgaccagaaacggggagccucauaugaucgugagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggaagcagaucacaccggagcugaaucauauucucagcgagaacgaagugaaacugaccaucaugacaggagacaucaagggcauuaugcaggcugggaaacggucccugagaccucagcccaccgagcuuaaguacagcuggaaaacguggggaaaggccaagaugcucucuaccgaacugcacaaucauacauuccugaucgauggcccugagaccgcggaaugccccaacgccaaucgcgcuuggaacucccucgagguugaggacuauggguuuggaguguucacaaccaauauuuggcugaaacuuaaggaacggcaagaugccuuuugugacagcaaacugaugucugcugccaucaaggacaacagagcgguccacgccgauaugggcuacuggauugaguccgcucucaacgacacauggaaaaucgaaaaggccagcuucaucgaggugaagucuugccacuggccuaaaagccauacccugugguccaauggcgugcuggagagcgaaaugauuauccccaagaacuucgcugggccggucucucagcacaauuaucgcccuggauaccauacgcagacagccggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgcuggacauggccagauugauaauuuuagccuggggguucugggaauggcgcuuuuccucgaggaaaugcugcgcacacgggugggcaccaagcacgccauccugcucgucgcuguguccuuuguuacgcugauuaccgggaacaugucuuucagagaccuuggacgcgugauggucauggugggcgccacaaugaccgaugacaucggcauggggguuacauaccuggcccuccuggcugccuuuaaggugagaccuaccuucgcggcuggacugcuucugcggaaacucacgagcaaggagcugaugaugacaaccaucggcgucacacuccugucccaaucuaccauucccgagaccauccuugaacugacagaugcccucgcccuggggaugauggugcugaaaauugugcgcaauauggagaaguaucagcuugcugucacgaucauggccauucugugcguuccuaacgcggugauccuccagaaugcuuggaaagugagcuguaccacacuggccgucguguccguuagcccccuccugcuuaccucuucccaacagaaggccgacuggaucccucuggcucucacaauuaagggacugaaccccaccgccaucuuucugacgacacuuagcagaaccucuaaaaagcgguccuggccgcugaaugaagcuauuauggccgugggcauggucagcauccucgcgucuucccugcucaaaaacgauauuccuaugaccgggccccugguggccggaggccuucugacaguuugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacgcugaccauccucauucgcacaggccugcucgugaucuccgggcuguuccccgucucuauuccgaucaccgccgcugcgugguaucuuugggaggugaaaaagcaaagagccggaguucugugggacgugccuucucccccucccgucggcaaagcugaacuggaggauggggccuaccggaucaagcagaagggcauucucggcuauucccagaucggcgccgggguguacaaagaaggaacauuucacaccauguggcauguuacgcgcggcgcugugcugaugcacaaggggaaaagaauugagcccuccugggccgacgucaagaaagaucuuaucagcuacggaggcggguggaagcuggagggagaauggaaggagggcgaagagguccaggugcucgcgcuggaaccuggcaaaaacccgcgggcuguucaaaccaagcccggacucuucaaaacauccaccggaacaauuggcgccgucagccuggacuuuucuccugggaccuccggaagccccaucguggauaagaaaggcaagguggucgggcuuuauggaaacggcgugguuacaagaucuggcacguacguguccgccaucgcucagaccgaaaagagcauugaggacaauccugaaaucgaggaugacauuuuccgcaaaaagcggcugacaaucauggaucugcaucccggggccggaaaaaccaagagauaucucccugcgauuguccgcgaagcuaucaaacggggccugagaacccuuauccuggccccgacacgcgugguugccgcugagauggaagaggcccuccgggggcugcccauuagauaccagacgccugcuauccgcgccgagcacaccggacgggaaauuguggaccucaugugucaugcgacauucaccaugagacugcuuucccccauccgggucccuaacuauaaucugauuaucauggaugaggcccacuuuacagaccccgcuucuauugccgcucgcggcuacaucagcaccagaguggaaaugggggaggccgccggcaucuucaugacggcuacaccgccuggaucccgggaccccuuuccccagagcaacgcgccuauuauggaugaggaacgcgagauccccgaaagaucuuggaauagcggccacgaguggguuaccgacuucaaggggaagaccgugugguuugucccuagcauuaaagccggaaacgauaucgcugccugccugcggaagaauggcaaaaaggugauucaacucucuagaaaaacauucgacuuugaauauaucaagacccgcacaaacgauugggacuucguggucaccacggauaucagcgagaugggggccaauuuuaaggcugagcggguuauugacccgagacgcuguaugaaacccgugauccugacagauggagaagaacgggugauucuugccggcccuaugcccgucacccauuccucugcggcucagagacgcgggcgggugggcagaaacccuaagaaugaaaacgaccaguacaucuacaugggagagccccuggaaaaugaugaggacugcgcccacuggaaagaggccaagaugcuccuggacaacauuaauacaccggaaggcaucaucccuagcauguucgagcccgaacgcgagaaaguugaugcuauugacggggaauauagacugcggggagaggcccgcaagaccuuuguggaucucaugagacggggcgaccuuccugucuggcuggcguaccgcguggccgcugaggggaucaacuaugccgauagacggugguguuucgacggaguuaaaaacaaucaaauucuggaagagaacguggaagucgagaucuggacgaaggagggcgaaagaaagaaacucaagccccgcuggcuggaugcucggauuuacuccgacccucuugcccugaaagaguucaaggaauuugcugccgggagaaaaucucucacccugaaucugaucacagagaugggccgccuccccaccuucaugacacagaaggcgcggaacgcccuugauaaucuggcugugcugcauaccgccgaagcuggaggcagagccuauaaccacgcccucagcgagcugccggagacacuugaaacccugcuccugcugacgcuccuugcuacagucaccgggggaauuuuucuguuccugauguccggcaaggggaucggaaaaaugacccucggcaugugcugcaucauuacagcgagcauccugcuuugguacgcccagauucagccucacuggaucgcugccucuauuauccuggaguuuuuccucaucgugcugcugauucccgaacccgagaagcaacggaccccucaggacaaucagcucacauauguugugaucgccauucuuacgguggucgcugccaccauggcgaacgaaaugggcuuucuggagaaaacaaagaaagauuucgggcugggauccaucaccacacagcaaccggagagcaauauucucgacaucgaucugcgccccgccuccgcuuggacccuuuacgccguugcuacgaccuuuaucacaccuaugcugagacauucuauugaaaacagcuccgugaaugugucucucaccgccaucgcgaaccaggccacaguccugaugggccuggggaagggauggccccucagcaagauggacauuggcgugccucuucuggcuaucggguguuacucccagguuaaucccauuacccugacggccgcucuccugcuucugguggcccacuaugcuaucauuggaccuggccuccaggccaaagcgacacgggaggcccaaaagcgcgcugccgcuggcaucaugaaaaacccgaccgucgacgggaucacagugauugaucuggaccccaucccuuacgaucccaaguucgaaaaacagcugggacaggucaugcuccuugugcugugcguuacccaggugcugaugaugagaaccacaugggcccucugugaggcccugacgcuugcgaccggcccuauuagcacacugugggaagggaaucccggacgguuuuggaacaccacaaucgcugucucuauggccaauauuuuccgcggcuccuaucucgcuggggccggacugcuguuuagcaucaugaagaacaccgccaacacgagacggggcacaggcaauaccggggagacccucggagagaaguggaaaaaccgccuuaaugcucugggcaagucugaguuccaaaucuacaaaaaguccgggauucaggagguggacagaacacuggccaaagaaggaaucaagcggggcgagaccgaucaucacgcgguuagcagagggucugccaaacuccgcugguucguggagcggaaccuggucacaccggaaggaaaggugguggaccuuggcugcggcagagggggauggagcuauuacuguggcgggcugaagaauguuaaagaggucaagggacucacgaaaggcgggccuggacaugaggaacccauucccauguccaccuauggcuggaaccuggugcgccugcagucuggcguggaugucuuuuucacaccucccgaaaagugcgacacccuccuuugugauaucggggagagcuccccuaauccgacaguugaggcuggacggacccugagagugcugaaccucguggaaaauuggcugaacaauaacacgcaauuuugcauuaaaguccuuaaucccuacaugccuagcgugaucgagaagauggaagcccugcagcgcaaguacggcggggcucucguucggaacccccuguccagaaauucuacccacgagauguauugggugagcaacgccuccggaaacaucgucucuagcgugaauaugauuucccgcaugcugaucaaccgguucacaaugagacacaaaaaggcgaccuacgaaccugacguugaucucggcucugggacacgcaauauuggaaucgagagcgagacccccaaccuugacauuaucggcaaacggaucgaaaagauuaaaagagagcaugaaacauccuggcacuaugaucaggaccauccguacaagaccugggccuaucacggcagcuacgagacgaagcagacagggucugcuuccagcauggugaauggagucgugcgccugcugaccaaaccuugggacgugauccccauggucacccaaauggccaugacagauacgaccccuuuuggccagcagagaguuuucaaggaaaaaguggacacacggacccaggagcccaaggaggggaccaaaaagcucaugaagauuaccgcugaauggcuguggaaagagcuuggaaagaaaaagacaccucgcauguguaccagagaagaguuuacgcggaaagugagaucuaacgccgcucugggcgccaucuucaccgaugagaauaaguggaaauccgcgcgggaagccgucgaggacagcggguuuugggaacucguggauaaggagcgcaaccugcaccuggaaggaaagugcgagacauguguuuauaauaugaugggcaaaagagagaagaaacucggcgaguucgggaaggcuaaaggaucucgggccauuugguacauguggcugggcgcucgcuuucuugaguucgaagcccugggguuucucaacgaggaccauugguucuccagagaaaauagccuguccggaguggagggcgaggggcuucacaagcugggcuacauccuccgggaugucagcaagaaagaaggaggcgccauguaugcggacgauaccgcugggugggacacacgcauuacccuggaggaucugaagaacgaagagauggugacgaaucauauggaaggagagcacaaaaagcucgccgaggccaucuucaaacugacauaccaaaacaagguugugagaguccagcggcccaccccgcgcggcacagugauggacaucauuucuagacgggaccagcgcgggagcggacagguugugaccuauggccuuaauacguuuaccaacauggaagcucaacugaucagacagauggagggggaaggcgucuucaaguccauucagcaucucacagugaccgaggagaucgccgucaaaaacuggcuggugcggguuggacgcgaaagacuuucucggauggcuauuagcggcgaugacugcguggucaagccucuggaugacagauuugccuccgcgcucacagcccugaaugauauggggaaagugcgcaaggacauccaacagugggagcccucucggggauggaacgauuggacccaggugcccuucugcagccaccacuuucaugaacugaucaugaaagacggcagaguucucguggucccuugucgcaaucaggaugagcugauugggcgggcuagaaucucccaaggagccggcuggucucuucgcgaaacagcuugccugggaaagagcuacgcccagauguggucccucauguauuuccaccggagagaccugcgccuugcggccaacgcuauuuguagcgccgugccgucucauuggguucccaccucccggacgacauggagcauccacgcuacccacgaguggaugaccacagaggauaugcugaccguguggaauagagucuggauucaggaaaacccuuggauggaggacaagacacccguggaaucuugggaggaaaucccuuaccucggcaaacgcgaggaucaguggugcggaucccugaucggccugacgagccgggccaccugggcuaagaauauucaaacagccaucaaccaggucagaucccucauugggaaugaggaauauaccgacuacaugcccucuaugaaacgguuuagacgcgaggaagaggaagcgggagugcugugguga

SEQ ID NO: 20223 - RNA, 9876 nt, Artificial Sequence
  derived and/or modified CDS sequence (opt5) from DENV-2__KC762659__SS-prME
accgccggcaucauuaucaugaugauucccacagugauggcuuuccaccugacgaccagaaauggggaaccucauaugaucgucagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagguggugcagccugaaaaccuggaguauaccauugucaucacaccccacucuggcgaagagaaugcgguggggaacgauaccggaaaacauggcaaggagauuaaaguuacaccucaguccagcaucaccgaagccgagcucacgggcuacgggaccgugacaauggaauguucuccccggaccggacuggacuucaaugagaugguccuucugcagauggaaaacaaggcuuggcucgugcaccgccaaugguuucuggaucuuccgcugccuuggcuccccggcgccgacacacagggguccaacuggauccagaaagagacccugguuacguucaagaauccucacgcuaagaaacaggauguggucgugcugggaagccaagagggcgccaugcauacagcccucaccggggcuacagaaauucagauguccucuggcaaccugcuuuuuaccggacaccugaagugcagacuccggauggacaaacugcagcuuaagggcaugagcuauuccauguguaccgggaaauucaaggucgugaaggagaucgcggaaacacaacauggaacgauuguuaucagagugcaguacgagggcgacgggagccccugcaaaauucccuucgagaucauggaucuggaaaagcgccacguccucggacggcugaucaccgugaauccuauuguuacagagaaagacucuccggugaacaucgaagccgagcccccuuuuggcgauuccuacauuaucauuggggucgaacccggccagcugaagcucagcugguucaaaaagggaucuagcaucggccagauguuugagaccacaaugagaggggcuaagcgcauggccauucugggagacaccgccugggauuucggcucccuugggggaguguuuacgucuaucggcaaagcucugcaucaaguguucggggccaucuauggcgcggcuuuuagcggaguuuccuggacaaugaagauucucaucggcgucgugauuaccuggaucgggaugaauagccggucuaccucccugagcgugucucugguccuugugggaguugugacacucuaccugggcgucauggugcaggccgacuccggguguguugugagcuggaaaaacaaggagcugaaaugcggauccggcauuuucaucaccgauaauguccacacauggacggaacaguauaaguuucagccugagucucccagcaagcucgccuccgcuauccaaaaagcccacgaagaggggauuuguggcaucagaucugugacccgccuggaaaaccuuauguggaagcagauuacaccggagcugaaucauauccucagcgagaacgaaguuaaacugaccauuaugacaggagacaucaagggcaucaugcaggcugggaaacggucccugagaccucagcccaccgagcuuaaguacagcuggaaaacguggggaaaggccaagaugcucucuaccgaacugcacaaucauacauuccugauugauggcccugagaccgcggaaugccccaacacaaaucgcgccuggaacucccucgagguggaggacuauggguuuggagucuucaccacaaauaucuggcugaaacuuaaggaacggcaagauguguuuugugacagcaaacugaugucugcugccauuaaggacaacagagcugugcacgccgauaugggcuacuggauggaguccgcgcucaacgacaccuggaaaaucgaaaaggccagcuucauugaggucaagucuugccacuggccuaaaagccauacgcugugguccaauggcguucuggagagcgaaaugaucauccccaagaacuucgcugggccggugucucagcacaauuaucgcccuggauaccauacacagaccgccggccccuggcaccuugggcggcucgagauggauuuugacuucugugaaggaaccacaguggucgugaccgaggauugcggcaacagagggcccucccugcggacgacaaccgcuagcggaaaacugauuacagaauggugcugucgcuccugcacccucccuccgcugagauaccggggcgaggacggcuguugguaugggauggagaucagaccccuuaaggaaaaagaggaaaaucugguuaacucucucgugacagccggacauggccagauugauaauuuuagccuggggguccugggaauggcccuuuuccucgaggaaaugcugcgcacccgggugggcacgaagcacgcuauccugcucguugcgguguccuuugucacccugauuacagggaacaugucuuucagagaccuuggacgcgugaugguuauggugggcgccaccaugacagaugacaucggcaugggggucaccuaccuggcucuccuggccgccuuuaaggugagaccuacguucgcugccggacugcuucugcggcgccucacaagcaaagagcugaugaugaccacaauuggcaucgugcuccugucccaaucuaccauccccgagaccauucuugaacugacagaugcgcucgcucuggggaugaugguccugaagaucguuagaaaaauggagaaguaucagcuugccgugacgauuauggccauccugugcgugccuaaugcugucauucuccagaacgccuggaaagugagcuguaccacacuggcgguuguguccgucagcccccuccugcuuaccucuucccaacagaaggcugacuggaucccucuggcccucacaaucaagggacugaaucccaccgccauuuuucugacgacacuuagccggaccucuaaaaagcgcuccuggccgcugaacgaagcuaucauggccgugggcaugguuagcauucucgcuucuucccugcucaaaaaugauaucccuaugaccgggccccugguggccggaggccuucugacagucugcuacgugcugaccggcagaagcgcggaccucgagcuggaacgggccgcugacguccgcugggaggagcaggccgaaauuuccgggagcucuccuauccuuagcaucacaauuuccgaggauggaucuaugagcaucaagaacgaagaggaggaacagacgcugaccauucucaucagaacaggccugcucgugauuuccgggcuguuccccguuucuaucccgauuaccgcugccgccugguaucuuugggaggugaaaaagcaacgggcuggaguccugugggacgugccuucucccccucccguuggcaaagcggaacuggaggauggggccuaccgcaucaagcagaagggaauccucggcuauucccagauuggcgcugggguguacaaagaaggaacauuucacaccauguggcaugucacgagaggcgccgugcugaugcacaaggggaaacggaucgagcccuccugggccgacgugaagaaagaucuuauuagcuacggaggcggguggaagcuggagggagaauggaaggagggcgaagagguucagguccucgcucuggaaccuggcaaaaauccgagagccgugcaaaccaagcccggacucuucaaaacaaacaccggaacaaucggcgcggugucccuggacuuuagcccugggaccucuggaucccccauugucgauaagaaaggcaaggugguugggcuuuauggaaacggcguggucacacgcagcggcacguacgugucugcuaucgcccagaccgagaaguccaucgaggacaauccugaaauugaggaugacaucuuccggaaaaagagacugacaauuauggaucugcaucccggggccggaaaaaccaagcgcuaucucccugcuaucguucgggaagccauuaaaagaggccugcgcacccuuauccuggcgccgacacggguggucgcugccgagauggaagaggcccucagagggcugcccauccgcuaccagacgccugcuauucgggccgagcacaccggaagagaaaucguggaccucaugugucaugcuacauucaccaugcggcugcuuagccccauucgcguuccuaacuauaaucugaucauuauggaugaggcccacuuuacagaccccgcguccaucgccgcuagaggcuacauuucuacccggguggaaaugggggaggccgcuggcaucuucaugacggccacaccgccuggaagccgcgaccccuuuccccaguccaacgccccuaucauggaugaggaaagagagauucccgaacggagcuggaacucuggccacgagugggucaccgacuucaaggggaagaccgugugguuugugccuuccaucaaagcuggaaacgauauugcggccugccugagaaagaauggcaaaaaggucauccaacucagccgcaaaacauucgacuuugaauauauuaagacccggacaaacgauugggacuucguugugaccacggauaucucugagaugggggcuaauuuuaaggccgagagagugaucgacccgcgccgguguaugaaacccgucauucugacagauggagaagagagagugauccuugccggcccuaugcccguuacccauagcuccgcugcccagcgccgggggagagugggccgcaacccuaagaaugaaaacgaccaguacauuuacaugggagagccccuggaaaaugaugaggacugcgcgcacuggaaagaggcuaagaugcuccuggacaacaucaauacaccggaaggcauuaucccuucuauguucgagcccgaaagagagaaagucgaugccaucgacggggaauaucggcugcgcggagaggccagaaagaccuuuguggaucucaugcggcgcggcgaccuuccuguuuggcuggcuuacagaguggccgcggaggggauuaacuaugccgaucggagaugguguuucgacggagucaaaaacaaucaaauccuggaagagaacguggaagucgagauuuggacgaaggagggcgaacgcaagaaacucaagccccgguggcuggaugcuagaaucuacagcgacccucuugcccugaaagaguucaaggaauuugcugccgggcgcaaaucccucacccugaaucugauuacagagaugggccggcuccccaccuucaugacacagaaggcuagaaacgcccuugauaaucuggcggugcugcauaccgccgaagcuggaggccgggccuauaaccacgcucucucugagcugccggagacacuugaaacccugcuccugcugacgcuccuugccacaguuaccgggggaaucuuucuguuccugaugagcggcaaggggauuggaaaaaugacccucggcaugugcugcaucaucacagccuccauucugcuuugguacgcucagauccagccucacuggauugcggccagcaucauucuggaguuuuuccucaucgugcugcugauccccgaacccgagaagcaacgcaccccucaggacaaucagcucacauauguggucauugcuauccuuacgguuguggccgccaccauggcuaacgaaaugggcuuucuggagaaaacaaagaaagauuucgggcugggaucuauuaccacacagcaauccgagagcaauauccucgacauugaucugagaccggccuccgcguggacccuuuacgccguggcuacgaccuuuaucacacccaugcugcggcauucuaucgaaaacagcuccgucaaugugucucucaccgccauugcuaaccaggccacaguucugaugggccuggggaagggauggccucucagcaagauggacaucggcgugccccuucuggcgauuggguguuacucccaggucaauccuaucacccugacggccgcucuccugcuucugguggcccacuaugcuauuaucggacccggccuccaggccaaagcuacacgcgaggcccaaaagagagcggccgcuggcauuaugaaaaacccuaccgucgacgggaucacagugaucgaucuggacccgauucccuacgauccuaaguucgaaaaacagcugggacagguuaugcuccuugugcugugcgucacccaggugcugaugaugcggaccacaugggcccucugugaggcucugacgcuugccaccggccccaucagcacacugugggaagggaauccuggacgcuuuuggaacaccacaauugccguuucuauggcgaauaucuucagaggcuccuaucucgcuggggccggacugcuguuuagcauuaugaagaacaccgcuaacacgcggcgcggcacaggcaauaccggggagacccucggagagaaguggaaaaacagacuuaaugcccugggcaagucugaguuccaaaucuacaaaaaguccgggauccaggagguggaccggacacuggccaaagaaggaauuaagagaggcgagaccgaucaucacgcugucagccgcgggucugccaaacuccggugguucguggagagaaaccuggugacacccgaaggaaagguugucgaccuuggcugcggccgcgggggauggagcuauuacuguggcgggcugaagaaugugaaagaggugaagggacucacgaaaggcgggccgggacaugaagaaccuauccccauguccaccuauggcuggaaccugguccggcugcagucuggcguugauguguuuuucacacccccugaaaagugcgacacccuccuuugugauauuggggagagcucccccaauccuacaguggaggcgggaagaacccugcgcguccugaaccucguggaaaauuggcugaacaauaacacgcaauuuugcaucaaaguucuuaauccguacaugcccagcgugauugagaagauggaagcccugcagcggaaguacggcggggcucucgucagaaacccucugucccgcaauucuacccacgagauguauugggugagcaacgccuccggaaacaucguuucuagcgugaauaugaucucccggaugcugauuaacagauucacaaugcgccacaaaaaggcuaccuacgaacccgacgucgaucucggcucugggacacggaauaucggaauugagagcgagaccccuaaccuugacaucauuggcaaaagaaucgaaaagaucaaacaggagcaugaaacauccuggcacuaugaucaggaccaucccuacaagaccugggccuaucacggcagcuacgagacgaagcaaacagggucugcguccagcauggugaauggagugguccgccugcugaccaaaccgugggacguuauuccuauggugacccagauggccaugacagauacgacccccuuuggccagcagagaguguucaaggaaaaagucgacacacggacccaagagccuaaggaggggaccaaaaagcucaugaagaucaccgcugaauggcuguggaaagagcuuggaaagaaaaagacaccccgcauguguaccagagaagaguuuacgcggaaagugagaucuaacgccgcucugggcgccauuuucaccgaugagaauaaguggaaauccgcucgggaagccguugaggacagcggguuuugggaacucguggauaaggagcgcaaccugcaccuggaaggaaagugcgagacaugugucuauaauaugaugggcaaaagagagaagaaacucggcgaguucgggaaggcgaaaggaucucgggccaucugguacauguggcugggcgcucgcuuucuugaguucgaagcccugggguuucucaacgaggaccauugguucuccagagaaaauagccuguccggaguggagggcgaggggcuucacaagcugggcuacauucuccgggauguuagcaagaaagaaggaggcgcuauguaugccgacgauaccgccgggugggacacacgcaucacccuggaggaucugaagaacgaagagauggugacgaaucauauggaaggagagcacaaaaagcucgcggaggcuauuuucaaacugacauaccagaacaaggucgugagaguucagcggccuacaccccgcggcacagugauggacaucaucucuagacgggaccagcgcgggagcggacaagucgugaccuauggccuuaauacguuuaccaacauggaagcccagcugauuagacagauggagggggaaggcgucuucaaguccauccaacagcucacagccaccgaggagauugcugugaaaaacuggcugguucgggugggacgcgaaagacuuucucggauggccaucagcggcgaugacugcgucgugaagccgcuggaugacagauuugcuuccgcccucacagcgcugaaugauauggggaaagugcgcaaggacauucagcagugggagccuucucggggauggaacgauuggacccaaguucccuucugcagccaucacuuucacgaacugaucaugaaagacggcagagugcucgucgugcccugucgcaaucaggaugagcugaucgggcgggccagaauuucccagggagcuggcuggucucuucgcgaaacagccugccugggaaagagcuacgcucagauguggucccucauguauuuccaucggagagaccugcgccuugccgcgaacgccaucuguagcgcuguuccuucucacugggugccgaccucccggacgacauggagcauucaugccacccacgaguggaugaccacagaggauaugcugaccgucuggaauagaguguggauccaagaaaaccccuggauugaggacaagacaccugucgaaucuugggaggaaauccccuaccucggcaaacgcgaggaucaguggugcggaucccugaucggccugacgagccgggcuaccugggccaagaauauucagacagcuaucaaccaggugagaucccucauugggaaugaggaauauaccgacuacaugccuucuaugaaacgguuuagacgcgaggaagaggaagccggaguucugugguga

SEQ ID NO: 20224 - RNA, 9876 nt, Artificial Sequence
  derived and/or modified CDS sequence (opt5) from DENV-2__KC762657__SS-prME
accgccggcaucauuaucaugaugauucccacagugauggucuuccaccugacgaccagaaauggggaaccucauaugaucguuagccggcaggaaaaggggaaaagccuccuguuuaagacagagaauggcgugaacaugugcacccuuauggcuauggaccugggggaacucugugaggauacaauuaccuacaauugcccgcugcuucgccaaaacgaacccgaggacaucgauuguuggugcaauucuacaagcaccugggugacguaugggaccuguacagccaccggcgagcacagacgggaaaaacgcuccgucgcgcuggugccucauguugggaugggacucgagacaagaaccgaaacguggaugucuagcgagggcgcuuggaagcacgcccagcggaucgagacaugggugcugcgccaucccggcuucaccauuauggccgcuauccuggccuacacaauugggaccaccuauuuucagagaguccucaucuucauucugcuuacagcugugacgccuuccaugaccaugcggugcaucggaauuucuaaccgcgacuuuguugaaggcgugagcgggggauccugggucgauaucgugcuggagcacggcagcugugugacaaccauggccaaaaauaagcccacacucgacuucgaacugaucaagaccgaggcgaaacacccugccacgcuuagaaaguacugcauugaagcuaaacugacaaacaccaccacagccucucgguguccgacccagggggagcccucccucaaugaggaacaagauaagcgcuuugucugcaaacauagcaugguugacagaggauggggcaacggcugugggcuguucggaaagggcgggaucgugacaugcgcuauguuuacgugcaagaaaaauauggagggaaaggugguccagccugaaaaccuggaguauaccauugugaucacaccccacucuggcgaagagaaugccguugggaacgauaccggaaaacauggcaaggagauuaaagugacaccucaguccagcaucaccgaagcggagcucacgggcuacgggaccgucacaauggaauguucuccccggaccggacuggacuucaaugagauggugcuucugcagauggaaaacaaggccuggcucguucaccgccaaugguuucuggaucuuccgcugccuuggcuccccggcgcugacacacagggguccaacuggauccagaaagagacccuggugacguucaagaauccucacgccaagaaacaggaugucgugguccugggaagccaagagggcgcuaugcauacagcccucaccggggccacagaaauucagauguccucuggcaaccugcuuuuuaccggacaccugaagugcagacuccggauggacaaacugcagcuuaagggcaugagcuauuccauguguaccgggaaauucaaggugguuaaggagaucgcugaaacacaacauggaacgauugugaucagaguccaguacgagggcgacgggagccccugcaaaauucccuucgagaucauggaucuggaaaagcgccacgugcucggacggcugaucaccguuaauccuauugugacagagaaagacucuccggucaacaucgaagcggagcccccuuuuggcgauuccuacauuaucauugggguggaacccggccagcugaagcucagcugguucaaaaagggaucuagcaucggccagauguuugagaccacaaugagaggggccaagcgcauggcuauucugggagacaccgccugggauuucggcucccuugggggaguguuuacgucuaucggcaaagcccugcaucaaguuuucggggcuaucuauggcgccgcguuuagcggagucuccuggacaaugaagauucucaucggcguggugauuaccuggaucgggaugaauagccggucuaccucccugagcgucucucuggugcuuguuggaguggucacacucuaccugggcgugaugguucaggcugacuccggguguguggucagcuggaaaaacaaggagcugaaaugcggauccggcauuuucaucaccgauaaugugcacacauggacggaacaguauaaguuucagccugagucucccagcaagcucgccuccgccauccaaaaagcucacgaagaggggauuuguggcaucagaucuguuacccgccuggaaaaccuuauguggaagcagauuacaccggagcugaaucauauccucagcgagaacgaagugaaacugaccauuaugacaggagacaucaagggcaucaugcaggccgggaaacggucccugagaccucagcccaccgagcuuaaguacagcuggaaaacguggggaaaggcuaagaugcucucuaccgaacugcacaaucauacauuccugauugauggcccugagaccgccgaaugccccaacacaaaucgcgcguggaacucccucgaggucgaggacuauggguuuggaguguucaccacaaauaucuggcugaaacuuaaggaacggcaagauguguuuugugacagcaaacugaugucugccgcuauuaaggacaacagagccguccacgcugauaugggcuacuggauggaguccgcccucaacgacaccuggaaaaucgaaaaggcgagcuucauugagguuaagucuugccacuggccuaaaagccauacgcugugguccaauggcgugcuggagagcgaaaugaucauccccaagaacuucgccgggccggugucucagcacaauuaucgcccuggauaccauacacagaccgcuggccccuggcaccuugggcggcucgagauggauuuugacuucugugaaggaaccacagucgugguuaccgaggauugcggcaacagagggcccucccugcggacgacaaccgccagcggaaaacugauuacagaauggugcugucgcuccugcacccucccuccgcugagauaccggggcgaggacggcuguugguaugggauggagaucagaccccuuaaggaaaaagaggaaaaucuggugaacucucucgucacagcuggacauggccagauugauaauuuuagccugggggugcugggaauggcccuuuuccucgaggaaaugcugcgcacccggguuggcacgaagcacgccauccugcucguggcugucuccuuugugacccugauuacagggaacaugucuuucagagaccuuggacgcguuauggugauggucggcgcgaccaugacagaugacaucggcaugggggugaccuaccuggcccuccuggcugccuuuaaggugagaccuacguucgccgcuggacugcuucugcggcgccucacaagcaaagagcugaugaugaccacaauuggcaucguccuccugucccaaucuaccauccccgagaccauucuugaacugacagaugcccucgcgcuggggaugaugguucugaagaucgugagaaaaauggagaaguaucagcuugcugugacgauuauggccauccugugcgucccuaaugccgugauucuccagaacgcuuggaaaguuagcuguaccacacuggccguggucuccgugagcccccuccugcuuaccucuucccaacagaaggcggacuggaucccucuggcucucacaaucaagggacugaaucccaccgccauuuuucugacgacacuuagccggaccucuaaaaagcgcuccuggccgcugaacgaagccaucauggcuguuggcauggugagcauucucgccucuucccugcucaaaaaugauaucccuaugaccgggccccuggucgcuggaggccuucugacagugugcuacguccugaccggcagaagcgccgaccucgagcuggaacgggcggccgacgugcgcugggaggagcaggcugaaauuuccgggagcucuccuauccuuagcaucacaauuuccgaggauggaucuaugagcaucaagaacgaagaggaggaacagacgcugaccauucucaucagaacaggccugcucguuauuuccgggcuguuccccgugucuaucccgauuaccgccgcugccugguaucuuugggaggucaaaaagcaacgggccggagugcugugggacguuccuucucccccucccgugggcaaagcugaacuggaggauggggcguaccgcaucaagcagaagggaauccucggcuauucccagauuggcgccggggucuacaaagaaggaacauuucacaccauguggcaugugacgagaggcgcugugcugaugcacaaggggaaacggaucgagcccuccugggccgacguuaagaaagaucuuauuagcuacggaggcggguggaagcuggagggagaauggaaggagggcgaagagguccaggugcucgcccuggaaccuggcaaaaauccgagagcugugcaaaccaagcccggacucuucaaaacaaacaccggaacaaucggcgccgucucccuggacuuuagcccugggaccucuggaucccccauuguggauaagaaaggcaagguuguggggcuuuauggaaacggcgucgugacacgcagcggcacguacguuucugcgaucgcucagaccgagaaguccaucgaggacaauccugaaauugaggaugacaucuuccggaaaaagagacugacaauuauggaucugcaucccggggccggaaaaaccaagcgcuaucucccugccaucgugcgggaagcuauuaaaagaggccugcgcacccuuauccuggccccgacacgggucguggcggcugagauggaagaggcccucagagggcugcccauccgcuaccagacgccugccauucgggcugagcacaccggaagagaaaucguugaccucaugugucaugccacauucaccaugcggcugcuuagccccauucgcgugccuaacuauaaucugaucauuauggaugaggcucacuuuacagaccccgccuccaucgcggccagaggcuacauuucuacccgggucgaaaugggggaggcugccggcaucuucaugacggcuacaccgccuggaagccgcgaccccuuuccccaguccaacgccccuaucauggaugaggaaagagagauucccgaacggagcuggaacucuggccacgagugggugaccgacuucaaggggaagaccgugugguuugucccuuccaucaaagccggaaacgauauugcugcgugccugagaaagaauggcaaaaagguuauccaacucagccgcaaaacauucgacuuugaauauauuaagacccggacaaacgauugggacuucguggugaccacggauaucucugagaugggggccaauuuuaaggcugagagagucaucgacccgcgccgguguaugaaacccgugauucugacagauggagaagagagaguuauccuugccggcccuaugcccgugacccauagcuccgccgcucagcgccgggggagagucggccgcaacccuaagaaugaaaacgaccaguacauuuacaugggagagccccuggaaaaugaugaggacugcgcccacuggaaagaggcgaagaugcuccuggacaacaucaauacaccggaaggcauuaucccuucuauguucgagcccgaaagagagaaaguggaugcuaucgacggggaauaucggcugcgcggagaggccagaaagaccuuuguugaucucaugcggcgcggcgaccuuccuguguggcuggccuacagagucgcugccgaggggauuaacuaugcggaucggagaugguguuucgacggagugaaaaacaaucaaauccuggaagagaacgucgaaguggagauuuggacgaaggagggcgaacgcaagaaacucaagccccgguggcuggaugccagaaucuacagcgacccucuugcucugaaagaguucaaggaauuugccgcugggcgcaaaucccucacccugaaucugauuacagagaugggccggcuccccaccuucaugacacagaaggccagaaacgcucuugauaaucuggccguucugcauaccgcggaagccggaggccgggcuuauaaccacgcccucucugagcugccggagacacuugaaacccugcuccugcugacgcuccuugcuacagugaccgggggaaucuuucuguuccugaugagcggcaaggggauuggaaaaaugacccucggcaugugcugcaucaucacagccuccauucugcuuugguacgcccagauccagccucacuggauugcugcgagcaucauucuggaguuuuuccucaucgugcugcugauccccgaacccgagaagcaacgcaccccucaggacaaucagcucacauaugucguuauugccauccuuacggugguggcugccaccauggccaacgaaaugggcuuucuggagaaaacaaagaaagauuucgggcugggaucuauuaccacacagcaauccgagagcaauauccucgacauugaucugagaccggcuuccgccuggacccuuuacgcggucgccacgaccuuuaucacacccaugcugcggcauucuaucgaaaacagcuccgugaauguuucucucaccgcuauugccaaccaggcuacagugcugaugggccuggggaagggauggccucucagcaagauggacaucggcgucccccuucuggccauuggguguuacucccaggugaauccuaucacccugacggcggcccuccugcuucuggucgcucacuaugccauuaucggacccggccuccaggcuaaagccacacgcgaggcucaaaagagagccgcggccggcauuaugaaaaacccuaccguggacgggaucacaguuaucgaucuggacccgauucccuacgauccuaaguucgaaaaacagcugggacaggugaugcuccuuguccugugcgugacccagguucugaugaugcggaccacaugggcucucugugaggcccugacgcuugcuaccggccccaucagcacacugugggaagggaauccuggacgcuuuuggaacaccacaauugccgugucuauggccaauaucuucagaggcuccuaucucgcgggggcuggacugcuguuuagcauuaugaagaacaccgccaacacgcggcgcggcacaggcaauaccggggagacccucggagagaaguggaaaaacagacuuaaugcucugggcaagucugaguuccaaaucuacaaaaaguccgggauccaggaggucgaccggacacuggccaaagaaggaauuaagagaggcgagaccgaucaucacgccgugagccgcgggucugcuaaacuccggugguucguggagagaaaccugguuacacccgaaggaaaggucguggaccuuggcugcggccgcgggggauggagcuauuacuguggcgggcugaagaaugugaaagaggucaagggacucacgaaaggcgggccgggacaugaagaaccuauccccauguccaccuauggcuggaaccugguucggcugcagucuggcguggauguguuuuucacacccccugaaaagugcgacacccuccuuugugauauuggggagagcucccccaauccuacagucgaggccggaagaacccugcgcgugcugaaccucguugaaaauuggcugaacaauaacacgcaauuuugcaucaaagugcuuaauccguacaugcccagcgucauugagaagauggaagcgcugcagcggaaguacggcggggcccucgugagaaacccucugucccgcaauucuacccacgagauguauuggguuagcaacgcuuccggaaacaucgugucuagcgucaauaugaucucccggaugcugauuaacagauucacaaugcgccacaaaaaggccaccuacgaacccgacguggaucucggcucugggacacggaauaucggaauugagagcgagaccccuaaccuugacaucauuggcaaaagaaucgaaaagaucaaacaggagcaugaaacauccuggcacuaugaucaggaccaucccuacaagaccugggcuuaucacggcagcuacgagacgaagcaaacagggucugccuccagcauggugaauggagucguucgccugcugaccaaaccgugggacgugauuccuauggugacccagauggcgaugacagauacgacccccuuuggccagcagagagucuucaaggaaaaaguggacacacggacccaagagccuaaggaggggaccaaaaagcucaugaagaucaccgccgaauggcuguggaaagagcuuggaaagaaaaagacaccccgcauguguaccagagaagaguuuacgcggaaaguuagaucuaacgcugcccugggcgcuauuuucaccgaugagaauaaguggaaauccgcccgggaagcuguggaggacagcggguuuugggaacucgucgauaaggagcgcaaccugcaccuggaaggaaagugcgagacauguguguauaauaugaugggcaaaagagagaagaaacucggcgaguucgggaaggccaaaggaucucgggcgaucugguacauguggcugggcgcccgcuuucuugaguucgaagcucugggguuucucaacgaggaccauugguucuccagagaaaauagccuguccggaguugagggcgaggggcuucacaagcugggcuacauucuccgggaugugagcaagaaagaaggaggcgccauguaugcugacgauaccgccgggugggacacacgcaucacccuggaggaucugaagaacgaagagauggucacgaaucauauggaaggagagcacaaaaagcucgccgaggcgauuuucaaacugacauaccagaacaaggugguuagagugcagcggccuacaccccgcggcacagucauggacaucaucucuagacgggaccagcgcgggagcggacaaguggucaccuauggccuuaauacguuuaccaacauggaagcucagcugauuagacagauggagggggaaggcguguucaaguccauccaacaucucacagccaccgaggagauugccguuaaaaacuggcuggugcgggucggacgcgaaagacuuucucggauggcuaucagcggcgaugacugcguggugaagccgcuggaugacagauuugccuccgcucucacagcccugaaugauauggggaaaguucgcaaggacauucagcagugggagccuucucggggauggaacgauuggacccaggugcccuucugcagccaccacuuucaugaacugaucaugaaagacggcagaguccucgugguucccugucgcaaucaagaugagcugaucgggcgggcgagaauuucccagggagccggcuggucucuucgcgaaacagcuugccugggaaagagcuacgcccagauguggucccucauguauuuccaccggagagaccugcgccuugcugccaacgcgaucuguagcgccgugccuucucauugggucccgaccucccggacgacauggagcauucacgcuacccacgaguggaugaccacagaggauaugcugaccguguggaauagagucuggauccaggaaaaccccuggauugaggacaagacaccuguggaaucuugggaggaaauccccuaccucggcaaacgcgaggaucaauggugcggaucccugaucggccugacgagccgggccaccugggcuaagaauauucagacagccaucaaccagguuagaucccucauugggaaugaggaauauaccgacuacaugccuucuaugaaacgguuuagacgcgaggaagaggaagcuggagugcugugguga

SEQ ID NO: 20225 - RNA, 9876 nt, Artificial Sequence
  derived and/or modified CDS sequence (opt5) from DENV-2__KC762666__SS-prME
acagccggcaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucacgccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggaagcagaucacaccggagcugaaucauauucucagcgagaacgaagugaaacugaccaucaugacaggagacaucaagggcauuaugcaggcugggaaacggucccugagaccucagcccaccgagcuuaaguacagcuggaaaacguggggaaaggccaagaugcucucuaccgaacugcacaaucauacauuccugaucgauggcccugagaccgcggaaugccccaacgccaaucgcgcuuggaacucccucgagguugaggacuauggguuuggaguguucacaaccaauauuuggcugaaacuuaaggaacggcaagaugccuuuugugacagcaaacugaugucugcugccaucaaggacaacagagcgguccacgccgauaugggcuacuggauugaguccgcucucaacgacacauggaaaaucgaaaaggccagcuucaucgaggugaagucuugccacuggccuaaaagccauacccugugguccaauggcgugcuggagagcgaaaugauuauccccaagaacuucgcugggccggucucucagcacaauuaucgcccuggauaccauacgcagacagccggccccuggcaccuugggcggcucgagauggauuuugacuucugugaaggaaccaccguuguggugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggucaacucucucgugaccgcuggacauggccagauugauaauuuuagccuggggguucugggaauggcgcuuuuccucgaggaaaugcugcgcacacgggugggcaccaagcacgccauccugcucgucgcuguguccuuuguuacgcugauuaccgggaacaugucuuucagagaccuuggacgcgugauggucauggugggcgccacaaugaccgaugacaucggcauggggguuacauaccuggcccuccuggcugccuuuaaggugagaccuaccuucgcggcuggacugcuucugcggaaacucacgagcaaggagcugaugaugacaaccaucggcauuacacuccugucccaaucuaccauccccgagaccauucuugaacugacagaugcccucgcccuggggaugaugguccugaaaaucgugcgcaauauggagaaguaucagcuugcugugacgauuauggccauccugugcgucccuaacgcgguuauccuccagaaugcuuggaaagugagcuguaccacacuggccguggucuccgugagcccccuccugcuuaccucuucccaacagaaggccgacuggauuccucuggcucucacaaucaagggacugaaccccaccgccauuuuucugacgacacuuagcagaaccucuaaaaagcgguccuggccgcugaaugaagcuaucauggccguuggcauggugagcauucucgcgucuucccugcucaaaaacgauaucccuaugaccgggccccuggucgccggaggccuucugacagugugcuacguucugaccggccgcagcgcugaccucgagcuggaaagagccgcugacgugcggugggaggagcaggccgaaaucuccgggagcucuccuauucuuagcaucacaauuuccgaggauggaucuaugagcaucaagaaugaagaggaggaacagacgcugaccauucucauccgcacaggccugcucgucauuuccgggcuguuccccgugucuaucccgaucaccgccgcugcgugguaucuuugggaggucaaaaagcaaagagccggagugcugugggacguuccuucucccccucccgugggcaaagcugaacuggaggauggggccuaccggauuaagcagaagggaauccucggcuauucccagauuggcgccggggucuacaaagaaggaacauuucacaccauguggcaugugacgcgcggcgcuguucugaugcacaaggggaaaagaaucgagcccuccugggccgacgugaagaaagaucuuauuagcuacggaggcggguggaagcuggagggagaauggaaggagggcgaagagguccaggugcucgcgcuggaaccuggcaaaaacccgcgggcugugcaaaccaagcccggacucuucaaaacauccaccggaacaaucggcgccguuagccuggacuuuucuccugggaccuccggaagccccaucgucgauaagaaaggcaaggugguggggcuuuauggaaacggcgucgugacaagaucuggcacguacguuuccgccauugcucagaccgaaaagagcaucgaggacaauccugaaauugaggaugacaucuuccgcaaaaagcggcugacaauuauggaucugcaucccggggccggaaaaaccaagagauaucucccugcgaucgugcgcgaagcuaucaaacggggccugagaacccuuauucuggccccgacacgcgucguggccgcugagauggaagaggcccuccgggggcugcccaucagauaccagacgccugcuauucgcgccgagcacaccggacgggaaaucguugaccucaugugucaugcgacauucaccaugagacugcuuucccccauucgggugccuaacuauaaucugaucauuauggaugaggcccacuuuacagaccccgcuucuaucgccgcucgcggcuacaucagcaccagagucgaaaugggggaggccgccggcauuuucaugacggcuacaccgccuggaucccgggaccccuuuccccagagcaacgcgccuaucauggaugaggaacgcgagauucccgaaagaucuuggaauagcggccacgagugggugaccgacuucaaggggaagaccguuugguuugugccuagcaucaaagccggaaacgauauugcugccugccugcggaagaauggcaaaaaggucauccaacucucuagaaaaacauucgacuuugaauauaucaagacccgcacaaacgauugggacuucguggugaccacggauauuagcgagaugggggccaauuuuaaggcugagcgggucaucgacccgagacgcuguaugaaacccguuauucugacagauggagaagaacgggugauccuugccggcccuaugcccgugacccauuccucugcggcucagagacgcgggcgggucggcagaaacccuaagaaugaaaacgaccaguacauuuacaugggagagccccuggaaaaugaugaggacugcgcccacuggaaagaggccaagaugcuccuggacaacaucaauacaccggaaggcaucauuccuagcauguucgagcccgaacgcgagaaaguggaugcuaucgacggggaauauagacugcggggagaggcccgcaagaccuuuguugaucucaugagacggggcgaccuuccuguguggcuggcguaccgcgucgccgcugaggggauuaacuaugccgauagacggugguguuucgacggagugaaaaacaaucaaauccuggaagagaacguugaaguggagauuuggacgaaggagggcgaaagaaagaaacucaagccccgcuggcuggaugcucggaucuacuccgacccucuugcccugaaagaguucaaggaauuugcugccgggagaaaaucucucacccugaaucugauuacagagaugggccgccuccccaccuucaugacacagaaggcgcggaacgcccuugauaaucuggcuguccugcauaccgccgaagcuggaggcagagccuauaaccacgcccucagcgagcugccggagacacuugaaacccugcuccugcugacgcuccuugcuacagugaccgggggaaucuuucuguuccugauguccggcaaggggaucggaaaaaugacccucggcaugugcugcauuaucacagcgagcauucugcuuugguacgcccagauccagccucacuggauugcugccucuaucauccuggaguuuuuccucauuguccugcugauccccgaacccgagaagcaacggaccccucaggacaaucagcucacauaugugguuauugccauccuuacggugguggcugccaccauggcgaacgaaaugggcuuucuggagaaaacaaagaaagauuucgggcugggauccauuaccacacagcaaccggagagcaauauccucgacaucgaucugcgccccgccuccgcuuggacccuuuacgccgucgcuacgaccuuuauuacaccuaugcugagacauucuaucgaaaacagcuccguuaaugugucucucaccgccauugcgaaccaggccacagugcugaugggccuggggaagggauggccccucagcaagauggacaucggcgucccucuucuggcuauuggguguuacucccaggugaaucccaucacccugacggccgcucuccugcuucugguugcccacuaugcuauuaucggaccuggccuccaggccaaagcgacacgggaggcccaaaagcgcgcugccgcuggcaucaugaaaaacccgaccguggacgggauuacagucaucgaucuggaccccauuccuuacgaucccaaguucgaaaaacagcugggacaggugaugcuccuuguccugugcgugacccagguucugaugaugagaaccacaugggcccucugugaggcccugacgcuugcgaccggcccuaucagcacacugugggaagggaaucccggacgguuuuggaacaccacaauugcugugucuauggccaauaucuuccgcggcuccuaucucgcuggggccggacugcuguuuagcaucaugaagaacaccgccaacacgagacggggcacaggcaauaccggggagacccucggagagaaguggaaaaaccgccuuaaugcucugggcaagucugaguuccaaauuuacaaaaaguccgggauccaggaggucgacagaacacuggccaaagaaggaauuaagcggggcgagaccgaucaucacgcggugagcagagggucugccaaacuccgcugguucguugagcggaaccuggugacaccggaaggaaaggucguggaccuuggcugcggcagagggggauggagcuauuacuguggcgggcugaagaaugugaaagagguuaagggacucacgaaaggcgggccuggacaugaggaacccauccccauguccaccuauggcuggaaccugguccgccugcagucuggcguggauguguuuuucacaccucccgaaaagugcgacacccuccuuugugauauuggggagagcuccccuaauccgacagucgaggcuggacggacccugagaguucugaaccucguggaaaauuggcugaacaauaacacgcaauuuugcaucaaagugcuuaaucccuacaugccuagcgucaucgagaagauggaagcccugcagcgcaaguacggcggggcucucgugcggaacccccuguccagaaauucuacccacgagauguauuggguuagcaacgccuccggaaacauugugucuagcgucaauaugaucucccgcaugcugauuaaccgguucacaaugagacacaaaaaggcgaccuacgaaccugacguggaucucggcucugggacacgcaauaucggaauugagagcgagacccccaaccuugacaucaucggcaaacggauugaaaagaucaaaagagagcaugaaacauccuggcacuaugaucaggaccauccguacaagaccugggccuaucacggcagcuacgagacgaagcagacagggucugcuuccagcaugguuaauggagugguccgccugcugaccaaaccuugggacgugauucccauggugacccaaauggccaugacagauacgaccccuuuuggccagcagagagucuucaaggaaaaaguugacacacggacccaggagcccaaggaggggaccaaaaagcucaugaagaucaccgcugaauggcuguggaaagagcuuggaaagaaaaagacaccucgcauguguaccagagaagaguuuacgcggaaagugagaucuaacgccgcucugggcgccauuuucaccgaugagaauaaguggaaauccgcgcgggaagccguggaggacagcggguuuugggaacucgucgauaaggagcgcaaccugcaccuggaaggaaagugcgagacauguguguauaauaugaugggcaaaagagagaagaaacucggcgaguucgggaaggcuaaaggaucucgggccaucugguacauguggcugggcgcucgcuuucuugaguucgaagcccugggguuucucaacgaggaccauugguucuccagagaaaauagccuguccggaguugagggcgaggggcuucacaagcugggcuacauucuccgggaugugagcaagaaagaaggaggcgccauguaugcggacgauaccgcugggugggacacacgcaucacccuggaggaucugaagaacgaagagauggucacgaaucauauggaaggagagcacaaaaagcucgccgaggccaucuucaaacugacauaccaaaacaaggugguuagagugcagcggcccaccccgcgcggcacagucauggacauuaucucuagacgggaccagcgcgggagcggacaggugguuaccuauggccuuaauacguuuaccaacauggaagcucaacugauuagacagauggagggggaaggcguguucaaguccauccagcaacucacagucaccgaggagauugccgugaaaaacuggcugguccgggugggacgcgaaagacuuucucggauggcuaucagcggcgaugacugcguugugaagccucuggaugacagauuugccuccgcgcucacagcccugaaugauauggggaaaguccgcaaggacauccagcagugggagcccucucggggauggaacgauuggacccaggugcccuucugcagccaucacuuucacgaacugauuaugaaagacggcagagugcucguugugccuugucgcaaucaagaugagcugaucgggcgggcuagaauuucccagggagccggcuggucucuucgcgaaacagcuugccugggaaagagcuacgcccagauguggucccucauguauuuccaucggagagaccugcgccuugcggccaacgcuaucuguagcgccgucccgucucacugggugcccaccucccggacgacauggagcauucaugcuacccacgaguggaugaccacagaggauaugcugaccguuuggaauagaguguggauccaggaaaacccuuggauggaggacaagacacccgucgaaucuugggaggaaaucccuuaccucggcaaacgcgaggaucaauggugcggaucccugauuggccugacgagccgggccaccugggcuaagaauauccagacagccauuaaccaggugagaucccucaucgggaaugaggaauauaccgacuacaugcccucuaugaaacgguuuagacgcgaggaagaggaagcgggaguccugugguga

SEQ ID NO: 20226 - RNA, 9876 nt, Artificial Sequence
  derived and/or modified CDS sequence (opt5) from DENV-2__KC762677__SS-prME
accgccggaaucauuaucaugaugauucccacagugauggcuuuccaccugacgaccagaaacggggagccucauaugaucgugagccggcaggaaaagggaaagucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagauugugcagccugaaaaccuggaguacacgaucgugauuacaccccauucuggcgaagagaaugccgucgggaacgauacaggaaaacacggcaaggagaucaaagugaccccucaguccagcaucacagaagcugagcucaccggcuaugggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucaugccaagaaacaggauguugugguccugggaagccaagagggcgccaugcacacggcucucacaggggcgaccgaaauccagauguccucuggcaaccugcuuuuuacaggacaucugaagugcagacuccggauggacaaacugcagcuuaagggcaugagcuacuccauguguaccgggaaauucaagguggucaaggagauugccgaaacccaacacggaacaaucgugauuagaguucaguaugagggcgacgggagccccugcaaaauccccuucgagaucauggaucuggaaaagcgccaugugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaccaaguguucggggcgauuuacggcgcugccuuuagcggaguguccuggacgaugaagauccucauuggcguugucaucacauggauugggaugaauagccggucuaccucccugagcgugucucuggugcuugucggagugguuacccucuaucugggcgugaugguccaggccgacuccgggugugugguuagcuggaaaaacaaggagcugaaaugcggauccggcaucuucaucacagauaaugugcacaccuggacagaacaguacaaguuucagccugagucucccagcaagcucgcuuccgccauucaaaaagcucaugaagaggggaucuguggcauuagaucugucacgcgccuggaaaaccuuauguggaagcagaucaccccggagcugaaucacauucucagcgagaacgaagugaaacugacaaucaugaccggagacaucaagggcauuaugcaggccgggaaacggucccugagaccucagcccacagagcuuaaguauagcuggaaaaccuggggaaaggcgaagaugcucucuacggaacugcauaaucacaccuuccugaucgauggcccugagacagccgaaugccccaacaccaaucgcgcuuggaacucccucgagguugaggacuacggguuuggaguguucacaaccaauauuuggcugaaacuuaaggaacggcaagaugucuauugugacagcaaacugaugucugccgcuaucaaggacaacagagccgugcacgcggauaugggcuacuggauugaguccgcccucaacgacacauggaaaaucgaaaaggcuagcuuuaucgaggugaagucuugcuauuggccuaaaagccauacccugugguccaauggcguccuggagagcgaaaugauuauccccaagaacuucgccgggccgguuucucagcacaauuaccgcccuggauaccauacgcagacagcuggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaucggggcgaggacggcuguugguacgggauggagaucagacccaugaaggaaaaagaggaaaaucuugugaacucucugguuaccgccggacauggccagauugauaauuucagccucggggugcugggaauggcucuguuucuugaggaaaugcuccgcacacgggucggcaccaagcacgcgauccugcugguggccguuuccuucgugacgcucauuaccgggaacaugucuuuuagagaccugggacgcgucauggugaugguuggcgcuacaaugaccgaugacaucggcaugggggugacauaucuugcccugcucgccgcuuucaaggucagaccuaccuuugccgcgggacugcugcuucggaaacugacgagcaaggagcucaugaugacaaccaucggcauugugcugcucucccaaucuacaauccccgagaccauucuggaacuuaccgaugcucuggcccucgggaugauggcccugaaaaucgugcgcaauauggagaaguaccagcuggcugucacaauuauggccauccuuugcguuccuaacgcggugauccugcagaaugcuuggaaagugagcuguacgacccucgccgucguguccguuagcccccugcuccugacaucuucccaacagaaggccgacuggauuccucuugcucugaccaucaagggacucaaccccacagccauuuuccugaccacgcugagcagaacaucuaaaaagcgguccuggccgcuuaaugaagcuaucauggccgugggcauggucagcauucuggcgucuucccuccugaaaaacgauaucccuaugaccgggccccucguggccggaggccugcuuaccguuugcuaugugcugacaggccgcagcgcugaccuggagcucgaaagagccgcugacguccggugggaggagcaggccgaaaucuccgggagcucuccuauucugagcaucaccauuuccgaggauggaucuaugagcaucaagaaugaagaggaggaacagacacuuacgauucugauccgcaccggccuccuggugauuuccgggcucuuucccgucucuaucccgaucacagccgcugcgugguaccugugggaggugaaaaagcaaagagccggaguucuuugggacgugccuucucccccucccgucggcaaagcugaacuggaggauggggccuaucggauuaagcagaagggaauccugggcuacucccagauuggcgccgggguguacaaagaaggaaccuuccacacaauguggcauguuacccgcggcgcugugcucaugcacaaggggaaaagaaucgagcccuccugggccgacgucaagaaagaucugauuagcuauggaggcggguggaaacuugagggagaauggaaggagggcgaagagguccaggugcuggcgcucgaaccuggcaaaaacccgcgggcuguucaaacgaagcccgggcuguuuaaaaccaacacaggaaccaucggcgccgucucccucgacuucagcccugggacaucuggaucccccaucguggauaagaaaggcaagguggucgggcuguacggaaauggcgugguuaccagaagcggcacauaugugucugccauugcucagacggagaaguccaucgaggacaacccugaaauugaggaugacaucuuucgcaaaaagcggcuuaccauuauggaucugcaucccggggccggaaaaacaaagagauaccugccugcgaucguccgcgaagcuaucaaacggggccucagaacccugauucuugccccgacccgcgugguugccgcugagauggaagaggcccugcgggggcuccccaucagauaucagaccccugcuauucgcgccgagcacacgggacgggaaaucguggaccugaugugucaugcgaccuucacaaugagacuccugagccccauucgggucccuaauuacaaccuuaucauuauggaugaggcccacuucaccgaccccgcuuccaucgccgcucgcggcuauaucucuacaagaguggaaaugggggaggccgccggcauuuuuaugaccgcuacgccgccuggaagccgggaccccuucccccaguccaaugcgccuaucauggaugaggaacgcgagauucccgaaagaagcuggaacucuggccacgaguggguuacagacuuuaaggggaagaccgugugguucgucccuuccaucaaagccggaaaugauauugcugccugccugcggaagaacggcaaaaaggugauccaacugagcagaaaaaccuuugacuucgaauacaucaagacacgcaccaaugauugggacuuuguggucacaaccgauauuucugagaugggggccaacuucaaggcugagcggguuaucgacccgagacgcuguaugaaacccgugauucucacggauggagaagaacgggugauccuggccggcccuaugcccgucacacauagcuccgcggcucagagacgcgggcgggugggcagaaauccuaagaacgaaaaugaccaguacauuuauaugggagagccccuugaaaacgaugaggacugcgcccacuggaaagaggccaagaugcugcucgacaauaucaacaccccggaaggcaucauuccuucuauguuugagcccgaacgcgagaaaguugaugcuaucgacggggaauacagacugcggggagaggcccgcaagacauucguggaucugaugagacggggcgaccucccugucuggcuugcguaucgcguggccgcugaggggauuaacuacgccgauagacggugguguuuugacggaguuaaaaauaaccaaauccuggaagagaauguggaagucgagauuuggaccaaggagggcgaaagaaagaaacugaagccccgcuggcucgaugcucggaucuauagcgacccucuggcccuuaaagaguucaaggaguucgcugccgggagaaaaucccugacgcucaaccugauuaccgagaugggccgccugcccacauuuaugacccagaaggcgcggaaugcccucgauaaccuugcugugcugcauacagccgaagcuggaggcagagccuacaaucacgcccugucugagcucccggagacccuggaaacacuucugcuccugacccugcucgcuacggucacagggggaaucuuccuuuuucugaugagcggcaaggggaucggaaaaaugacccugggcaugugcugcauuaucaccgcguccauucuccugugguaugcccagauccagccucacuggauugcugccagcaucauccuugaguucuuucugauugugcuccugauccccgaacccgagaagcaacggacaccucaggacaaccagcugaccuacguugugauugccauccucacaguggucgcugccacgauggcgaaugaaaugggcuuccuugagaaaaccaagaaagauuuugggcugggaucuauuacaacccagcaaccggaguccaacauccuggacaucgaucuccgccccgccagcgcuuggacacuguacgccguugcuaccacguucauuaccccuaugcuuagacauuccaucgaaaauucuagcgugaacgugucccugacagccauugcgaaucaggccaccguccucaugggccuggggaagggauggccccugucuaagauggacaucggcgugccucuccuugcuauuggguguuauagccagguuaaccccaucacacugaccgccgcucugcuccugcuuguggcccacuacgcuauuaucggaccuggccugcaggccaaagcgacgcgggaggcccaaaagcgcgcugccgcuggcaucaugaaaaauccgacagucgacgggauuaccgugaucgaucucgaccccauuccuuaugaucccaaguuugaaaaacagcugggacaggucaugcugcucgugcuuugcguuacacaggugcugaugaugagaaccaccugggcccugugugaggcccucacacuggcgacgggcccuaucuccacccuuugggaagggaaccccggacgguucuggaauacaaccauugcugucagcauggccaacaucuuucgcggcucuuaccuggcuggggccggacuccuguucuccaucaugaagaacacagccaauaccagacggggcacgggcaacacaggggagacccugggagagaaguggaaaaaucgccucaacgcucuuggcaagagcgaauuucaaauuuauaaaaagucugggauccaggagguggacagaacccuggccaaagaaggaauuaagcggggcgagacagaucaucacgcgguuuccagagggagcgccaaacugcgcugguucguggagcggaaucucgucaccccggaaggaaaggugguggaccugggcugcggcagagggggauggucuuacuauuguggcgggcuuaagaacguuaaagaggucaagggacugacaaaaggcgggccuggacaugaagaacccauccccaugagcacguacggcuggaaucucgugcgccugcaguccggcguggaugucuucuuuaccccucccgaaaagugcgacacacugcucugugauauuggggagucuagcccuaacccgaccguugaggcuggacggacacuuagagugcugaaucugguggaaaacuggcucaauaacaauacccaauucugcaucaaaguccugaaccccuacaugccuuccgugaucgagaagauggaagcccuucagcgcaaguauggcggggcucugguucggaauccccucagcagaaacuccacgcacgagauguacugggugucuaacgccagcggaaauauugucuccucugugaacaugaucagccgcaugcugauuaaucgguuuaccaugagacacaaaaaggcgacauaugaaccugacguugaucugggcuccgggacccgcaacaucggaauugagucugagauccccaaucucgacaucauuggcaaacggaucgaaaagauuaaacaggagcaugaaacaagcuggcacuacgaucaggaccauccguauagaaccugggccuaccacggcuccuaugagaacaagcaaacagggagcgcuucuuccauggugaauggagucgugcgccuucugaccaagccuugggacgugauccccauggucacgcagauggccaugacagauaccaccccuuucggccagcagagaguuuuuaaagaaaagguggacacacggacgcaagagcccaaagaggggaccaagaaacugaugaagauuacagcugaauggcucuggaaggagcugggcaagaagaaaaccccucgcauguguacaagaaaggaguucacccggaaagugagaagcaacgccgcucuuggcgccaucuuuacagaugagaauaaguggaaaucugcgcgggaggccgucgaagacuccggguucugggagcugguggauaaggaacgcaaccuccaccuggagggaaagugcgaaaccuguguuuacaauaugaugggcaaaagagagaagaaacugggcgaguuugggaaggcuaaaggaagccgggccauuugguacauguggcucggcgcucgcuuccuggaauuugaggcccuuggguuccugaacgaagaccauugguuuucuagagagaauagccucagcggaguggaaggcgaggggcugcacaaacuuggcuauauccugcgggaugucuccaagaaagagggaggcgccauguacgcggacgauacggcugggugggacacccgcaucacacucgaagaucugaagaacgaggaaauggugaccaaucauauggagggagaacacaaaaagcuggccgaggccauuuucaaacucacauaucagaacaagguugugagaguccagcggcccaccccgcgcggcacggugauggacaucauuagcagacgggaccagcgcgggucuggacaaguugugacauacggccugaacaccuucacaaauauggaggcucagcuuaucagacagauggaaggggagggcgucuuuaagagcauucaacagcugaccgugacggaagagaucgccgucaaaaacuggcucgugcggguuggacgcgagagacugucccggauggcuaucucuggcgaugacugcguggucaagccucuugaugacagauucgccagcgcgcugaccgcccucaaugauauggggaaagugcgcaaggacauucagcagugggaacccucccggggauggaacgauuggacacaagugcccuuuugcucucaucacuuccacgagcugaucaugaaagacggcagaguucugguggucccuugucgcaaucaggaugaacucauugggcgggcuagaaucagccagggagccggcuggucccugcgcgagaccgcuugccuugggaagucuuaugcccagauguggagccugauguacuuucaucggagagaccuccgccuggcggccaacgcuauuuguuccgccgugccgagccacuggguucccacaucucggaccacaugguccauccaugcuacccacgaauggaugacgacagaggauaugcuuaccguguggaauagagucuggauccaagagaacccuuggauggaagacaagacccccguggagagcugggaagagauuccuuaucugggcaaacgcgaagaucaguggugcggaucucucaucggccugacaucccgggccaccugggcuaagaauauucagacagccaucaaccaggucagaagccugauugggaaugaggaguacacggacuacaugcccuccaugaaacgguucagacgcgaagaggaagaggcgggagugcucugguga

SEQ ID NO: 20227 - RNA, 9876 nt, Artificial Sequence
  derived and/or modified CDS sequence (opt5) from DENV-2__KC762668__SS-prME
accgccggaaucauuaucauggugauucccaccgucauggcuuuccaccugacgaccagaaacggggagccucauaugaucguuagccggcaggaaaaggggaaaagccuccuguuuaagaccgagaauggcgugaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguugcucuggugccucauguugggaugggacucgagacaagaaccgaaacguggaugucuagcgagggcgccuggaagcacgcccagcggaucgagacaugggugcugcgccaucccggcuucaccauuauggcugccauccuggcuuacacaauugggaccaccuauuuucagagaguccucaucuucauucugcuuacagccguggcgccuuccaugacgaugcggugcaucggaauuucuaaccgcgacuuuguugaaggcgugagcgggggauccugggucgauaucgugcuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggaucgugaccugcgcgauguuuacaugcaagaaaaauauggagggaaagauugugcagccugaaaaccuggaguauacgaucgucauuacaccccacucuggcgaagagaaugccguggggaacgauacaggaaaacauggcaaggagaucaaaaucaccccucaguccagcauuacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauccagaaagagacacuggugaccuucaagaauccucacgccaagaaacaggauguugugguccugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaagguggucaaggagaucgccgaaacccaacauggaacaauugugaucagaguucaguacgagggcgacgggagccccugcaaaauccccuucgagauuauggaucuggaaaagcgccacgugcucggacggcugaucacggucaauccuauugugaccgagaaagacucuccgguuaacaucgaagcugagcccccuuuuggcgauuccuacauuaucauugggguggaacccggccagcugaagcucagcugguucaaaaagggaucuagcaucggccagauguuugagacaaccaugagaggggccaagcgcauggccauccugggagacacagcuugggauuucggcucccuugggggagucuuuaccucuauuggcaaagcccugcaucaaguguucggggcgaucuauggcgcugccuuuagcggaguguccuggacgaugaagauucucaucggcguugucauuacauggaucgggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucauuacagauaaugugcacaccuggacagaacaguauaaguuucagccugagucucccagcaagcucgcuuccgccauccaaaaagcucacgaagaggggauuuguggcaucagaucugucacgcgccuggaaaaccuuauguggaagcagauuaccccggagcugaaucauauccucagcgagaacgaagugaaacugacaaucaugaccggagacauuaagggcaucaugcaggccgggaaacggucccugagaccucagcccacagagcuuaaguacagcuggaaagcguggggaaaggccaagaugcucucuaccgaacugcacaaucauacguuccugauugauggcccugagaccgcugaaugccccaacacaaaucgcgccuggaacucccucgagguugaggacuauggguuuggaguguucaccacaaauaucuggcugaaacuuaaggaacggcaagaugucuuuugugacagcaaacugaugucugcugccauuaaggacaacagagcggugcacgccgauaugggcuacuggaucgaguccgcucucaacgacaccuggaaaaucgaaaaggccagcuucauugaggugaagucuugccacuggccuaaaagccauacacugugguccaauggcguccuggagagcgaaaugaucauucccaagaacuucgcugggccgguuucucagcacaauuaucgcccuggauaccauacccagacggccggccccuggcaccuugggcggcucgagauggauuuugacuucugugaaggaacaaccgugguggucaccgaggauugcggcaacagagggcccucccugcggacaaccacggccagcggaaaacugaucacagaauggugcugucgcuccugcacccucccuccgcugagauaccggggcgaggacggcuguugguaugggauggagauuagaccccuuaaggaaaaagaggaaaaucuggugaacucucucguuacagcuggacauggccagaucgauaauuuuagccugggggugcugggaauggcgcuuuuccucgaggaaaugcugcgcacccgggucggcacaaagcacgccauucugcucguggcuguuuccuuugugacccugaucacggggaacaugucuuucagagaccuuggacgcgucauggugaugguuggcgccaccaugacagaugacaucggcaugggggugaccuaccuggcccuccuggcugccuuuaaggucagaccuacauucgcggcuggacugcuucugcggaaacucaccagcaaggagcugaugaugacgacaauuggcaucgugcuccugucccaaucuaccauucccgagacaauccuugaacugaccgaugcccucgcccuggggaugauggugcugaaaauuguccgcaauauggagaaguaucagcuugcuguuaccaucauggccauccugugcgugccuaacgcggugauucuccagaaugcuuggaaagucagcuguacaacgcuggccgugguuuccgugagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgucggcauggugagcauccucgcgucuucccugcucaaaaacgauaucccuaugacagggccccugguugccggaggccuucugaccgugugcuacguccugaccggccgcagcgcugaccucgagcuggaaagagccgcugacgugcggugggaggagcaggccgaaauuuccgggagcucuccuauccuuagcauuacaaucuccgaggauggaucuaugagcauuaagaaugaagaggaggaacagacccugacaauccucauucgcacgggccugcucgucaucuccgggcuguuccccgugucuaucccgauuaccgccgcugcgugguaucuuugggagguuaaaaagcaaagagccggagugcugugggacgucccuucucccccucccgugggcaaagcugaacuggaggauggggccuaccggaucaagcagaagggcauucucggcuauucccagaucggcgccgggguuuacaaagaaggaacauuucacaccauguggcaugugacacgcggcgcuguccugaugcacaaggggaaaagaauugagcccuccugggccgacgugaagaaagaucuuaucagcuacggaggcggguggaagcuggagggagaauggaaggagggcgaagaggugcagguucucgcgcuggaaccuggcaaaaacccgcgggcuguccaaaccaagcccggacucuucaaaacgaacaccggaaucauuggcgccgugucccuggacuuuagcccugggacaucuggaucccccaucguggauaagaaaggcaaggucguggggcuuuauggaaauggcguugugaccagaagcggcacauacgucucugccauugcucagaccgagaaguccaucgaggacaacccugaaauugaggaugacaucuuccgcaaaaagcggcugacaaucauggaucugcaucccggggccggaaaaacgaagagauaucucccugcgauugugcgcgaagcuaucaaacggggccugagaacccuuauucuggccccgacacgcguuguggccgcugagauggaagaggcccuccgggggcugcccaucagauaccagaccccugcuauucgcgccgagcacaccggacgggaaaucgucgaccucaugugucaugcgacauucacgaugagacugcuuagccccauucgggugccuaauuauaaccugaucaucauggaugaggcccacuuuaccgaccccgcuuccauugccgcucgcggcuacaucucuacaagaguugaaaugggggaggccgccggcauuuucaugaccgcuacaccgccuggaagccgggaccccuuuccccaguccaaugcgccuaucauggaugaggaacgcgagauucccgaaagaagcuggaacucuggccacgagugggugaccgacuucaaggggaagacggucugguuugugccuuccaucaaagccggaaaugauaucgcugccugccugcggaagaacggcaaaaaggugauucaacucagcagaaaaacauucgacuuugaauauaucaagacccgcaccaaugauugggacuucgucguuacaaccgauauuucugagaugggggccaacuuuaaggcugagcgggugaucgacccgagacgcuguaugaaacccgugauucugacagauggagaagaacgggucauccuugccggcccuaugcccgugacccauagcuccgcggcucagagacgcgggcggguuggcagaaauccuaagaacgaaaaugaccaguacaucuacaugggagagccccuggaaaacgaugaggacugcgcccacuggaaagaggccaagaugcuccuggacaauauuaacacgccggaaggcaucauuccuucuauguucgagcccgaacgcgagaaaguggaugcuaucgacggggaauauagacugcggggagaggcccgcaagacauuugucgaucucaugagacggggcgaccuuccuguguggcuggcguaccgcguugccgcugaggggauuaacuaugccgauagacggugguguuucgacggagugaaaaauaaccaaauccuggaagagaaugucgaaguggagauuuggaccaaggagggcgaaagaaagaaacucaagccccgcuggcuggaugcucggaucuacagcgacccucuugcccugaaagaguucaaggaauuugcugccgggagaaaaucccucacacugaaccugaucaccgagaugggccgccuccccacguucaugacccagaaggcgcggaaugcccuugauaaccuggcuguccugcauacagccgaagcuggaggcagagccuauaaucacgcccucucugagcugccggagacccuugaaacacugcuccugcugacccuccuugcuacagugaccgggggaauuuuucuguuccugaugagcggcaaggggaucggaaaaaugacgcucggcaugugcugcauuaucacagcguccauucugcuuugguacgcccagauccagccucacuggaucgcugccagcauuauccuggaguuuuuccucauuguucugcugauccccgaacccgagaagcaacggaccccucaggacaaccagcucaccuauguggugauugccauccuuacagucguugcugccaccauggcgaaugaaaugggcuuucuggagaaaacaaagaaagauuucgggcugggaucuaucacgacccagcaacucgaguccaacauucuggacaucgaucuucgcccggccagcgcuuggacacuguacgccguggcuaccacauuuauuacccccaugcucagacauuccaucgaaaauucuagcgugaacgucucccugacggccauugcgaaucaggccaccgugcugaugggccucgggaagggauggccucuuucuaagauggacaucggcguuccccugcuggcuauuggguguuacagccaggugaacccuaucacacucaccgccgcucugcuucugcucgucgcccacuaugcuaucauuggacccggccugcaggccaaagcgacacgggaggcccaaaagcgcgcugccgcuggcaucaugaaaaauccuaccguggacgggauuacggucaucgaucuggacccgauucccuacgauccuaaguucgaaaaacagcucggacaggugaugcuucugguucugugcgugacacagguccucaugaugagaaccacaugggcccugugugaggcccuuacccuggcgaccggccccaucuccacacucugggaagggaacccuggacgguuuuggaauacgaccaucgcugugagcauggccaacauuuuccgcggcucuuaucuggcuggggccggacugcucuuuuccaucaugaagaacacagccaauaccagacggggcacaggcaacaccggggagacgcuuggagagaaguggaaaaaucgccugaacgcucugggcaagagcgaguuccaaauuuacaaaaagucugggauccaggagguugacagaacacucgccaaagaaggaauuaagcggggcgagaccgaucaucacgcgguguccagagggagcgccaaacugcgcugguucgucgagcggaaucuugugacccccgaaggaaaggugguugaccugggcugcggcagagggggauggucuuauuacuguggcgggcucaagaacgucaaagaggugaagggacugacaaaaggcgggccgggacaugaagaaccuauccccaugagcaccuauggcuggaaucuggugcgccuccaguccggcgucgaugucuuuuucacacccccugaaaagugcgacacgcuucugugugauaucggggagucuagccccaacccuaccguggaggcuggacggacacugagagugcucaaucuggucgaaaacuggcuuaauaacaauacccaauuuugcauuaaagugcugaacccguacaugcccuccguuaucgagaagauggaagcccuccagcgcaaguacggcggggcucuggugcggaauccucugagcagaaacuccacacacgagauguauugggucucuaacgccagcggaaauauuguguccucuguuaacaugaucagccgcaugcucauuaaucgguucaccaugagacacaaaaaggcgacguacgaacccgacguggaucuuggcuccgggacccgcaacaucggaaucgagucugagacaccuaaucuggacauuaucggcaaacggauugaaaagaucaaacaggagcaugaaaccagcuggcacuaugaucaggaccaucccuacaagacaugggccuaucacggcuccuacgagaccaagcaaacagggagcgcuucuuccauggucaacggaguggugagacugcucaccaaaccgugggacgucauuccuaugguuacgcagauggccaugacagauaccacccccuuuggccagcagcgcguguucaaggaaaaaguggacacaagaacgcaagagccuaaggaggggaccaaaaagcugaugaagaucacagcugaauggcuuuggaaagagcugggaaagaaaaagacaccccggauguguacacgcgaagaguuuaccagaaaaguccggagcaaugccgcucucggcgccauuuucacagaugagaacaaguggaaaucugcgagagaagccguggaggacuccggguuuugggaacugguugauaaggagcggaaucugcaccucgaaggaaagugcgagaccuguguguauaacaugaugggcaaacgcgagaagaaacugggcgaguucgggaaggcuaaaggaagcagagccaucugguacauguggcuuggcgcucgguuucuggaguucgaagcccucggguuucugaaugaggaccauugguucucucgcgaaaacucccuuagcggagucgagggcgaggggcugcacaagcucggcuacauccugagagauguguccaagaaagaaggaggcgccauguaugcggacgauacggcugggugggacacccggauuacacuggaggaucucaagaaugaagagaugguuaccaaccauauggaaggagagcacaaacgccuggccgaggccaucuucagacuuacauaccagaauaaggugguccgggugcagcgcccuacccccagaggcacgguuauggacauuaucagccggcgcgaccagagagggucuggacaaguggucacauauggccugaacaccuuuacaaacauggaagcucagcucauucggcagauggagggggaaggcguguucaaaagcauccaacaucugaccgucacggaggagaucgccgugaagaauuggcuugcucgcguuggaagagaacggcuguccagaauggccauuucuggcgaugacugcguggucaagccgcucgaugaccgcuuugcgagcgcccugaccgcucugaacgauauggggaaagugcggaaggacauccagcagugggagccuuccagaggauggaaugauuggacacaggugcccuucugcucucaccacuuucaugaacucauuaugaaagacggccgcguucuggugguccccugucggaaccaagaugagcuuaucgggagagcccgcauuagccagggagcuggcuggucccugcgggaaaccgccugccucgggaagucuuacgcgcagauguggagccugauguauuuccacagacgcgaccuucggcuggccgcuaaugccaucuguuccgcugugccuagccauuggguuccgacaucuagaaccacaugguccauccacgccacccacgaguggaugacgacagaggauaugcucaccguguggaaccgcgucuggauucaggaaaaucccuggauggaggacaaaaccccuguggaaagcugggaggaaauccccuaccugggcaagcgggaggaucaauggugcggaucucugauuggccucacauccagagcuaccugggccaagaacauccagacagcgauuaaucagguccggagccugaucgggaacgaggaauauacggacuacaugccuuccaugaaaagauuucgccgggaggaagaggaagccggagugcuuugguga

SEQ ID NO: 20228 - RNA, 9876 nt, Artificial Sequence
  derived and/or modified CDS sequence (opt5) from DENV-2__KC762678__SS-prME
accgccggcaucauuaucaugaugauucccacagugauggcuuuccaccugacgaccagaaacggggagccucauaugaucgucagccggcaggaaaaggggaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagaauccucauuuucauccugcuuacagccgugacgccuuccaugaccaugcggugcauuggaaucucuaaccgcgacuuugucgaaggcgugagcgggggauccuggguugauaucgugcuggagcacggcagcugugucacaaccauggcgaaaaauaagcccacacucgacuucgaacugauuaagaccgaggccaaacacccugcuacgcuuagaaaguacugcaucgaagccaaacugacaaacaccaccacagcuucucgguguccgacccagggggagcccucccucaaugaggaacaagauaagcgcuuugugugcaaacauagcaugguggacagaggauggggcaacggcugugggcuguucggaaagggcgggauugucacaugcgccauguuuacgugcaagaaaaauauggagggaaagaucguucagccugaaaaccuggaguauaccauugugaucacaccccacucuggcgaagagaaugcgguggggaacgauaccggaaaacauggcaaggagaucaaagucacaccucaguccagcauuaccgaagccgagcucacgggcuacgggaccgugacaauggaauguucuccccggaccggacuggacuucaaugagaugguucuucugcagauggaaaacaaggcuuggcucgugcaccgccaaugguuucuggaucuuccgcugccuuggcuccccggcgccgacacacagggguccaacuggauccagaaagagacccuggucacguucaagaauccucacgcuaagaaacaggaugugguugugcugggaagccaagagggcgccaugcauacagcccucaccggggcuacagaaauucagauguccucuggcaaccugcuuuuuaccggacaccugaagugcagacuccggauggacaaacugcagcuuaagggcaugagcuauuccauguguaccgggaaauucaaggucgugaaggagaucgcggaaacacaacauggaacgauugucaucagagugcaguacgagggcgacgggagccccugcaaaauccccuucgagauuauggaucuggaaaagcgccacguucucggacggcugaucaccgugaauccuauugucacagagaaagacucuccggugaacaucgaagccgagcccccuuuuggcgauuccuacauuaucauugggguugaacccggccagcugaagcucagcugguucaaaaagggaucuagcaucggccagauguuugagaccacaaugagaggggcuaagcgcauggccauccugggagacaccgccugggauuucggcucccuugggggaguguuuacgucuauuggcaaagcucugcaucaagucuucggggccaucuauggcgcggcuuuuagcggaguguccuggacaaugaagauucucaucggcgugguuauuaccuggaucgggaugaauagccggucuaccucccugagcgucucucuggugcuugugggagucgugacacucuaccugggcguuauggugcaggccgacuccgggugugucgugagcuggaaaaacaaggagcugaaaugcggauccggcaucuucauuaccgauaauguucacacauggacggaacaguauaaguuucagccugagucucccagcaagcucgccuccgcuauccaaaaagcccacgaagaggggauuuguggcaucagaucugugacccgccuggaaaaccuuauguggaagcagauuacaccggagcugaaucauauccucagcgagaacgaagucaaacugaccaucaugacaggagacauuaagggcaucaugcaggcugggaaacggucccugagaccucagcccaccgagcuuaaguacagcuggaaaacguggggaaaggccaagaugcucucuaccgaacugcacaaucauacauuccugauugauggcccugagaccgcggaaugccccaacgccaaucgcgcuuggaacucccucgagguggaggacuauggguuuggaguuuucacaaccaauaucuggcugaaacuuaaggaacggcaagaugccuuuugugacagcaaacugaugucugcugccauuaaggacaacagagcggugcacgccgauaugggcuacuggaucgaguccgcucucaacgacacauggaaaaucgaaaaggccagcuucauugaggucaagucuugccacuggccuaaaagccauacccugugguccaauggcgugcuggagagcgaaaugaucauucccaagaacuucgcugggccggugucucagcacaauuaucgcccuggauaccauacgcagacagccggccccuggcaccuugggcggcucgagauggauuuugacuucugugaaggaaccaccgucguugugacagaggauugcggcaacagagggcccucccugcggaccacgacagccagcggaaaacugaucaccgaauggugcugucgcuccugcacacucccuccgcugagauaccggggcgaggacggcuguugguaugggauggagauuagaccccuuaaggaaaaagaggaaaaucuggugaacucucucgucaccgcuggacauggccagaucgauaauuuuagccugggggugcugggaauggcgcuuuuccucgaggaaaugcugcgcacacggguuggcaccaagcacgccauucugcucguggcugucuccuuugugacgcugaucaccgggaacaugucuuucagagaccuuggacgcguuauggugauggucggcgccacaaugaccgaugacaucggcauuggggugacauaccuggcccuccuggcugccuuuaagguuagaccuaccuucgcggcuggacugcuucugcggaaacucacgagcaaggagcugaugaugacaaccaucggcauuacacuccugucccaaucuaccauccccgagaccauucuugaacugacagaugcccucgcccuggggaugauggugcugaaaaucguccgcaauauggagaaguaucagcuugcugugacgaucauggccauucugugcgugccuaacgcggucauccuccagaaugcuuggaaaguuagcuguaccacacuggccgugguguccgucagcccccuccugcuuaccucuucccaacagaaggccgacuggauuccucuggcucucacaaucaagggacugaaccccaccgccauuuuucugacgacacuuagcagaaccucuaaaaagcgguccuggccgcugaaugaagcuaucauggccgugggcaugguuagcauccucgcgucuucccugcucaaaaacgauauuccuaugaccgggccccugguggccggaggccuucugacagucugcuacgugcugaccggccgcagcgcugaccucgagcuggaaagagccgcugacguucggugggaggagcaggccgaaaucuccgggagcucuccuauucuuagcaucacaauuuccgaggauggaucuaugagcaucaagaaugaagaggaggaacagacgcugaccauucucauccgcacaggccugcucgugaucuccgggcuguuccccgucucuauuccgaucaccgccgcugcgugguaucuuugggaggugaaaaagcaaagagccggaguccugugggacgugccuucucccccucccguuggcaaagcugaacuggaggauggggccuaccggauuaagcagaagggaauccucggcuauucccagauuggcgccgggguguacaaagaaggaacauuucacaccauguggcaugucacgcgcggcgcugugcugaugcacaaggggaaaagaaucgagcccuccugggccgacguuaagaaagaucuuaucagcuacggaggcggguggaagcuggagggagaauggaaggagggcgaagaggugcagguccucgcgcuggaaccuggcaaaaacccgcgggcugugcaaaccaagcccggacucuucaaaacauccaccggaacaauuggcgccgugagccuggacuuuucuccugggaccuccggaagccccaucguugauaagaaaggcaaggucguggggcuuuauggaaacggcguggucacaagaucuggcacguacguguccgccauugcucagaccgaaaagagcaucgaggacaauccugaaauugaggaugacaucuuccgcaaaaagcggcugacaaucauggaucugcaucccggggccggaaaaaccaagagauaucucccugcgauuguucgcgaagcuaucaaacggggccugagaacccuuauucuggccccgacacgcguggucgccgcugagauggaagaggcccuccgggggcugcccaucagauaccagacgccugcuauucgcgccgagcacaccggacgggaaaucguggaccucaugugucaugcgacauucaccaugagacugcuuucccccauucggguuccuaacuauaaucugaucaucauggaugaggcccacuuuacagaccccgcuucuauugccgcucgcggcuacaucagcaccagaguggaaaugggggaggccgccggcauuuucaugacggcuacaccgccuggaucccgggaccccuuuccccagagcaacgcgccuaucauggaugaggaacgcgagauucccgaaagaucuuggaauagcggccacgagugggucaccgacuucaaggggaagaccgugugguuuguuccuagcaucaaagccggaaacgauaucgcugccugccugcggaagaauggcaaaaaggugauucaacucucuagaaaaacauucgacagcgaauauaucaagacccgcacaaacgauugggacuuugucgugaccacggauauuuccgagaugggggccaauuucaaggcugagcgggugaucgacccgagacgcuguaugaaacccgucauucugacagauggagaggaacggguuauccuugccggcccuaugcccgugacccauucuagcgcggcucagagacgcgggcgggugggcagaaacccuaagaaugaaaacgaccaguacaucuacaugggagagccccuggaaaaugaugaggacugcgcccacuggaaagaggccaagaugcuccuggacaacauuaauacaccggaaggcaucauuccuuccauguuugagcccgaacgcgagaaagucgaugcuaucgacggggaauauagacugcggggagaggcccgcaagaccuucguggaucucaugagacggggcgaccuuccuguuuggcuggcguaccgcguggccgcugaggggauuaacuaugccgauagacggugguguuuugacggagucaaaaacaaucaaauccuggaagagaacguggaaguugagauuuggacgaaggagggcgaaagaaagaaacucaagccccgcuggcuggaugcucggaucuacucugacccucuugcccugaaagaguucaaggaguucgcugccgggagaaaaagccucacccugaaucugaucacagagaugggccgccuccccaccuuuaugacacagaaggugcggaacgcgcuugauaaucuggccguccugcauaccgcugaagccggaggcagagcuuauaaccacgcccucuccgagcugccggagacacuugaaacccugcuccugcugacgcuccuugccacagugaccgggggaauuuuccuguuucugaugagcggcaagggggucggaaaaaugacccucggcaugugcugcaucauuacagcuucuauccugcuuugguacgcgcagauucagccucacuggaucgccgcuuccaucauucuggaguucuuucucaucgugcugcugauucccgaacccgagaagcaacggaccccucaggacaaucagcucacauauguugugaucgccauucuuacgguggucgccgcuaccauggccaacgaaaugggcuuccuggagaaaacaaagaaagauuuugggcugggaagcaucaccacacagcaaccggaguccaauauccucgacauugaucugcgccccgcgucugccuggacccuuuacgcuguugccacgaccuucaucacaccuaugcugagacauagcauugaaaacuccucugugaaugugagccucaccgcuaucgccaaccaggcgacaguccugaugggccuggggaagggauggccccucuccaagauggacauuggcgugccucuucuggccaucggguguuacagccagguuaaucccauuacccugacggcugcccuccugcuucugguggcucacuaugccaucaucggaccuggccuccaggcuaaagccacacgggaggcgcaaaagcgcaccgccgcuggcauuaugaaaaacccgacagucgacgggaucaccgugauugaucuggaccccaucccuuacgaucccaaguuugaaaaacagcugggacaggucaugcuccuugugcugugcguuacccaggugcugaugaugagaacaacgugggcccucugugaggcucugacccuugccacaggcccuauuucuacccugugggaagggaaucccggacgguucuggaacacaaccaucgccgucuccauggcgaauaucuuucgcggcagcuaucucgcuggggccggacugcuguucucuauuaugaagaacacggcuaacacaagacggggcaccggcaauaccggggagacacucggagagaaguggaaaaaccgccuuaaugcccugggcaaguccgaauuucaaaucuacaaaaagagcgggauucaggagguggacagaacccuggccaaagaaggaaucaagcggggcgagacagaucaucacgcuguuucuagagggagcgccaaacuccgcugguucguggagcggaaccuggucacgccggaaggaaaggugguggaccuuggcugcggcagagggggaugguccuauuacuguggcgggcugaagaauguuaaagaggucaagggacucaccaaaggcgggccuggacaugaggaacccauucccaugucuacauauggcuggaaccuggugcgccugcagagcggcguggaugucuucuuuaccccucccgaaaagugcgacacacuccuuugugauaucggggaguccagcccuaauccgaccguugaggcgggacggacgcugagagugcugaaccucguggaaaauuggcugaacaauaacacccaauucugcaucaaaguccuuucccccuacaugccuucugugauugagaagauggaagcccugcagcgcaaguacggcggggcucucguucggaauccccugagcagaaacuccacacacgagauguauugggugucuaaugccagcggaaacaucgucuccucugugaacaugauuagccgcaugcugaucaaucgguuuaccaugagacacaaaaaggcuacauacgaaccugacguugaucucggcuccgggacccgcaacauuggaaucgagagcgagacacccaaucuugacaucauuggcaaacggaucgaaaagauuaaacaggagcaugaaaccucuuggcacuaugaucaggaccauccguacaagacgugggccuaucacggcuccuacgagacaaagcaaaccgggagcgcgucuuccauggugaacggagucgugagacugcugaccaaaccuugggacgugauccccauggucacacagauggccaugacggauaccacaccuuucggccagcagcgcguuuuuaaggaaaaaguggacaccagaacacaagagcccaaggaggggaccaaaaagcucaugaagauuacagcugaauggcuguggaaagagcuuggaaagaaaaagaccccucggauguguacgcgcgaagaguucaccagaaaagugcggagcaaugccgcucugggcgccaucuuuacagaugagaacaaguggaaaucugcuagagaagccgucgaggacuccggguucugggaacucguggauaaggagcggaaucugcaccuggaaggaaagugcgagaccuguguuuauaacaugaugggcaaacgcgagaagaaacucggcgaauuugggaaggcgaaaggaagcagagccauuugguacauguggcugggcgcucgguuccuugaguuugaagcccugggguuccucaaugaggaccauugguuuucccgcgaaaacagccugucuggaguggagggcgaggggcuucacaagcugggcuacauccucagagaugucagcaagaaagaaggaggcgcuauguaugccgacgauacagccgggugggacacccggaucacgcuggaggaucugaagaaugaagagauggugacaaaccauauggaaggagagcacaaaaagcucgcggaggcuauuuucaaacugaccuaccagaauaagguugugcgcguccagagacccacaccgcggggcaccgugauggacaucauuucccgcagagaccagcgggggucuggacaaguugugacguauggccuuaacaccuucacaaauauggaagcccagcugauccgccagauggagggggaaggcgucuuuaagagcauucaacagcucaccgugacagaggagaucgccgucaaaaacuggcuggugaccguuggaagagaacggcuuucccgcauggcuaucucuggcgaugacugcguggucaagccucuggaugacagauucgccagcgcucucacagcccugaacgauauggggaaagugcggaaggacauucagcagugggagcccuccagaggauggaaugauuggacccaagugcccuuuugcucucaucacuuccacgaacugaucaugaaagacggccgcguucucguggucccuugucggaaccaggaugagcugauugggagagcgcgcaucagccagggagccggcuggucccuucgggaaacggcuugccugggaaagagcuacgcccagauguggucucucauguauuuucauagacgcgaccugcggcuugcugccaaugcgauuuguuccgccgugccgagccacuggguucccacaucuagaaccaccugguccauccaugcuacacacgaguggaugaccacagaggauaugcugacgguguggaaccgcgucuggauccaagaaaauccuuggauggaggacaagacccccguggaaagcugggaggaaauuccuuaccucggcaaacgggaggaucaguggugcggaucccugaucggccugacaucuagagccaccugggcuaagaacauucagacagccaucaaucagguccgcagccucauugggaacgaggaauauaccgacuacaugcccuccaugaaacgguucagacgggaggaagaggaagcuggagugcugugguga

SEQ ID NO: 20229 - RNA, 9876 nt, Artificial Sequence
  derived and/or modified CDS sequence (opt5) from DENV-2__KC762679__SS-prME
accgccggcaucauuaucaugaugauucccacggugauggcuuuccaccugacgaccagaaauggggagccucauaugaucgucucccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgcuacgugcucggacggcugauuacggucaauccuaucgugaccgagaaagacucuccgguuaacauugaagcugagcccccuuuuggcgauuccuauaucauuaucgggguggaacccggccagcugaagcucaauugguucaaaaagggaagcucuauuggccagauguuugagacaaccaugagaggggccaagcgcauggccauccugggagacacagcuugggauuucggcagccuugggggagucuuuaccuccaucggcaaagcccugcaccaaguguucggggcgauuuacggcgcugccuuuucuggagugagcuggacgaugaagauccucauuggcguugucaucacauggauugggaugaacucccggagcaccucucuguccgugagccuggugcuugucggagugguuacccucuaucugggcgugaugguccaggccgacucugggugugugguuuccuggaaaaauaaggagcugaaaugcggaagcggcaucuucaucacagauaacgugcauaccuggacagaacaguacaaguuucagccugagucccccucuaagcucgcuagcgccauucaaaaagcucacgaagaggggaucuguggcauuagauccgucacgcgccuggaaaaucuuauguggaagcagaucaccccggagcugaaccacauucucucugagaaugaagugaaacugacaaucaugaccggagacaucaagggcauuaugcaggccgggaaacggagccugagaccucagcccacagagcuuaaguauuccuggaaagcguggggaaaggccaagaugcucagcaccgaacugcauaaccacacguuccugaucgauggcccugagaccgcugaaugccccaauacaaaccgcgccuggaacucucucgagguugaggacuacggguuuggaguguucaccacaaacauuuggcugaaacuuaaggaacggcaagaugucuuuugugacuccaaacugaugagcgcugccaucaaggacucuagagcggugcaugccgauaugggcuauuggauugaguccgcucucaacgacaccuggaaaaucgaaaaggccagcuucaucgaggugaagucuugccacuggccuaaaagccacacacugugguccaauggcguccuggagagcgaaaugauuauccccaagaacuucgcugggccgguuucucagcauaauuaccgcccuggauaccacacccagacggccggccccuggcaucuugggcggcucgagauggauuuugacuucugugaaggaacaaccgugguggucaccgaggauugcggcaacagagggcccucccugcggacaaccacggccagcggaaaacugauuacagaauggugcugucgcuccugcacccucccuccgcugagauaucggggcgaggacggcuguugguacgggauggagaucagaccccuuaaggaaaaagaggaaaaucuggugaacucucucguuacagcuggacacggccagauugauaauuuuagccugggggugcugggaauggcgcuuuuccucgaggaaaugcugcgcacccgggucggcacaaagcaugccauccugcucguggcuguuuccuuugugacccugauuacggggaacaugucuuucagagaccuuggacgcgucauggugaugguuggcgccaccaugacagaugacaucggcaugggggugaccuaucuggcccuccuggcugccuuuaaggucagaccuacauucgcggcuggacugcuucugcggaaacucaccagcaaggagcugaugaugacgacaaucggcauugugcuccugucccaagccaccauccccgagacaauucuugaacugaccgaugcccucgcucuggggaugauggugcugaaaaucguccgcaauauggagaaguaccagcuugccguuaccauuauggcgauccugugcgugccuaacgcugugauccuccagaaugccuggaaagucucuuguacaacgcuggccgugguuagcgugagcccccuccugcuuaccagcucucaacagaaggcugacuggauuccucuggcccucacaaucaagggacugaaccccaccgcuauuuuucugacaacccuuuccagaacgagcaaaaagcggucuuggccgcugaaugaagccaucauggcggucggcaugguguccauucucgccagcucucugcucaaaaacgauaucccuaugacagggccccugguugcuggaggccuucugaccgugugcuauguccugaccggccgcuccgccgaccucgagcuggaaagagcugccgacgugcggugggaggagcaggccgaaaucagcggguccagcccuauucuuucuaucacaauuagcgaggauggauccaugucuaucaagaaugaagaggaggaacagacccugacaauucucauccgcacgggccugcucgucauuagcgggcuguuccccguguccaucccgaucaccgcugcggccugguaccuuugggagguuaaaaagcaaagagcuggagugcugugggacgucccuucucccccucccgugggcaaagccgaacuggaggauggggccuaucggauuaagcagaagggaauccucggcuacagccagauuggcgcugggguuuacaaagaaggaacauuucacaccauguggcacgugacacgcggcgccguccugaugcauaaggggaaaagaaucgagcccuccugggcggacgugaagaaagaucuuauuucuuauggaggcggguggaagcuggagggagaauggaaggagggcgaagaggugcagguucucgcucuggaaccuggcaaaaacccgcgggccguccaaaccaagcccggacucuucaaaacgaacaccggaacaaucggcgccgugagccuggacuuuuccccugggaccagcggaucucccaucguggauaagaaaggcaaggucguggggcuuuacggaaauggcguugugacaagauccggcaccuaugucagcgcuauugcccagacagagaagucuaucgaggacaacccugaaauugaggaugacaucuuccgcaaaaagcggcugacgauuauggaucugcaccccggggcgggaaaaaccaagagauaccucccugcuaucgugcgcgaagccaucaaacggggccugagaacacuuauucuggccccgacccgcguuguggcugccgagauggaagaggcucuccgggggcugcccaucagauaucagaccccugccauucgcgcggagcauacaggacgggaaaucgucgaccucaugugucacgccacguucaccaugagacugcuuucccccauucgggugccuaauuacaaccugaucauuauggaugaggcucauuuuacagaccccgccagcaucgcugcccgcggcuauaucuccaccagaguugaaaugggggaggccgcuggcauuuucaugacagcgaccccgccuggaucucgggaccccuuuccccagagcaaugccccuaucauggaugaggaacgcgagauucccgaaagauccuggaacagcggccacgagugggugacggacuucaaggggaagacagucugguuugugccuucuaucaaagcuggaaaugauauugccgccugccugcggaagaacggcaaaaaggugauccaacucuccagaaaaaccuucgacagcgaauacaucaagacccgcacaaaugauugggacuuugucguuaccacagauauuucugagaugggggcuaacuucaaggccgagcgggugaucgacccgagacgcuguaugaaacccgugauucugaccgauggagaagaacgggucauccuugcgggcccuaugcccgugacgcacagcuccgcugcccagagacgcgggcggguuggcagaaauccuaagaacgaaaaugaccaguacauuuauaugggagagccccuggaaaacgaugaggacugcgcccauuggaaagaggcuaagaugcuccuggacaauaucaacacaccggaaggcaucauuccuucuauguuugagcccgaacgcgagaaaguggaugccaucgacggggaauacagacugcggggagaggcgcgcaagaccuucgucgaucucaugagacggggcgaccuuccuguguggcuggccuaucgcguugcugccgaggggauuaacuacgcugauagacggugguguuuugacggagugaaaaauaaccaaauccuggaagagaaugucgaaguggagauuuggacaaaggagggcgaaagaaagaaacucaagccccgcuggcuggaugcccggaucuauagcgacccucuugcucugaaagaguucaaggaguucgccgcggggagaaaaucccucacccugaaccugauuacggagaugggccgccuccccaccuuuaugacacagaaggcccggaaugcucuugauaaccuggccguccugcacaccgcugaagccggaggcagagccuacaaucaugcucucucugagcugccggagacacuugaaacccugcuccugcugacacuccuugcgaccgugacaggcgggaucuuccuguuucugaugagcgggaaggggaucggaaaaaugacacucggcaugugcugcauuaucaccgccuccauucugcuuugguaugcucagauccagccucacuggauugccgccagcaucauccuggaguucuuucucauuguucugcugauccccgaacccgagaagcaacggaccccucaggacaaccagcucacauacguggugauugcuauccuuaccgucguugccgcgacaauggccaaugaaaugggcuuccuggagaaaacgaagaaagauuuugggcugggaucuauuaccacacagcaaccggaguccaacauccucgacaucgaucugcgccccgcuagcgccuggacccuuuacgcuguggccacaaccuucauuacgccuaugcugagacacuccaucgaaaauucuagcgugaacgucucccucaccgcgauugccaaucaggcuacagugcugaugggccuggggaagggauggccccucucuaagauggacaucggcguuccucuucuggccauuggguguuauagccaggugaaccccaucacccugacagcugcccuccugcuucuggucgcucauuacgccauuaucggaccuggccuccaggcgaaagccacccgggaggcucaaaagcgcgccgcugccggcaucaugaaaaauccgacgguggacgggauuacagucaucgaucuggaccccauuccuuaugaucccaaguuugaaaaacagcugggacaggugaugcuccuuguucugugcgugacccagguccugaugaugagaacaaccugggcccucugugaggcgcugacccuugcuacaggcccuaucuccacgcugugggaagggaaccccggacgguucuggaauaccacaauugccgugagcauggcuaacaucuuucgcggcucuuaccucgccggggccggacugcuguucuccaucaugaagaacaccgcuaauacaagacggggcaccggcaacacgggggagacacucggagagaaguggaaaaaucgccuuaacgcccugggcaagagcgaauuucaaauuuauaaaaagucugggauccaggagguugacagaacccuggcgaaagaaggaauuaagcggggcgagaccgaucaccaugccguguccagagggagcgcuaaacuccgcugguucgucgagcggaaucuggugacaccggaaggaaaggugguugaccuuggcugcggcagagggggauggucuuacuauuguggcgggcugaagaacgucaaagaggugaagggacucaccaaaggcgggccuggacacgaggaacccauccccaugagcacauacggcuggaaucuggugcgccugcaguccggcgucgauguuuucuuuacgccucccgaaaagugcgacacccuccuuugugauauuggggagucuagcccuaacccgacaguggaggccggacggacccugagagugcugaaucucgucgaaaacuggcugaauaacaauacacaauucugcaucaaagugcuuaaccccuacaugccuuccguuaucgagaagauggaagcucugcagcgcaaguauggcggggcccucgugcggaauccccugagcagaaacuccacccaugagauguacugggucucuaacgcgagcggaaauauuguguccucuguuaacaugaucagccgcaugcugauuaaucgguuuacgaugagacacaaaaaggccaccuaugaaccugacguggaucucggcuccgggacacgcaacaucggaauugagucugagacccccaaucuugacaucaucggcaaacggauugaaaagaucaaacaggagcacgaaacaagcuggcauuacgaucaggaccacccguauaagaccugggcuuaccauggcuccuaugagacaaagcaaaccgggagcgccucuuccauggucaacggaguggugagacugcugacgaaaccuugggacgucauucccaugguuacacagauggcuaugaccgauaccacaccuuucggccagcagcgcguguuuaaggaaaaaguggacacgagaacccaagagcccaaggaggggaccaaaaagcucaugaagaucaccgccgaauggcuguggaaagagcuuggaaagaaaaagacaccucggauguguacccgcgaagaguucacaagaaaaguccggagcaaugcugcccugggcgcgauuuuuaccgaugagaacaaguggaaaucugccagagaagcuguggaggacuccggguucugggaacucguugauaaggagcggaaucugcaccuggaaggaaagugcgagacguguguguacaacaugaugggcaaacgcgagaagaaacucggcgaauuugggaaggccaaaggaagcagagcuaucugguacauguggcugggcgcccgguuccuugaguuugaagcccugggguuccucaaugaggaccacugguuuucucgcgaaaacucccugagcggagucgagggcgaggggcuucauaagcugggcuauauucucagagauguguccaugaaggaaggaggcgcgauguacgcugacgauaccgccgggugggacacacggaucacccuggaggaucugaaaaaugaagagaugguuacaaaccacauggaaggagagcauaagaaacucgccgaggcuaucuucaagcugaccuaucagaauaaagugguccgcgugcagagacccacgccgcggggcacaguuauggacauuaucagccgcagagaccagcgggggucuggacaaguggucaccuacggccuuaacacauucaccaacauggaagcccagcugauucgccagauggagggggaaggcguguuuaagagcauccaacagcucacggucaccgaggagauugcugugaagaauuggcugguuagagugggacgggaacgccuuuccagaauggccaucucuggcgaugacugcgucgugaaaccucuggaugaccgguucgcgagcgcccucacagcucugaacgauauggggaaggugagaaaagacauccagcagugggagcccucccgcggauggaaugauuggacccaaguucccuuuugcucucaccauuuccacgaacugauuaugaaggacggccgggugcucgucgugccuuguagaaaccaggaugagcugaucgggcgcgcccggauuagccagggagcuggcuggucccuuagagaaacagccugccuggggaaaucuuaugcgcagauguggagccucauguacuuucaccgccgggaccugagacuugccgcuaaugccaucuguuccgcuguuccgagccauugggugcccaccucucgcacaaccugguccauucacgccacgcaugaguggaugacaaccgaggauaugcugaccgucuggaaccggguguggauccaagaaaauccuuggauggaggacaagacacccgucgaaagcugggaggaaaucccuuaucucggcaagagagaggaucaguggugcggaucucugauuggccugaccucccgcgcuacaugggccaaaaacauccagacggcgauuaaucaggugcggagccucaucgggaacgaggaauacaccgacuacaugcccuccaugaagagauuccggagagaggaagaggaagccggaguucugugguga

SEQ ID NO: 20230 - RNA, 9876 nt, Artificial Sequence
  derived and/or modified CDS sequence (opt5) from DENV-2__KC762680__SS-prME
accgccggcaucauuaucaugaugauucccacggugauggcuuuccaccugacgaccagaaauggggagccucauaugaucgucucccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgcuacgugcucggacggcugauuacggucaauccuaucgugaccgagaaagacucuccgguuaacauugaagcugagcccccuuuuggcgauuccuauaucauuaucgggguggaacccggccagcugaagcucaauugguucaaaaagggaagcucuauuggccagauguuugagacaaccaugagaggggccaagcgcauggccauccugggagacacagcuugggauuucggcagccuugggggagucuuuaccuccaucggcaaagcccugcaccaaguguucggggcgauuuacggcgcugccuuuucuggagugagcuggacgaugaagauccucauuggcguugucaucacauggauugggaugaacucccggagcaccucucuguccgugagccuggugcuugucggagugguuacccucuaucugggcgugaugguccaggccgacucugggugugugguuuccuggaaaaauaaggagcugaaaugcggaagcggcaucuucaucacagauaacgugcauaccuggacagaacaguacaaguuucagccugagucccccucuaagcucgcuagcgccauucaaaaagcucacgaagaggggaucuguggcauuagauccgucacgcgccuggaaaaucuuauguggaagcagaucaccccggagcugaaccacauucucucugagaaugaagugaaacugacaaucaugaccggagacaucaagggcauuaugcaggccgggaaacggagccugagaccucagcccacagagcuuaaguauuccuggaaagcguggggaaaggccaagaugcucagcaccgaacugcauaaccacacguuccugaucgauggcccugagaccgcugaaugccccaauacaaaccgcgccuggaacucucucgagguugaggacuacggguuuggaguguucaccacaaacauuuggcugaaacuuaaggaacggcaagaugucuuuugugacuccaaacugaugagcgcugccaucaaggacucuagagcggugcaugccgauaugggcuauuggauugaguccgcucucaacgacaccuggaaaaucgaaaaggccagcuucaucgaggugaagucuugccacuggccuaaaagccacacacugugguccaauggcguccuggagagcgaaaugauuauccccaagaacuucgcugggccgguuucucagcauaauuaccgcccuggauaccacacccagacggccggccccuggcaucuugggcggcucgagauggauuuugacuucugugaaggaacaaccgugguggucaccgaggauugcggcaacagagggcccucccugcggacaaccacggccagcggaaaacugauuacagaauggugcugucgcuccugcacccucccuccgcugagauaucggggcgaggacggcuguugguacgggauggagaucagaccccuuaaggaaaaagaggaaaaucuggugaacucucucguuacagcuggacacggccagauugauaauuuuagccugggggugcugggaauggcgcuuuuccucgaggaaaugcugcgcacccgggucggcacaaagcaugccauccugcucguggcuguuuccuuugugacccugauuacggggaacaugucuuucagagaccuuggacgcgucauggugaugguuggcgccaccaugacagaugacaucggcaugggggugaccuaucuggcccuccuggcugccuuuaaggucagaccuacauucgcggcuggacugcuucugcggaaacucaccagcaaggagcugaugaugacgacaaucggcauugugcuccugucccaagccaccauccccgagacaauucuugaacugaccgaugcccucgcucuggggaugauggugcugaaaaucguccgcaauauggagaaguaccagcuugccguuaccauuauggcgauccugugcgugccuaacgcugugauccuccagaaugccuggaaagucucuuguacaacgcuggccgugguuagcgugagcccccuccugcuuaccagcucucaacagaaggcugacuggauuccucuggcccucacaaucaagggacugaaccccaccgcuauuuuucugacaacccuuuccagaacgagcaaaaagcggucuuggccgcugaaugaagccaucauggcggucggcaugguguccauucucgccagcucucugcucaaaaacgauaucccuaugacagggccccugguugcuggaggccuucugaccgugugcuauguccugaccggccgcuccgccgaccucgagcuggaaagagcugccgacgugcggugggaggagcaggccgaaaucagcggguccagcccuauucuuucuaucacaauuagcgaggauggauccaugucuaucaagaaugaagaggaggaacagacccugacaauucucauccgcacgggccugcucgucauuagcgggcuguuccccguguccaucccgaucaccgcugcggccugguaccuuugggagguuaaaaagcaaagagcuggagugcugugggacgucccuucucccccucccgugggcaaagccgaacuggaggauggggccuaucggauuaagcagaagggaauccucggcuacagccagauuggcgcugggguuuacaaagaaggaacauuucacaccauguggcacgugacacgcggcgccguccugaugcauaaggggaaaagaaucgagcccuccugggcggacgugaagaaagaucuuauuucuuauggaggcggguggaagcuggagggagaauggaaggagggcgaagaggugcagguucucgcucuggaaccuggcaaaaacccgcgggccguccaaaccaagcccggacucuucaaaacgaacaccggaacaaucggcgccgugagccuggacuuuuccccugggaccagcggaucucccaucguggauaagaaaggcaaggucguggggcuuuacggaaauggcguugugacaagauccggcaccuaugucagcgcuauugcccagacagagaagucuaucgaggacaacccugaaauugaggaugacaucuuccgcaaaaagcggcugacgauuauggaucugcaccccggggcgggaaaaaccaagagauaccucccugcuaucgugcgcgaagccaucaaacggggccugagaacacuuauucuggccccgacccgcguuguggcugccgagauggaagaggcucuccgggggcugcccaucagauaucagaccccugccauucgcgcggagcauacaggacgggaaaucgucgaccucaugugucacgccacguucaccaugagacugcuuucccccauucgggugccuaauuacaaccugaucauuauggaugaggcucauuuuacagaccccgccagcaucgcugcccgcggcuauaucuccaccagaguugaaaugggggaggccgcuggcauuuucaugacagcgaccccgccuggaucucgggaccccuuuccccagagcaaugccccuaucauggaugaggaacgcgagauucccgaaagauccuggaacagcggccacgagugggugacggacuucaaggggaagacagucugguuugugccuucuaucaaagcuggaaaugauauugccgccugccugcggaagaacggcaaaaaggugauccaacucuccagaaaaaccuucgacuuugaauacaucaagacccgcacaaaugauugggacuucgucguuaccacagauauuagcgagaugggggcuaacuuuaaggccgagcgggugaucgacccgagacgcuguaugaaacccgugauucugaccgauggagaagaacgggucauccuugcgggcccuaugcccgugacgcacucuagcgcugcccagagacgcgggcggguuggcagaaauccuaagaacgaaaaugaccaguacauuuauaugggagagccccuggaaaacgaugaggacugcgcccauuggaaagaggcuaagaugcuccuggacaauaucaacacaccggaaggcaucauuccuuccauguucgagcccgaacgcgagaaaguggaugccaucgacggggaauacagacugcggggagaggcgcgcaagaccuuugucgaucucaugagacggggcgaccuuccuguguggcuggccuaucgcguugcugccgaggggauuaacuacgcugauagacggugguguuucgacggagugaaaaauaaccaaauccuggaagagaaugucgaaguggagauuuggacaaaggagggcgaaagaaagaaacucaagccccgcuggcuggaugcccggaucuauucugacccucuugcucugaaagaguucaaggaauuugccgcggggagaaaaagccucacccugaaccugauuacggagaugggccgccuccccaccuucaugacacagaaggcccggaaugcucuugauaaccuggccguccugcacaccgcugaagccggaggcagagccuacaaucaugcucucuccgagcugccggagacacuugaaacccugcuccugcugacacuccuugcgaccgugacaggcgggaucuuucuguuccugaugucugggaaggggaucggaaaaaugacacucggcaugugcugcauuaucaccgccagcauucugcuuugguaugcucagauccagccucacuggauugccgccuccaucauccuggaguuuuuccucauuguucugcugauccccgaacccgagaagcaacggaccccucaggacaaccagcucacauacguggugauugcuauccuuaccgucguugccgcgacaauggccaaugaaaugggcuuucuggagaaaacgaagaaagauuucgggcugggaagcauuaccacacagcaaccggagucuaacauccucgacaucgaucugcgccccgcuuccgccuggacccuuuacgcuguggccacaaccuuuauuacgccuaugcugagacacagcaucgaaaauuccucugugaacgucagccucaccgcgauugccaaucaggcuacagugcugaugggccuggggaagggauggccccucuccaagauggacaucggcguuccucuucuggccauuggguguuauucucaggugaaccccaucacccugacagcugcccuccugcuucuggucgcucauuacgccauuaucggaccuggccuccaggcgaaagccacccgggaggcucaaaagcgcgccgcugccggcaucaugaaaaauccgacgguggacgggauuacagucaucgaucuggaccccauuccuuaugaucccaaguucgaaaaacagcugggacaggugaugcuccuuguucugugcgugacccagguccugaugaugagaacaaccugggcccucugugaggcgcugacccuugcuacaggcccuaucagcacgcugugggaagggaaccccggacgguuuuggaauaccacaauugccguguccauggcuaacaucuuccgcggcagcuaccucgccggggccggacugcuguuuucuaucaugaagaacaccgcuaauacaagacggggcaccggcaacacgggggagacacucggagagaaguggaaaaaucgccuuaacgcccugggcaaguccgaguuccaaauuuauaaaaagagcgggauccaggagguugacagaacccuggcgaaagaaggaauuaagcggggcgagaccgaucaccaugccgugucuagaggguccgcuaaacuccgcugguucgucgagcggaaucuggugacaccggaaggaaaggugguugaccuuggcugcggcagagggggauggagcuacuauuguggcgggcugaagaacgucaaagaggugaagggacucaccaaaggcgggccuggacacgaagaacccauccccaugucuacauacggcuggaaucuggugcgccugcagagcggcgucgaugucuuuuucacgccucccgaaaagugcgacacccuccuuugugauauuggggaguccucuccuaacccgacaguggaggccggacggacccugagagugcugaaucucgucgaaaacuggcugaauaacaauacacaauuuugcaucaaagugcuuaaccccuacaugccuagcguuaucgagaagauggaagcucugcagcgcaaguauggcggggcccucgugcggaauccccuguccagaaacagcacccaugagauguacugggucuccaacgcgucuggaaauauugugagcuccguuaacaugaucucucgcaugcugauuaaucgguucacgaugagacacaaaaaggccaccuaugaaccugacguggaucucggcagcgggacacgcaacaucggaauugaguccgagacccccaaucuugacaucaucggcaaacggauugaaaagaucaaacaggagcacgaaacaucuuggcauuacgaucaggaccacccguauaagaccugggcuuaccauggcagcuaugagacaaagcaaaccggguccgccagcucuauggucaacggaguggugagacugcugacgaaaccuugggacgucauucccaugguuacacagauggcuaugaccgauaccacaccuuuuggccagcagcgcguguucaaggaaaaaguggacacgagaacccaagagcccaaggaggggaccaaaaagcucaugaagaucaccgccgaauggcuguggaaagagcuuggaaagaaaaagacaccucggauguguacccgcgaagaguuuacaagaaaaguccgguccaaugcugcccugggcgcgauuuucaccgaugagaacaaguggaaaagcgccagagaagcuguggaggacucuggguuuugggaacucguugauaaggagcggaaucugcaccuggaaggaaagugcgagacguguguguacaacaugaugggcaaacgcgagaagaaacucggcgaguucgggaaggccaaaggauccagagcuaucugguacauguggcugggcgcccgguuucuugaguucgaagcccugggguuucucaaugaggaccacugguucagccgcgaaaacucucuguccggagucgagggcgaggggcuucauaagcugggcuauauucucagagaugugagcaugaaggaaggaggcgcgauguacgcugacgauaccgccgggugggacacacggaucacccuggaggaucugaaaaaugaagagaugguuacaaaccacauggaaggagagcauaagaaacucgccgaggcuaucuucaagcugaccuaucagaauaaagugguccgcgugcagagacccacgccgcggggcacaguuauggacauuaucucccgcagagaccagcgggggagcggacaaguggucaccuacggccuuaacacauuuaccaacauggaagcccagcugauucgccagauggagggggaaggcguguucaagucuauccaacagcucacggucaccgaggagauugcugugaagaauuggcugguuagagugggacgggaacgccuuagcagaauggccaucuccggcgaugacugcgucgugaaaccucuggaugaccgguuugcgucugcccucacagcucugaacgauauggggaaggugagaaaagacauccagcagugggagcccagccgcggauggaaugauuggacccaaguucccuucugcucccaccauuuucacgaacugauuaugaaggacggccgggugcucgucgugccuuguagaaaccaggaugagcugaucgggcgcgcccggauuucucagggagcuggcuggagccuuagagaaacagccugccuggggaaauccuaugcgcagauguggucucucauguacuuccaccgccgggaccugagacuugccgcuaaugccaucuguagcgcuguuccgucccauugggugcccaccagccgcacaaccuggucuauucacgccacgcaugaguggaugacaaccgaggauaugcugaccgucuggaaccggguguggauccaagaaaauccuuggauggaggacaagacacccgucgaauccugggaggaaaucccuuaucucggcaagagagaggaucaguggugcggaagccugauuggccugaccucucgcgcuacaugggccaaaaacauccagacggcgauuaaucaggugcggucccucaaggggaacgaggaauacaccgacuacaugcccagcaugaaaagauuucggagagaggaaggagaggccggcguucugugguga

SEQ ID NO: 20231 - RNA, 9876 nt, Artificial Sequence
  derived and/or modified CDS sequence (opt5) from DENV-2__JQ955624__SS-prME
acagccggcgugaucauuaugcugauccccacagcuauggccuuccaccucacgaccagaaacggggaaccucauaugauugucagccggcaggaaaagggaaaaagccugcuuuuuaagacagaagacggcguuaauaugugcacccugauggcgauggaucucggggaacugugugaggacacaaucaccuacaacugcccgcuucugcgccaaaaugaacccgaggauauugacuguuggugcaacucuacaagcaccugggugacguauggaaccuguacagcuaccggcgagcacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucgccauuauggcugccauccucgcguacaccauugggacaacccacuuucagagaguucugaucuucauucuucugaccgccguggcuccuuccaugacaaugcggugcaucggaauuucuaaucgcgauuuugucgaaggcgugagcgggggauccuggguugacaucgugcucgagcacggcagcugugucacgaccauggccaaaaacaagcccacacuggauuucgaacuuaucaagaccgaggcuaaacagccugccacacugagaaaguauugcauugaagcgaaacucaccaauacgacaaccgccucucgguguccgacccaaggggagcccucccugaacgaggaacaggacaagcgcuuugugugcaaacauagcaugguggauagaggauggggcaauggcugugggcuguucggaaagggcgggaucgucacaugcgcuauguuuaccugcaagaaaaacauggagggaaagauuguucagccugaaaaucucgaguacacaaucguggugacgccccacucuggcgaagagaacgccgucgggaaugacaccggaaaacauggcaaggagauuaaagugacaccucaguccagcaucaccgaagcugagcugacaggcuaugggaccguuacgauggaauguucuccccggaccggacuugauuucaacgagauggugcugcuccaaauggaaaauaaggccuggcugguccaccgccagugguuucuugaccugccgcucccuuggcugcccggcgccgauacacagggguccaacuggauccagaaagagacccuggugacauucaagaacccucacgcuaagaaacaagacguugugguccucggaagccaggagggcgcgaugcauaccgcccugacgggggcuacagaaauucagauguccucuggcaaucuucuguuuaccggacaccucaagugcagacugcggauggacaaacuucaacugaagggcaugagcuacuccauguguacagggaaauucaagguggucaaggagaucgccgaaacccagcauggaaccauugugguuagagugcaguaugagggcgaugggagccccugcaaaauccccuucgagauuauggaccucgaaaagcgccacguccugggacggcugaucacagugaacccuaucguuacggagaaagauucuccggugaauauugaagccgagcccccuuuuggcgacuccuacaucauuaucggggucgaacccggccagcucaagcugagcugguucaaaaagggaucuagcauuggccaaauguuugagaccacaaugagaggggcuaagcgcauggccauccuuggagauaccgcgugggacuucggcucccucgggggaguguuuacaucuauuggcaaagcucuccaucagguguucggggccaucuacggcgccgcuuuuagcggaguuuccuggaccaugaagauccugauuggcgucgugaucacguggauugggaugaacagccggucuacaucccugagcgugucucuuguccucgugggaguugugacccuguaucugggcgucauggugcaggccgauuccggguguguugugagcuggaaaaauaaggagcucaaaugcggauccggcaucuucauuaccgacaacguccacacauggaccgaacaguacaaguuucaaccugagucucccagcaagcuggcuuccgccauccagaaagcgcacgaagaggggaucuguggcauuagaucugugacacgccuugaaaaucugauguggaagcagaucacgccggagcucaaccauauucugagcgagaaugaaguuaaacugaccaucaugacaggagauauuaagggcaucaugcaggccgggaaacggucccuuagaccucaacccaccgagcucaaguauagcuggaaaacauggggaaaggcuaagaugcugucuaccgaaucccacaaccagacguuccugaucgacggcccugagaccacagaaugccccaauaccaaccgcgccuggaauagccucgagguggaggauuacggguuuggagucuucacaaccaacauuuggcugaaacuuaaggaacggcaggacguguuuugugacucuaaacugauguccgcugccgugaaggauaauagagcgguccaugccgacaugggcuauuggaucgagagcgcucucaacgauacauggaaaauugaaaaggccucuuucaucgagguuaagagcugccacuggccuaaaucccacacccuguggagcaacggcgugcuggagucugaaaugauuauccccaagaauuucgcugggccggugucccagcauaacuaccgcccuggauaucacacgcaaacagccggccccuggcaucuugggaaacucgagauggacuuugauuucugugaaggaaccaccgucgugguuacagaggacugcggcaaucgggggcccagccugagaaccacgacagccuccggaaagcugaucaccgaauggugcugucggucuugcacacucccuccgcugcgcuacagaggcgaggauggcuguugguacgggauggagauucggccccuuaaagaaaaggaggaaaaccuggugaauagccucgucaccgcuggacacggccagaucgacaacuuuucccuggggauucugggaauggcgcuuuuccucgaggaaaugcugagaacacgcgugggcaccaagcaugccguucugcucguggcugucucuuuuaugacgcugaucaccgggaauaugagcuuccgggaucuuggaagagugaugguuauggugggcgccgccaugacagacgauauuggcaugggggucaccuaucuggcucuccuggccgcguuuaaagugcgcccuacauucgcugccggacugcuucugagaaagcucaccuccaaagagcugaugaugacgacaaucggcauugugcuccugucucagagcaccauccccgagacaauccuugaacugaccgacgcccucgcucuggggaugaugguccugaagauuguucggaacauggagaaauaccaacuugccgugaccaucauggcgauucugugcgugccuaaugcugucauccuccagaacgccuggaagguguccuguacaauucuggccguugugagcgucucuccccuccugcuuacguccagccagcagaaggcugauuggaucccucuggcccucaccaucaaaggacugaaucccacagcuauuuuucugaccacacuuucucgcaccaacaagaaaagauccuggccgcugaaugaagccaucauggcggugggcaugguuagcauucucgccucuucccugcucaagaacgacaucccuaugacggggccccugguggcuggaggccuucugacagucugcuaugugcugaccggccggagcgccgaccucgagcuggaacgcgcugccgaugucagaugggaggaccaagccgagauuuccgggagcucuccuauccuuagcaucaccauuuccgaagauggaucuaugagcaucaaaaaugaggaagaggagcagacacugaccauucucauccggacaggccugcucgugauuuccgggcuguuccccguuucuaucccgauuacggcugcggccugguaccuuugggaagugaagaaacagcgcgcuggaguccugugggacgugccuucucccccucccguuggcaaggccgagcuggaagauggggccuauagaaucaagcagaaaggaauccucggcuacucccaaauuggcgcugggguguauaaggagggaaccuuucacacaauguggcacgucacccggggcgccgugcugaugcauaaagggaagcgcaucgaacccuccugggcggacgugagaaaagaucuuauuagcuacggaggcggguggaagcuggagggagaguggaaggaaggcgaggaaguucagguccucgcucuggagccuggcaaaaacccgcgggccgugcagacaaagcccgggcuguucaaaaccaacacgggaaccaucggcgccgugucccuggacuuuagcccugggacaucuggaucccccauugucgauaagaaaggcaaggugguugggcuuuacggaaauggcguggucaccagaagcggcacauaugugucugcuaucgcccaguccgaaaagagcaucgaggacaacccugagauugaagaugacaucuuccgcaaaaagcggcugaccauuauggaucugcaccccggggcgggaaaaacaaagagauaccucccugcuaucguucgcgaggccauuaaacggggccugagaacgcuuauccuggccccgacccgcguggucgcugccgaaauggaggaagcucuccgggggcugcccaucagauaucaaaccccugccauucgcgcggagcauaccggacgggagaucguggaccucaugugucacgccaccuucacaaugagacugcuuucccccguucgggugccuaauuacaaccugauuaucauggacgaagcucauuuuacggaucccgccucuauugcugcccgcggcuauaucagcaccagagucgagaugggggaagccgcuggcauuuucaugacagcgaccccgccuggaucccgggaccccuuuccccagagcaaugccccuaucauggaugaggagcgcgaaauccccgagagaucuuggaacuccggccacgaaugggugacagacuucaaggggaagaccgugugguuugucccuagcauuaaagcuggaaaugauaucgccgccugccugcggaagaacggcaaaaagguuauucagcucucuagaaaaacguucgacagcgaguacaucaagacacgcaccaaugauugggacuuuguggugaccacagauauuuccgaaaugggggcuaacuucaaggccgagcgggucaucgacccgagacgcuguaugaaacccgugauccugaccgauggagaggaacggguuauucuugcgggcccuaugcccgugacacacucuagcgcugcccaaagacgcgggcggaucggcagaaauccuaagaacgagaaugaccaguauauuuacaugggagaaccccuggagaacgacgaagauugcgcccauuggaaagaggcuaagaugcuccuggacaauaucaacaccccggagggcauuaucccuuccauguuugaacccgagcgcgaaaaagucgaugccaucgacggggaguacagacugcggggagaagcgcgcaagacguucguggagcucaugagacggggcgaucuuccuguuuggcuggccuaucgcguggcugccgaggggauuaacuacgcugacagacggugguguuuugauggaaucaaaaauaaccagauucuggaagagaaugucgaaguggagaucuggacaaaggagggcgaaagaaagaaacucaagccccgcuggcuggacgcccggauuuauucugauccucuugcucugaaagaguucaaggaguucgccgcggggagaaaaagccucacccugaaccugaucacagagaugggccgccuccccaccuuuaugacgcagaaggcccggaaugcucuugacaaccuggccguccugcacaccgcugaagccggaggcagagccuacaaucaugcucucuccgagcugccggagacacuugaaacccugcuccugcugacacuccuugcgaccgugacagggggaauuuuccuguuucugaugagcggcaaggggaucggaaaaaugacccucggcaugugcugcaucauuacggccucuauccugcuuugguaugcucaaauucagccucacuggaucgccgccuccauuauccuggaguucuuucucaucguucugcugauucccgaacccgagaagcagcggacaccucaggauaaccaacucaccuacguggugaucgcuauucuuaccgucguugccgcgacaauggccaaugaaaugggcuuccuggagaaaaccaagaaagacuuuggguucggaagcaucgcuacacagcagccggaguccaacauucuggauaucgaccuccgccccgccucugcuuggacgcuguaugccguggcgaccacauuuaucaccccuaugcuuagacacagcauugaaaauuccucugugaacgucagccugacagccaucgcuaaucaggccaccgugcucaugggccuggggaagggauggccccuguccaagauggacauuggcguuccucuccuugcuaucggguguuacagccaagugaaccccauuacgcugaccgccgcucugcuccugcuugucgcccauuacgcgaucauuggaccuggccugcaggccaaagcuacacgggaggcccagaagcgcgcugccgccggcaucaugaaaaauccgaccguggaugggaucacagucauugaccucgaucccaucccuuaugaccccaaguucgaaaaacagcugggacaagugaugcugcucguucuuugcgugacccagguccugaugaugagaacgacaugggcgcugugugaggcucucacccuggccacaggcccuauuucuacccuuugggaagggaaccccggacgguuuuggaauaccacaaucgcuguguccauggccaacauuuuccgcggcagcuaccuggccggggcuggacuccuguuuucuaucaugaagaacacgaccaauacaagacggggcaccggcaacacaggggagacccugggagagaaguggaaaaaucgccucaacucccuuggcaagagcgaguuccagaucuauaaaagaucugggauucaagagguugaucggacgcuggccaaggaaggaaucaaaagaggcgagacagaccaccaugcggugagccgcggguccgccaagcugcggugguucgucgagagaaaucucgugaccccggaaggaaaagugauggaucugggcugcggccgcgggggauggucuuacuauuguggcgggcuuaagaacguucgggaggucaagggacugaccaaaggcgggccuggacacgaagaacccauucccaugagcacauacggcuggaaucucgugagacugcaguccggcguggacgucuuuuucaccccucccgaaaagugcgauacacugcucugugacaucggggagagcuccccuaacccgacgguugaggcuggacgcacccuucgggugcugaaucugguggaaaacuggcucaauaacaauacacaguuuugcauuaaaguccugaaccccuauaugccuucugugaucgagaagauggaaacccuucagagaaaauacggcggggcccugguucgcaauccccucagccggaacuccacacaugagauguacugggugucuaacgcuagcggaaauaucgucuccucugugaacaugauuagcagaaugcugaucaaucgcuucaccaugcggcacaagaaggccacguaugaaccugauguugaccugggcuccgggaccagaaacauuggaaucgagagcgagacacccaaucucgauauuaucggcaaacgcaucgaaaagauuaaacaagagcacgaaaccucuuggcauuacgaccaggaccacccguauaagacaugggcguaccauggcuccuaugagaccaaacagacagggagcgccucuuccauggugaacggagucgugagacuucugaccaagccuugggaugugauccccauggucacgcagauggcuaugacagacaccaccccuuuuggccaacagcggguuuucaaggaaaaaguggauacacgcacgcaggagcccaaggaggggaccaaaaagcugaugaaaauuacagccgaauggcucuggaaggagcugggaaagaaaaagaccccuagaauguguacacgggaagaguuuaccagaaaagugcggagcaaugcugcccuuggcgcuaucuucacagacgagaacaaguggaaaucugcccgcgaagcggucgaggauuccagauuuugggaacugguggacaaggagcggaaucuccaccuggaagggaaaugcgagaccuguguuuacaacaugaugggaaagcgcgagaagaaaaugggcgaguucggcaaggccaaagggagcagagcuauuugguauauguggcugggagcccgguuucucgaguucgaagcucugggcuuucuuaaugaggaucacugguucucccgcgaaaacagccugucugggguggagggagagggccuccauaagcugggguacauccuuagagaagucagcaaaaaggagggcggagccauguacgccgacgauacggcgggcugggacacccggauuacacuggaagaucucaagaaugaggaaauggugaccaaccacauggagggggagcauaaaaagcuggcugaagccaucuucaaacugacauaucagaauaagguugugcgcguccaaagacccaccccgcggggaacggugauggacaucauuucccgcagagaccagcggggcucugggcagguuggaacauacggccucaacaccuuuacaaacaugggggcccaacugauccgccagauggagggcgaaggaguguucaaaagcauucagcaccuuaccacgaccgaggaggucgcugugcaggauuggcuggccagagucggccgggaaagacucucccgcauggcuaucucuggggacgauugcgugguuaagccucuggacgaucgguuugccagcgcgcuuacagcccugaaugacaugggaaaggugagaaaagauauucaacagugggagcccucccgcggcuggaacgacuggacccagguccccuucugcucucaucacuuucacgaacucaucaugaaggaugggcgggugcuggugguuccuuguagaaaucaggacgagcugaucggacgcgcucggauuagccaaggcgccggguggucccucagagaaacagcuugccugggcaaaagcuaugcccagauguggucucuuauguacuuccaucgccgggaucugagacucgcggccaacgcuaucuguuccgccgugccgagccacuggguccccaccucucgcacaaccugguccauucaugcucggcacgaguggaugacgacagaggacaugcugaccguguggaauagaguuuggauccaggaaaacccuuggauggaggauaagacccccguggaaagcugggaggaaauuccuuaucuuggaaaacgggaggaccaguggugcggcucccugaucgggcucacaucuagagccaccugggcuaagaauauccaaacagccauuaaccagguccgcagccugaucggauccgaggaauacacggacuauaugcccagcaugaagcgguuuagacgcgaggaagaggaagcgggcgugcugugguga

SEQ ID NO: 20232 - RNA, 9876 nt, Artificial Sequence
  derived and/or modified CDS sequence (opt5) from DENV-2__KJ918750__SS-prME
accgccggcaugaucauuaugcugauccccacagugauggcuuuccaccugacgaccagaaauggggagccucauaugauuguuagccggcaggaaaaggggaaaucccugcuuuuuaagacaaaagacggcaccaauaugugcacacugauggccauggaucucggggagcugugugaagacaccaucacauacaagugcccguuccuucgccagaacgagcccgaagauauugacuguuggugcaauucuaccagcacguggguuaccuauggaacauguaccacaaccggcgagcacagacgggagaaacgcuccguggcgcuggugccucaugucgggaugggacucgaaacgagaacagagaccuggaugucuagcgaaggcgcuuggaagcacgcccagcggaucgagaucuggauucugcgccaucccggcuuuacaaucauggccgcuauucuggccuacaccaucgggaccacacacuuccagagagugcucauuuuuauccugcuuacggcuauugccccuuccaugaccaugcggugcaucggaaucucuaaccgcgauuucguugagggcgugagcgggggauccugggucgacauugugcuggaacacggcagcuguguuacaaccauggcgaagaauaaacccacacucgauuuugagcugaucaagaccgaagccaaacagccugcuacgcuuagaaaguauugcauugaggccaaacugacaaacaccaccacagacucucgguguccgacccaaggggaacccacacucaaugaggagcaggauaagcgcuucgugugcaagcauuccauggucgacagaggauggggcaacggcugugggcuguuuggaaaaggcgggaucgugacgugcgcuauguucacaugcaagaaaauuaugaagggaaaaaucgugcagccugaaaaucuggaguacacagucguuaucacaccccacagcggcgaagaacaugccguggggaacgauacaggaaagcacggcaaagaagugaagauuaccccucagucuuccaucacggaggcggagcucaccggcuaugggacagucaccauggaauguagcccccggacaggacuggacuuuaaugagauggugcuucugcaaauggaagauaaggccuggcucguucaccgccagugguuccuggaccuuccgcugccuuggcuccccggcgcugacacccaggggucuaacuggauucagaaagagacgcuggugacauuuaagaauccucaugccaaaaagcaagaugucgugguucugggaucccaggaaggcgcuaugcacaccgcccucacaggggccaccgagauccagaugagcuccggcaaccugcuuuucaccggacaucugaaaugcagacuccggauggacaagcugcaacuuaagggcaugucuuacagcauguguacagggaaauucaagguggucaaagagauugcugaaacgcagcacggaaccaucgugaucagaguccaguaugagggcgaugggucccccugcaagauucccuuugaaaucauggaccuggagaaacgccaugugcucggacggcugauuacaguuaauccuaucgugaccgagaaggauagcccggucaacauugaagcggagcccccuuucggcgacucuuacaucauuaucgggguggaacccggccagcugaagcucaacugguuuaaaaagggauccagcaucggccaaaugcuggagacaaccaugagaggggccaaacgcauggcuauucuuggagauacggccugggacuucggcucucucggcgggguuuuuacaagcaucgggaaggcccuccaccagguguucggggcuauuuacggcgccgcguuuuccggagucucuuggaccaugaaaauccugaccggcgugauuaucacauggaucgggaugaauagccgguccaccagccugucugugucccuuguucucgucggaauugugacacuguaucugggcgugaugguccaggcugauagcgggugugugguuucuuggaagaacaaggaacucaaaugcggauccggcaucuucgugacggacaauguccacaccuggacagagcaguacaaguuucaaccugagagccccuccaaacuggccucugccauucagaaggcucaugaagaggggaucuguggcauuagaagcgugacccgccuugaaaaccugauguggaaacagaucacaccggagcucaaucacauccuguccgaaaacgagguuaagcugaccauuaugacgggagauaucaaaggcauuaugcaaguggggaagcggucucuuagaccucaacccaccgagcuccgcuauagcuggaagacauggggaaaagccaagaugcuguccaccgaacugcauaaucagacauuccucaucgacggcccugagaccgcugaaugccccaacacaaaucgggccuggaacagccuggaggucgaagacuacggguuuggaguguucaccacgaauauuuggcuuagacugcgcgagaaacaggaugucuuuugugacucuaagcucauguccgcggccaucaaagauaaccgggcugugcacgccgacaugggcuauuggaucgagagcgcucugaaugauacauggaagauugaaaaggccucuuucaucgaggucaaauccugccacuggccuaagagccauacccuguggucugacggcgugcuugaaagcgagauggugauucccaaaaacuucgcggggccggucucccagcacaauaacagaccuggauaccauacccaaacagccggccccuggcaccucgggaagcuggagauggauuuugacuucugugaaggaaccacgguuguggugacagaggauugcggcaaccgggggcccagccugcgcaccacaaccgcuucuggaaaacucaucacagaauggugcuguagauccugcacccugccuccgcuucgguauagaggcgaggacggcuguugguacgggauggaaauucgcccccugaaggagaaggaggaaaaucucgucagcucccuggugacggccggacauggccagaucgauaacuuuucucuggggauucuuggaauggcucucuuccuggaggaaaugcugcggaccagaguuggcacaaaacacgccauccuccugguggccgucagcuuugugacccuuaucacagggaauauguccuuccgcgaccugggaagaguuauggugauggucggcgcuaccaugacggaugacauuggcaugggggugacauaccucgcgcugcuggccgcuuuuaagguucggccuaccuucgccgccggacuucugcuccgcaaacugacaucuaaggagcucaugaugaccaccaucggcauugugcugcuuagccaguccucuauccccgaaacaauucuggagcucacggacgcucuggcccuggggaugaugguccuuaaaauggugagaaacauggagaaguaucaacuggcggugaccaucauggcuauccucugcgucccuaaugccguuauucugcagaacgccuggaaggugagcuguacaauccucgcucugguguccgucagcccccuuuuucugaccucuucccagcagaaagccgauuggauuccucucgcgcugacaaucaagggacugaaucccaccgcuauuuuccuuacgacacugagccggaccucuaaaaagcgcuccuggccgcucaacgaagccaucauggccgugggcaugguuagcauccuggcuucuucccuccugaaaaaugacauuccuaugaccgggccccuuguggccggaggccugcugacagucugcuacgugcucaccggcagaagcgcugaucuggagcuugaacgggccgcggacguuaagugggaugaccaagccgagaucuccgggagcucuccuauucugagcaucacaauuuccgaagauggaucuaugagcaucaaaaacgaggaggaagaacagacgcucaccauucugauccgcacaggccuccuggugaucuccgggcuuuuucccgucucuauuccgaucaccgcugccgcuugguaucugugggaagugaagaagcagagagccggaguccugugggacgugccuucucccccucccguuggcaaagccgagcucgaggauggggcuuaccggauuaagcagaaaggaauccugggcuauucccaaauuggcgcggggguguacaaggaaggaacauuccacaccauguggcaugucacgcgcggcgccgugcuuaugcacaaagggaagagaaucgagcccuccugggcugacguuaagaaagaucugaucagcuauggaggcggguggaagcucgaaggagaguggaaagaaggcgaggaggugcagguccuggcccucgaaccuggcaagaauccgcgggccgugcagaccaaacccgggcuguuuaagacaaacaccggaacaauuggcgcugugucccuugacuucagcccugggaccucuggaucccccaucguugauaagaaaggcaaggucguggggcuguacggaaauggcguggucacaagaagcggcgccuacgugucugcgauugcucagacggagaaauccaucgaagacaacccugagauugaagacgauaucuuccgcaagcggagacugaccaucauggaccuccaucccggggccggaaaaacaaagcgcuaucugccugccauuguucgggaggcuaucaagagaggccuucgcacccugauucucgccccgacccggguggucgcggcugagauggaagaggcccugagagggcuccccauccgcuaccaaaccccugccauucgggcugaacacacgggaagagagaucguggaucugaugugucaugccaccuuuacaaugcggcuucugagccccauucgcguuccuaauuauaaccugaucaucauggacgaagcucacuucaccgaucccgccuccauugcggccagaggcuacaucucuacacggguggagaugggggaggcugccggcauuuuuaugaccgcuacgccgccuggaagccgcgaccccuucccccaguccaacgccccuaucauggaugaagagagagaaauucccgagcggagcuggaacucuggccacgagugggucacagacuuuaaagggaagaccgugugguucguuccuuccaucaaaaccggaaacgauaucgccgcuugccucagaaagaauggcaaacgcgugauucagcugagccggaagacauuugacucugaauaugucaagaccagaacaaacgauugggacuucguggugaccacggacaucagcgagaugggggcgaauuuuaaagccgaacgcgucauugauccgcggagauguaugaagcccguuauccuuacagacggagaggaacgcgugauucuggcuggcccuaugcccgugacccauuccucugccgcccaacggagagggcgcaucggcagaaacccuaaaaaugagaacgaucaguacaucuauaugggagagccccucgaaaaugacgaggauugcgcucacuggaaggaagccaaaaugcugcuggacaacauuaauacaccggagggcaucauuccuagcauguucgaacccgagcgggagaaggucgaugcgaucgacggggaauaccgccucagaggagaggcucggaaaaccuuuguggaucuuaugcgcagaggcgaccugccuguuuggcuggccuacaagguggccgcugaagggauuaacuaugccgaucggagaugguguuucgacggaacgcgcaauaaccagauccucgaggaaaaugucgagguggagauuuggaccaaggaaggcgagcggaaaaagcugaaacccagauggcuugaugcgcgcaucuacuccgacccucuggcccucaaggaguucaaagaguuugcugccgggcggaagucucugacacugaaccucaucaccgagaugggcagacuucccacauucaugacccagaaggcucgggacgcccuggauaaccuggcuguucuccauacagccgaagcgggaggcaaagccuauaaucacgcucugagcgagcuuccggaaacccuggagacgcuccugcugcucacacuucuggccaccgugaccgggggaauuuuucuguuccucauguccggccgcgggaucggaaagaugacacugggcaugugcugcauuaucaccgcuagcauucuucuguggugugcccaaauccagccucacuggaucgccgcuucuauuauccucgaauuuuuccugauuguccugcucauccccgagcccgagaaacagagaacaccucaggacaaccaacuuacguacgugauuaucgcgauccugaccgucguggccgcuacaauggccaaugaaaugggcuuucuggagaagaccaaaaaggaucucgggcugggaaacauuguuacacagcagccggaauccaauauccuugacauugaucugcggcccgccagcgcuuggacccucuaugccguggcgacgaccuucaucacaccuaugcugcgccauuccauugagaacucuagcgugaauaugucccugaccgccaucgcuaaccaggccacaguccucaugggccuugggaagggauggccccugucuaaaauggacauuggcguuccucugcucgcuaucgggugcuguagccaagugaaucccaucacccugacggccgcgcuuuuucugcucguggcccacuacgcuauuaucggaccuggccugcaggccaaggcuacaagagaagcccagaaacgggcugccgcgggcauuaugaagaacccgaccgucgaugggaucacagugauugaccuggaucccaucccuuaugaccccaaauucgagaagcagcucggacaaguuaugcuucuggugcugugcgucacccaggugcucaucaugcgcaccacaugggcccugugugaggcucuuacgcuggccaccggcccugucuccacacucugggaagggaaucccggaagauuuuggaacaccacaauugcugugagcauggccaauaucuuccggggcucuuaccuggccggggcgggacugcucuuuugcauuaugaacaauaccacgcgccuuagacggggcacaggccaucugagaaagacccugggggauaaauguaagucccgccucaacacccugggaaaaagcgaguuccagaucuacaagaaaucuggcauucaagaaguugaccggacacuugcuaaggaggggaucaaaagaggagaaaccgaucaccaugccgugucccgcggcagcgcuaagcugcggugguucgucgagagaaaucucgugacaccggaggggaagguuguggaccugggaugcggccgcggcggguggucuuauuacuguggaggccugaaaaacguccgggaagugaaggggcucacgaaaggaggcccugggcacgaggaacccauccccaugagcaccuauggauggaaccuugugagacugcaguccggcguugacgucuuuuucauuccucccgagaagugcgauacacugcucugugacaucggcgagucuagcccuaauccgaccguggaagccgggcgcacacugcgggugcuuaaccuggucgagaauuggcucaacaauaacacccaguuuugcauuaaaguucugaaucccuacaugccuuccgugaucgaaaagauggagacgcugcagagaaaguauggaggcgcccucgugcgcaacccccuuagccggaauagcacccacgaaauguacugggucucuaacgcuagcgggaauauuguguccucuguuaacaugaucagcagaaugcugaucaaucgcuucacaaugagacauaaaaaggccaccuaugagccugauguggaccugggauccggcacacggaacauugggaucgagucugaaacccccaaucucgauauuaucggaaaacgcauugagaagaucaaacaagaacacgagacaagcuggcauuacgaccaggaucacccguacaagaccugggcguaucacggcuccuacgaaacgaagcagacaggcagcgccucuuccauggucaacggggugguuagacugcuuaccaaaccuugggacgugguccccauggugacccagauggcuaugacagauacgaccccuuuuggacaacagcggguguucaaggagaaagucgacacaagaacccaggagcccaaggaaggcaccaaaaagcugaugaagauuaccgccgaguggcucuggaaagaacuggggaagaaaaagacaccucggaugugcacccgcgaggaauuuacgaaaaagguuagaagcaacgcugcccugggagcgaucuucaccgaugagaauaaauggaagucugcccgggaggcuguggaagacggccgcuuuugggagcucguggacaaggaaagaaaccugcaucuugaggggaaaugugagacaugcgucuauaauaugaugggaaagcgggagaaaaagcugggcgaguucggcaaagccaaggggucccgcgcuaucugguacauguggcucggagccagauuucuggaguucgaggcucuuggcuuucugaacgaagaucacugguucagccgggaaaauucucucuccgggguggagggagaaggccugcauaagcugggguauauucuccgcgagguuagcaaaaaggaaggcggagccauguacgcggacgauaccgccggcugggacacaagaaucaccauugaggaucugaaaaacgaagagaugaucacgaaucacauggcuggggagcauaagaaacuugccgaagcuauuuucaagcugacauaucagaacaaggugguccgggugcaacgccccaccccgagaggaacaguuauggacaucaucucccggcgcgaucagagaggcagcggacaggugggaaccuacggccucaauacguuuaccaacauggaggcccaacugauucggcagauggaaggggagggcaucuucaaaucuauucagcaccuuacagccaccgaagagaucgcgguccaggacuggcuggcuagagugggacgcgagcggcucagcagaauggccauuuccggcgaugacuguguugugaagccucuggaugaccgcuuugcccgggcucugacagcccucaaugauauggggaaagucagaaaggacauccaacagugggaacccucucgcggauggaacgacuggacccaggugcccuucugcagccaccauuuucacgagcugaucaugaaagauggccggacacuugucgugccuuguagaaaucaggacgaacugauugggcgcgcucggaucucccaaggagccggcuggucucucagagagaccgcgugccugggaaagagcuacgcccagauguggucccuuauguauuuccaucgccgggaucugagacucgcugccaacgcuauuuguucugccguuccgagccacugggugcccacgucccggacaaccuggagcauccacgcgucucaugaguggaugaccacagaagacaugcugaccgucuggaauagaguguggauucaggagaacccuuggauggaagauaagacacccguggaguccugggaagagaucccuuaccugggcaaacgcgaggaccaguggugcggaagccucauuggccugacgucucgggccaccugggcuaagaacauccaaacagccaucaaucagguuagaucccuuauugggaacgaagaguauaccgauuacaugcccagcaugaaacgcuuuagacgggaagaggaagaggcuggagugcugugguga

SEQ ID NO: 20233 - RNA, 9876 nt, Artificial Sequence
  derived and/or modified CDS sequence (opt5) from DENV-2__KU517845__SS-prME
accgccggaaucauuaucaugaugauucccacagugaucgcuuuccaccugacgaccagaaacggggagccucauaugauugucagccggcaggaaaaggggaaaagccuccuguuuaagacagagaauggcguuaacaugugcacccuuauggccauggaccugggggaacucugugaggauacaaucaccuacaauugcccgcugcuucgccaaaacgaacccgaggacaucgauuguuggugcaauucuacaagcgcgugggugaccuauggaacguguaccgcuacaggcgagcacagacgggaaaaacgcuccguggcccuggucccucauguggggaugggacucgagaccagaacagaaaccuggaugucuagcgagggcgccuggaagcacgcucagcggauugagacguggguucugcgccaucccggcuucacaaucauggccgcuauucuggccuacaccaucgggacaaccuauuuucagagagugcucauuuucauccugcuuaccgcggucacaccuuccaugacgaugcggugcauuggaaucucuaaccgcgacuuuguggaaggcguuagcgggggauccuggguggauaucguccuggagcacggcagcugugugaccacaauggccaaaaauaagcccacccucgacuucgaacugauuaagacagaggcuaaacacccugccacccuuagaaaguacugcaucgaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggauuguuaccugcgcgauguuuacaugcaagaaaaauauggagggaaagaucgugcagccugaaaaccuggaguauacgauugugaucacaccccacucuggcgaagagaaugccgucgggaacgauacaggaaaacauggcaaggagaucaaagugaccccucaguccagcauuacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauccagaaagagacacuggugaccuucaagaauccucacgccaagaaacaggauguugugguccugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaagguggucaaggagaucgccgaaacccaacauggaacaauugugaucagaguucaguacgagggcgacgggagccccugcaaaauccccuucgagauuauggaucuggaaaagcgccacgugcucggacggcugaucacggucaauccuauugugaccgagaaagacucuccgguuaacaucgaagcugagcccccuuuuggcgauuccuacauuaucauugggguggaacccggccagcugaagcucagcugguucaaaaagggaucuagcaucggccagauguuugagacaaccaugagaggggccaagcgcauggccauccugggagacacagcuugggauuucggcucccuugggggagucuuuaccucuauuggcaaagcccugcaucaaguguucggggcgaucuauggcgcugccuuuagcggaguguccuggacgaugaagauucucaucggcguugucauuacauggaucgggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucauuacagauaaugugcacaccuggacagaacaguauaaguuucagccugagucucccagcaagcucgcuuccgccauccaaaaagcucacgaagaggggauuuguggcaucagaucugucacgcgccuggaaaaccuuauguggaagcagauuaccccggagcugaaucauauccucagcgagaacgaagugaaacugacaaucauggccggagacauuaagggcaucaugcaggcggggaaacggucccugagaccucagcccaccgagcuuaaguacagcuggaaagccuggggaaaggcuaagaugcucucuacagaacugcacaaucauaccuuccugauugauggcccugagacggccgaaugccccaacaccaaucgcgcuuggaacucccucgagguugaggacuauggguuuggaguguucacaaccaauaucuggcugaaacuuaaggaacggcaagaugccuuuugugacagcaaacugaugucugcggccauuaaggacaacagagcuauccacgccgauaugggcuacuggaucgaguccgcucucaacgacacauggaaaauugaaaaggccagcuucaucgaggucaagucuugccacuggccuaaaagccauacccugugguccaauggcgugcuggagagcgaaaugauuauccccaagaacuucgccgggccggugucucagcacaauuaucgcccuggauaccauacacagaccgcuggccccuggcaccuugggcggcucgagauggauuuugacuucugugaaggaacgacagucguugugaccgaggauugcggcaacagagggcccucccugcggaccacaaccgcgagcggaaaacugauuacggaauggugcugucgcuccugcacacucccuccgcugagauaccggggcgaggacggcuguugguaugggauggagaucagaccccuuaaggaaaaagaggaaaaucuggugaacucucucgucaccgccggacauggccagauugauaauuuuagccugggggugcugggaauggcucuuuuccucgaggaaaugcugcgcacacggguuggcaccaagcacgccauccugcucguggccgucuccuuugugacacugaucaccgggaacaugucuuucagagaccuuggacgcguuauggugauggucggcgcuacgaugaccgaugacauuggcaugggggugacauaccuggcccuccuggcggcuuuuaagguuagaccuaccuucgccgccggacugcuucugcggaaacucacaagcaaggagcugaugaugaccacgaucggcauugugcuccugucccaaucuacaauccccgagaccauucuugaacugacagaugcucucgcccuggggaugaugguccugaaaaucgugcgcaauauggagaaguaucagcuugcggugaccaucauggcuauucugugcgucccuaacgccguuauccuccagaaugccuggaaagugagcuguaccacacuggcuguggucuccgugagcccccuccugcuuacgucuucccaacagaaggccgacuggauuccucugguucucaccaucaagggacugaaccccacagcuauuuuucugaccacacuuagcagaaccucuaaaaagcgguccuggccgcugaaugaagccaucauggcggugggcauggucagcauccucgccucuucccugcucaaaaacgauauuccuaugacggggccccugguggcuggaggccuucugacaguuugcuacgugcugaccggccgcagcgccgaccucgagcuggaaagagcugccgacguccggugggaggagcaggccgaaaucuccgggagcucuccuauucuuagcaucaccguguccgaggauggaucuaugagcauuaagaaugaagaggaggaacagacacugaccauccucauucgcacaggccugcucgucaucuccgggcuguuccccgugucuaucccgauuacggcugcggccugguaucuuugggagguuaaaaagcaaagagcuggagugcugugggacgucccuucucccccucccgugggcaaagccgaacuggaggauggggccuaccggaucaagcagaagggcauucucggcuauucccagaucggcgcugggguuuacaaagaaggaaccuuucacacaauguggcaugugacccgcggcgccguccugaugcacaaggggaaaagaauugagcccuccugggcggacgugaagaaagaucuuaucagcuacggaggcggguggaagcuggagggagaauggaaggagggcgaagaggugcagguucucgcucuggaaccuggcaaaaacccgcgggccguccaaacaaagcccggacucuucaaaaccaacacgggaaccaucggcgccgugucccuggacuuuagcccugggacaucuggaucccccauuguggauaagaaaggcaaggucguggggcuuuauggaaauggcguugugaccagaagcggcacauacgucucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucgugcgcgaagccauuaaacggggccugagaacccuuauccuggccccgacacgcguuguggcugccgagauggaagaggcucuccgggggcugcccauuagauaccagaccccugccauccgcgcggagcacaccggacgggaaauugucgaccucaugugucaugccacauucacgaugagacugcuuagccccauccgggugccuaauuauaaccugauuaucauggaugaggcucacuuuaccgaccccgccuccaucgcugcccgcggcuacauuucuacaagaguugaaaugggggaggccgcuggcaucuucaugaccgcgacaccgccuggaagccgggaccccuuuccccaguccaaugccccuauuauggaugaggaacgcgagauccccgaaagaagcuggaacucuggccacgagugggugaccgacuucaaggggaagacggucugguuugugccuuccauuaaagcuggaaaugauaucgccgccugccugcggaagaacggcaaaaaggugauccaacucagcagaaaaacauucgacucugaauauauuaagacccgcaccaaugauugggacuuugucguuacaaccgauaucagcgagaugggggcuaacuucaaggccgagcgggugauugacccgagacgcuguaugaaacccgugauccugacagauggagaagaacgggucauucuugcgggcccuaugcccgugacccauuccucugcugcccagagacgcgggcggguuggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguggaugccauugacggggaauauagacugcggggagaggcgcgcaagacauucgucgaucucaugagacggggcgaccuuccuguguggcuggccuaccgcguugcugccgaggggaucaacuaugcugauagacggugguguuuugacggagugaaaaauaaccaaauucuggaagagaaugucgaaguggagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccguccugcauacagcugaagccggaggcagagccuauaaucacgcucucagcgagcugccggagacccuugaaacacugcuccugcugacccuccuugcgacagugaccgggggaaucuuccuguuucugauguccggcaaggggauuggaaaaaugacgcucggcaugugcugcaucauuacagccagcauccugcuuugguacgcucagauucagccucacuggaucgccgccucuaucauucuggaguucuuucucaucguucugcugauucccgaacccgagaagcaacggaccccucaggacaaccagcucaccuauguggugaucgcuauucuuacagucguugccgcgaccauggccaaugaaaugggcuuccuggagaaaacaaagaaagauuuugggcugggauccaucgcuaaccagcaaccggagagcaauauccucgacauugaucugcgccccgccuccgcuuggacgcuuuacgccguggcgaccacauucaucaccccuaugcugagacauucuauugaaaacagcuccgugaaugucucucucacagccaucgcuaaccaggccaccgugcugaugggccuggggaagggauggccccucagcaagauggacauuggcguuccucuucuggcuaucggguguuacucccaggugaaucccauuacgcugaccgccgcucuccugcuucuggucgcccacuaugcgaucaucggaccuggccuccaggccaaagcuacacgggaggcccaaaagcgcgcugccgccggcauuaugaaaaacccgaccguggacgggaucacagucauugaucuggaccccaucccuuacgaucccaaguuugaaaaacagcugggacaggugaugcuccuuguucugugcgugacccagguccugaugaugagaacgacaugggcgcucugugaggcucugacccuugccacaggcccuauuagcacccugugggaagggaaucccggacgguucuggaacaccacaaucgcugugucuauggccaacaucuuucgcggcuccuaucucgccggggcuggacugcuguucagcauuaugaagaauacggccaacaccagacggggcacaggcaauaccggggagacacucggagagaaguggaaaaaccgccuuaaugcgcugggcaagucugaauuucaaaucuacaaaaaguccgggauucaggagguugacagaacccuggccaaagaaggaaucaagcggggcgagacggaucaucacgcugugagcagagggucugccaaacuccgcugguucgucgagcggaaccuggugacaccggaaggaaaggugguugaccuuggcugcggcagagggggauggagcuauuacuguggcgggcugaagaaugucaaagaggugaagggacucaccaaaggcgggccuggacaugaggaacccauucccauguccaccuauggcuggaaccuggugcgccugcagucuggcgucgauguuuucuuuacaccucccgaaaagugcgacacccuccuuugugauaucggggagagcuccccuaauccgacaguggaggcuggacggacgcugagagugcugaaccucgucgaaaauuggcugaacaauaacacccaauucugcaucaaagugcuuaaucccuacaugccuagcguuauugagaagauggaagcccugcagcgcaaguacggcggggcgcucgugcggaacccccuguccagaaacucuacacacgagauguauugggucagcaaugccuccggaaacaucgugucuagcguuaauaugauuucccgcaugcugaucaaccgguuuaccaugagacacaaaaaggcuacauacgaaccugacguggaucucggcucugggacccgcaauauuggaaucgagagcgagacgcccaaccuugacaucauuggcaaacggaucgaaaagauuaaacaggagcaugaaaccuccuggcacuaugaucaggaccauccguacaagacaugggccuaucacggcagcuacgagaccaagcaaacagggucugcuuccagcauggucaauggaguggugagacugcugaccaaaccuugggacgucauccccaugguuacacagauggccaugaccgauacgacaccuuucggccagcagcgcguguuuaaggaaaaaguggacaccagaacccaagagcccaaggaggggaccaagaagauuaugaagaucacggcugaauggcucuggaaagagcugggaaagaaaaagaccccucggauguguacacgcgaagaguucaccagaaaaguccggucuaacgccgcgcuuggcgccauuuuuacagaugagaauaaguggaaauccgcuagagaagccguggaggacagcggguucugggaacugguugauaaggagcggaaccuccaccuggaaggaaagugcgagaccuguguguauaauaugaugggcaaacgcgagaagaaacugggcgaauuugggaaggcuaaaggaucuagagccaucugguacauguggcucggcgcccgguuccuggaguuugaagcgcuuggguuccugaacgaggaccauugguuuucccgcgaaaauagccucuccggagucgagggcgaggggcugcacaaacuuggcuacauccugagagaugugagcaagaaagaaggaggcgcuauguaugccgacgauacagccgggugggacacccggauuacgcucgaggaucugaagaacgaagagaugguuaccucucauaugaaaggagaacaccgcaagcuggcugaggccaucuucaaacucacauaccagaauaagguggucagagugcagcggcccaccccgcgcggcacaguuauggacauuaucagcagacgggaccagcgcggguccggacaaguggucaccuauggccugaacacguucacaaacauggaggcucagcuuauuagacagauggaaggggagggcguguuuaagucuauccaacagcugaccgucacagaagagaucgccgugaaaaauuggcucguucgggugggacgcgagagacugagccggauggcgauuuccggcgaugacugcgucgugaagccucuugaugacagauucgccucugcucugaccgcccucaacgauauggggaaagugcgcaaggacauccagcagugggaacccagccggggauggaaugauuggacgcaaguucccuuuugcucccaucacuuccacgagcugauuaugaaagacggcagagugcuggucgugccuugucgcaaccaggaugaacucaucgggcgggcuagaauuucucagggagccggcuggagccugcgcgagaccgcgugccuugggaaguccuacgcccagauguggagccugauguauuuucaucggagagaccuccgccuggcugccaaugcuaucuguucugccguuccgucccacugggugcccacaagccggaccacauggucuauccaugcuacccacgaauggaugacaaccgaggauaugcuuacggucuggaacagaguguggauucaagagaauccuuggauggaagacaagacacccgucgaguccugggaagagaucccuuaccugggcaaacgcgaagaucaguggugcggaagccucauuggccugaccucccgggccaccugggcgaagaacauccagacagccauuaaucaggugagaucucugaucgggaacgaggaguauaccgacuacaugcccagcaugaaacgguucagacgcgaagaggaagaggcuggaguucucugguga

SEQ ID NO: 20234 - RNA, 9876 nt, Artificial Sequence
  derived and/or modified CDS sequence (opt5) from DENV-2__KU517847__SS-prME
accgccggaaucauuaucaugaugauucccacagugauggcuuuccaccugacgaccagaaacggggagccucauaugaucgucagccggcaggaaaaggggaaaagccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucacagagaacgaagugaaacugaccaucaugacaggagacaucaagggcauuaugcaggccgggaaacggagccugagaccucagcccaccgagcuuaaguacuccuggaaagcguggggaaaggccaagguucucagcacggaacugcacaaucauaccuuccugaucgauggcccugagacagcugaaugccccaacaccaaucgcgccuggaacucucucgagguggaggacuauggguuuggagucuucacaaccaauauuuggcugaaacuuaaggaacggcaagauguguccugugacagcaaacugaugucugcugccaucaaggacaacagagcggugcacgccgauaugggcuacuggauugaguccgcucucaacgacacauggaaaaucgaaaaggccagcuuuaucgaggucaagucuugccacuggccuaaaagccauacccugugguccaauggcguucuggagagcgaaaugauuauccccaagaacuucgcugggccggugucucagcacaauuaucgcccuggauaccauacgcagacagccggccccuggcaccuugggcggcucgagauggauuucgacuuuugugaaggaaccaccguggucgugacagagaacugcggcaauagagggcccucccugcggaccacgacagccagcggaaaacugauuaccgaauggugcugucgcuccugcacacucccuccgcugagauaccggggcgaggauggcuguugguaugggauggagaucagaccccuuaaggaaaaagaggaaaaccugguuaauucucucgugaccgcuggacauggccagauugacaacuucagccuggggguccugggaauggcgcuuuuucucgaggaaaugcugcgcacacgggugggcaccaagcacgccauccugcucguugcuguguccuucgucacgcugauuaccgggaauaugucuuuuagagaucuuggacgcgugaugguuauggugggcgccacaaugaccgacgauaucggcaugggggucacauaccuggcccuccuggcugccuucaaggugagaccuaccuuugcggcuggacugcuucugcggaaacucacgagcaaggagcugaugaugacaaccaucggcauugugcuccugucccaaucuacaauccccgagaccauucuugaacugaccgacgcccucgcccuggggaugaugguccugaaaaucguucgcaacauggagaaguaucagcuugcugugacaauuauggccauccugugcgugccuaaugcggucauccuccagaacgcuuggaaagugagcuguacggcccuggccguuguguccgucagcccccuccugcuuaccucuucccaacagaagacagauuggauuccucuggcucucaccaucaagggacugaaucccacagccauuuuccugaccacgcuuagcagaacaucuaaaaagcgguccuggccgcugaacgaagcuaucauggccgugggcaugguuagcauucucgcgucuuccuuucugaaaaaugacaucccuaugaccgggccccucguggccggaggccugcuuaccgucugcuacgugcugacaggccgcagcgcugaucuggagcucgaaagagccgcugacauccggugggaggagcaggccgaaauuuccgggagcucuccuauccugagcauuaccaucuccgaggacggaucuaugagcauuaagaacgaagaggaggaacagacacuuacgauccugauucgcaccggccuccuggucaucuccggacucuuccccgccucuaucccgauuacagcugcggccugguaucugugggaggugaaaaagcaaagagcuggaguucuuugggaugugccuuccccuccucccgucggccgggccgaacuggaggacggggccuaccgcaucaaacagaagggcauucugggcuauucccagaucggcgcugggguguacaaggaaggaaccuuucacacaauguggcauguuaccagaggcgccgugcucaugcacaaagggaagcggauugagcccucuugggcggaugucaaaaaggaccugaucagcuacggaggcggguggaaacuugagggagaauggaaggagggcgaagaggugcaagugcuggcucucgaaccuggcaagaacccgagagccguucaaacgaaacccgggcuguucaagaccaauacaggaaccaucggcgccgucucccucgauuuuagcccugggacaucuggaucccccauuguggacaaaaagggcaaaguggucgggcuguauggaaacggcgugguuacccgcagcggcacauacgugucugcuaucgcccagacggagaaguccauugaggauaauccugaaaucgaggacgauauuuuccggaagaaaagacuuaccaucauggaccugcaucccggggcgggaaagacaaaacgcuaucugccugcuaucguccgggaagccauuaagagaggccuccgcacccugauccuugccccgacccgggugguugcugccgagauggaagaggcucugagagggcuccccauucgcuaccagacacccgcuauccgggcggagcacacgggaagagaaauuguggaucugaugugucaugccaccuucacaaugcggcuccugagccccauccgcgucccuaacuauaaucuuauuaucauggacgaggcucacuuuaccgaucccgccuccaucgcugccagaggcuacauuucuacacggguggaaaugggggaggccgcuggcaucuucaugaccgcgacgccgccuggaagccgcgaccccuuuccccaguccaacgccccuauuauggacgaggaaagagagauccccgaacggagcuggaacucuggccacgaguggguuacagauuucaaagggaagaccgugugguuugucccuuccauuaaggcuggaaacgacaucgccgccugccugcgcaaaaauggcaagaaagugauccaacugagccgcaagaccuucgauucugaauauauuaaaacacggaccaacgacugggauuuuguggucacaaccgacaucagcgagaugggggcuaauuucaaggccgagagaguuauugauccgcgccgguguaugaagcccgugauccucacggacggagaagagagagugauucuggcgggcccuaugcccgucacacauuccucugcugcccagcgccgggggagagugggccgcaacccuaaaaaugaaaacgaucaguacaucuacaugggagagccccuugaaaaugacgaggauugcgcccacuggaaggaggcuaaaaugcugcucgacaacaucaacaccccggaaggcauuaucccuagcauguuugagcccgaaagagagaagguugacgccauugauggggaauaucggcugcgcggagaggcgagaaaaacauucguggaccugaugcggcgcggcgaucucccugucuggcuugccuacagaguggcugccgaggggaucaauuaugcugaccggagaugguguuuugauggaguuaagaacaaucaaauucuggaagagaacguggaagucgagaucuggaccaaagagggcgaacgcaagaagcugaaaccccgguggcucgacgccagaauuuacuccgauccucuggcucuuaaggaguucaaagaguucgccgcggggcgcaagucucugacgcucaaucugaucaccgagaugggccggcugcccacauuuaugacccagaaagccagaaacgcucucgacaaucuugccgugcugcauacagcugaagccggaggccgggccuauaaccacgcucugagcgagcucccggagacccuggaaacacuucugcuccugacccugcucgcgacggucacagggggaaucuuccuuuuucugauguccggcaaggggauuggaaagaugacccugggcaugugcugcaucgugaccgccagcauucuccugugguacgcucagauccagccucacuggauugccgccucuaucauccuugaguucuuucugauuguucuccugauccccgaacccgagaaacaacgcacaccucaggauaaucagcugaccuauguggugauugcuauccucacagucguugccgcgacgauggccaacgaaaugggcuuccuugagaagaccaaaaaggacuuugggcugggauccauuacaacccagcaaccggagagcaauauccuggauaucgaccucagacccgcuuccgccuggacacuguacgcuguggccaccacguucauuaccccuaugcuucggcauucuaucgaaaacagcuccgugaaugucucucugacagcgauugccaaccaggcuaccgugcucaugggccuggggaaaggauggccccugagcaagauggauaucggcguuccucuccuugccauuggguguuacucccaggugaaucccaucacacugaccgcugcccugcuccugcuugucgcucacuaugccauuaucggaccuggccugcaggcgaaggccacgcgcgaggcucagaaaagagccgcugccggcaucaugaagaacccgacaguggacgggauuaccgucaucgaccucgaucccauuccuuacgaccccaaauuugaaaagcagcugggacaggugaugcugcucguucuuugcgugacacagguccugaugaugcggaccaccugggcccugugugaggcgcucacacuggcuacgggcccuaucagcacccuuugggaagggaaucccggacgcuucuggaacacaaccauugccgugucuauggcuaacaucuuuagaggcuccuaucuggccggggccggacuccuguucagcaucaugaaaaauacagcuaacacccggcgcggcacgggcaauacaggggagacccugggagagaaguggaagaacagacucaaugcccuuggcaaaucugaauuucaaauuuacaagaaauccgggauccaggagguugaucggacccuggcgaaggaaggaauuaaaagaggcgagacagaccaucacgccgugagccgcgggucugcuaagcugcggugguucgucgagagaaaccucgugaccccggaaggaaaagugguugaucugggcugcggccgcgggggauggagcuauuacuguggcgggcuuaagaaugucaaggaggugaaaggacugacaaagggcgggccuggacaugaagaacccauccccauguccacguauggcuggaaccucgugcggcugcagucuggcgucgacguuuucuuuaccccucccgaaaaaugcgauacacugcucugugacauuggggagagcuccccuaauccgaccguggaggccggaagaacacuucgcgugcugaaccuggucgaaaauuggcucaacaauaacacccaauucugcaucaaggugcugaaucccuacaugccuagcguuaucgagaaaauggaagcccuucagcggagauacggcggggcccuggugcgcaaucccccuucccggaacucuacgcacgagauguauugggucagcaaugcguccggaaacauugugucuagcguuaauaugaucuccagaaugcucauuaaccgcuuuaccaugcggcacaagaaggccacauacgaacccgauguggaccugggcucugggaccagaaauaucggaauugagagcgaggucccgaaccuggauaucaucggcaaacgcauugaaaagaucaaacaggagcaugaaacauccuggcacuaugaccaggaucauccuuacaagaccugggcuuaucacggcagcuacgagacaaaacaaaccgggucugccuccagcauggugaauggaguggucagacuccuuacgaagcccugggacguuauuccuauggugacacagauggcuaugaccgacaccacacccuucggccagcagcggguguuuaaggaaaaagucgauacgcgcacccaagagccuaaggaggggaccaaaaagcugaugaaaaucaccgccgaauggcuguggaaggagcucggaaagaaaaagacacccagaauguguacccgggaagaguucacaagaaaagugcggucuaacgcugcccugggcgcgauuuuuaccgacgagaauaaguggaaauccgcccgcgaagcuguugaggauagcggguucugggaacuuguggacaaggagagaaaccugcaccucgaaggaaaaugcgagacgugugucuauaauaugaugggcaagcgggagaagaaacugggcgaauuugggaaggccaaaggaucucgcgcuaucugguacauguggcugggcgccagauuccucgaguuugaagcccugggguuccuuaacgaggaucauugguuuucccgggaaaauagccuguccggaguggagggcgaggggcuccacaagcugggcuacauucuucgcgacguuagcaaaaaggaaggaggcgcgauguaugcugaugacaccgccgggugggauacaagaaucacccuggaggaccucaagaacgaagagauggugacaaaucauauggaaggagagcacaaaaagcuggccgaggcuaucuuccggcugaccuaccagaacaaagucgugcgcguucagagaccgacgccucggggcacagugauggauauuaucucucgcagagaccagcgggggagcggacaagucgugaccuauggccucaacacauucaccaauauggaagcccagcugauucgccagauggagggggaaggcgucuuuaaguccauccaacaucuuacggcuaccgaggagauugccgugaaaaacuggcugguuagagugggacgggaaagacucucucgcauggcgaucagcggcgacgauugcgucgugaagcccuucgacgaucgguuugccaaugcucugacagcccuuaacgacauggggaaggugagaaaagauauccagcagugggagcccucccgcggauggaaugacuggacccagguuccuuucugcucucaccacuuucaugaacugauuaugaaggauggccgggugcucgucgugccguguagaaaccaagacgagcugaucgggcgcgcucggauuagccagggagccggcuggucccugagagaaacagcgugccucgggaaaucuuacgcccagauguggagccugauguauuuccaccgccgggaucuuagacuggcugccaaugcuaucuguuccgccguucccagccauugggugccuaccucucgcacaaccugguccauucacgcuacgcacgaguggaugacaaccgaggacaugcucaccgucuggaaccggguguggauccaggaaaaucccuggauggaggauaagacaccugucgaaagcugggaggaaauccccuaccugggcaaaagagaggaccaauggugcggaucucuuauuggccugaccucccgggccacaugggcgaagaacauccagacggccauuaaucaggugagaagccucaucgggaacgaggaauauaccgauuacaugccuuccaugaagcgcuuucggagagaggaagaggaagcuggaguucugugguga

SEQ ID NO: 20235 - RNA, 9876 nt, Artificial Sequence
  derived and/or modified CDS sequence (opt5) from DENV-2__JQ955623__SS-prME
accgccggcaugaucauuaugcugauccccacagcuauggccuuccaccucacgaccagaaacggggagccucauaugauugugagccggcaggaaaagggaaaaucccugcuuuuuaagacagaggacggcgucaauaugugcacccugauggcgauggaucucggggaacugugugaggacacaaucaccuacaacugcccgcuucugcgccaaaaugaacccgaggauauugacuguuggugcaacucuacaagcaccuggguuacguauggaaccuguacagcuaccggcgagcacagacgggaaaaacgcuccguggcccucgugccucaugucgggaugggacuggagacaagaaccgaaacguggaugucuagcgagggcgccuggaagcacgcucagcggaucgagacauggauccugcgccaucccggcuucaccauuauggccgcuauccucgccuacacaauugggaccacccacuuucagagagugcugaucuucauucuucugacagcgguugccccuuccaugacgaugcggugcaucggaauuucuaaucgcgauuuuguggaaggcgucagcgggggauccuggguggacaucguucucgagcacggcagcugugugaccacaauggcuaaaaacaagcccacccuggauuucgaacuuaucaagacagaggccaaacagccugcuacccugagaaaguauugcauugaagccaaacucacgaauacaaccaccgcgucucgguguccgacacaaggggagcccucccugaacgaggaacaggacaagcgcuuugucugcaaacauagcaugguggauagaggauggggcaauggcugugggcuguucggaaagggcgggaucgugaccugcgccauguuuacaugcaagaaaaacauggagggaaagauuguccagccugaaaaucucgaguacacgaucguugugaccccccacucuggcgaagagaacgcuguggggaaugacacaggaaaacauggcaaggagauuaaagucaccccucaguccagcaucacagaagccgagcugaccggcuaugggacggugaccauggaauguucuccccggacaggacuugauuucaacgagaugguucugcuccaaauggaaaauaaggcuuggcuggugcaccgccagugguuucuugaccugccgcucccuuggcugcccggcgccgauacccagggguccaacuggauccagaaagagacacuggucaccuucaagaacccucacgccaagaaacaagacgugguugugcucggaagccaggagggcgcuaugcauacggcgcugacaggggccaccgaaauucagauguccucuggcaaucuucuguuuacaggacaccucaagugcagacugcggauggacaaacuucaacugaagggcaugagcuacuccauguguaccgggaaauucaaggucgugaaggagaucgcugaaacccagcauggaacaauugucaucagagugcaguaugagggcgaugggagccccugcaaaauucccuucgagaucauggaccucgaaaagcgccacguucugggacggcugaucacggugaacccuauugucaccgagaaagauucuccggugaauaucgaagccgagcccccuuuuggcgacuccuacauuaucguugggguggaacccggccagcucaagcugagcugguucaaaaagggaucuagcauuggccaaauguuugagacaaccaugagaggggccaagcgcauggcuauccuuggagauacagccugggacuucggcucccuggggggagucuuuaccucuauuggcaaagcgcuccaucagguguucggggcuaucuacggcgccgccuuuagcggaguguccuggacgaugaagauccugauuggcguugucaucacauggauugggaugaacagccggucuaccucccugagcgugucucuugugcucgucggaaucgugacccuguaucugggcguuauggugcaggcugauuccgggugugucgugagcuggaaaaauaaggagcucaaaugcggauccggcauuuucaucacagacaacguucacaccuggacagaacaguacaaguuucaaccugagucucccagcaagcuggccuccgcuauccagaaagcccacgaagaggggauuuguggcaucagaucugugacgcgccuugaaaaucugauguggaagcagauuaccccggagcucaaccauauccugagcgagaaugaagucaaacugacaauuaugaccggagauaucaagggcaucaugcaggcggggaaacggucccuuagaccucaacccacagagcucaaguauagcuggaaaaccuggggaaaggccaagaugcugucuacggaaccucacaaccagaccuuccugauugacggccccgagacagcugaaugcccuaauaccaaccgcgccuggaauucccucgagguggaggauuacggguuuggaguuuucacaaccaacaucuggcugaaacuuaaggaacggcaggacguguuuugugacagcaaacugaugucugcugccauuaaggauaauagagcgguccaugccgacaugggcuauuggaucgaguccgcucucaacgauacauggaaaauugaaaaggccagcuucaucgaggugaagucuugccacuggcccaaaagccacacccugugguccaacggcgugcuggagagcgaaaugaucauuccgaagaauuucgcugggccugucucucagcauaacuaccgccccggauaucacacgcaaacagccggccccuggcaucuugggaaacucgagauggacuuugauuucugugaaggaaccaccguuguggugacagaggacugcggcaaucgggggccuucccugagaaccacgacagccagcggaaagcugaucaccgaauggugcugucgguccugcacacucccgccccugcgcuacagaggcgaggauggcuguugguacgggauggagauucggccucuuaaagaaaaggaggaaaaccuggucaauucucucgugaccgcuggacacggccagaucgacaacuuuagccuggggguucugggaauggcgcuuuuccucgaggaaaugcugagaacacgcgugggcaccaagcaugccguccugcucguggcuguuuccuuuaugacgcugauuaccgggaauaugucuuuccgggaucuuggaagagugauggucauggugggcgccgccaugacagacgauaucggcauggggguuaccuaucuggcucuccuggccgcguuuaaagugcgccccacauucgcugccggacugcuucugagaaagcucaccagcaaagagcugaugaugacgacaauuggcaucguccuccugucccagucuaccaucccugagacaauucuugaacugaccgacgcccucgcucuggggaugaugauccugaagauugugcggaacauggagaaauaccaacuugccgugaccaucauggcgauucugugcguccccaaugcuguuauccuccagaacgccuggaaggugagcuguacaauccuggccguggucuccgugagcccucuccugcuuacgucuucccagcagaaggcugauuggauuccccuggcccucaccaucaaaggacugaauccgacagcuauuuuucugaccacacuuagccgcaccaacaagaaaagaucuuggccucugaaugaagccaucauggcgguuggcaugguguccauucucgccagcucucugcucaagaacgacauccccaugacggggccucuggucgcuggaggccuucugacagugugcuauguucugaccggccgguccgccgaccucgagcuggaacgcgcugccgaugugagaugggaggaccaagccgagaucagcggguccagccccauucuuucuaucaccauuagcgaagauggauccaugucuaucaaaaaugaggaagaggagcagacacugaccauucucauccggacaggccugcucgucauuagcgggcuguucccgguguccaucccuaucacggcugcggccugguaccuuugggaagucaagaaacagcgcgcuggagugcugugggacguucccucuccuccccccgugggcaaggccgagcuggaagauggggccuauagaauuaagcagaaaggaauccucggcuacagccaaauuggcgcuggggucuauaaggagggaaccuuucacacaauguggcacgugacccggggcgccguucugaugcauaaagggaagcgcaucgaaccuuccugggcggacgugagaaaagaucuuauuucuuacggaggcggguggaagcuggagggagaguggaaggaaggcgaggaaguccaggugcucgcucuggagccgggcaaaaacccccgggccgugcagacaaagccugggcucuucaaaaccaacacgggaaccaucggcgccguuagccuggacuuuucccccgggacaagcggaucuccuaucgucgauaagaaaggcaaggugguggggcuuuacggaaauggcgucgugaccagauccggcacauauguuagcgcuauugcccagaccgaaaagucuaucgaggacaaccccgagauugaagaugacaucuuccgcaaaaagcggcugacaauuauggaucugcacccuggggcgggaaaaacgaagagauaccucccggcuaucgugcgcgaggccaucaaacggggccugagaacccuuauucuggcccccacacgcgucguggcugccgaaauggaggaagcucuccgggggcugccuaucagauaucaaacccccgccauucgcgcggagcauaccggacgggagaucguugaccucaugugucacgccacauucacgaugagacugcuuuccccugugcggguccccaauuacaaccugauuaucauggacgaagcucauuuuaccgauccggccagcauugcugcccgcggcuauaucuccacaagaguggagaugggggaagccgcuggcaucuucaugaccgcgacaccucccggaucucgggaccccuuuccucagagcaaugcccccauuauggaugaggagcgcgaaaucccugagagauccuggaacagcggccacgaauggguuaccgacuucaaggggaagacggugugguuugucccgucuauuaaagcuggaaaugauaucgccgccugccugcggaagaacggcaaaaaggugauucagcucuccagaaaaacauucgacagcgaguacaucaagacccgcaccaaugauugggacuuuguggucacaaccgauaucucugaaaugggggcuaacuucaaggccgagcggguuauugaccccagacgcuguaugaaaccugugauccugacagauggagaggaacgggugauucuugcgggccccaugccugucacccacagcuccgcugcccaaagacgcgggcggaucggcagaaaucccaagaacgagaaugaccaguauauuuacaugggagaaccgcuggagaacgacgaagauugcgcccauuggaaagaggcuaagaugcuccuggacaauaucaacacgccugagggcaucauucccucuauguuugaaccugagcgcgaaaaaguggaugccaucgacggggaguacagacugcggggagaagcgcgcaagacauucguugaucucaugagacggggcgaccuucccguguggcuggccuaucgcgucgcugccgaggggauuaacuacgcugauagacggugguguuuugacggaaucaaaaauaaccagauucuggaggaaaauguggagguugaaaucuggaccaaggagggcgagagaaagaaacucaagccucgcuggcuggaugcccggauuuauagcgacccccuugcucugaaagaauucaaggaguucgccgcggggagaaaaucccucacacugaaccugaucaccgaaaugggccgccucccgacguuuaugacccagaaggcccggaaugcucuugauaaccuggccgugcugcacacagcugaggccggaggcagagccuacaaucaugcucucucugaacugccugagacccuugagacacugcuccugcugacccuccuugcgacagucaccgggggaaucuuccuguuucugaugagcggcaaggggauuggaaaaaugacgcucggcaugugcugcaucauuacagccuccauccugcuuugguaugcucaaauucagccccacuggaucgccgccagcaucauucuggaauucuuucucaucgugcugcugauucccgagccugaaaagcagcggaccccgcaggacaaccaacucaccuacgucgugaucgcuauucuuacaguuguggccgcgaccauggccaaugagaugggcuuccuggaaaaaacaaagaaagauuuugggcugggaucuaucgcuacgcagcagcucgaguccaacauccuggacauugaccuucgccccgccagcgcuuggacccuguaugccguggcgacaaccuucaucacaccuaugcucagacacuccauugagaauucuagcgucaacguuucccugaccgccaucgcuaaucaggccacggugcugaugggccucgggaagggauggccccuuucuaagauggauauuggcgugccucugcuggcuaucggguguuacagccaagucaaccccauuacccucacagccgcucugcuucugcucguggcccauuacgcgaucaucggaccuggccugcaggccaaagcuacccgggaagcccagaagcgcgcugccgccggcauuaugaaaaauccgacaguugacgggaucaccgugauugaucuggaccccaucccuuaugaucccaaguuugagaaacagcucggacaagucaugcuucuggugcugugcgucacgcaggugcucaugaugagaacaaccugggcgcugugugaagcucuuacacuggccaccggcccuauuuccacccucugggaggggaaccccggacgguucuggaauacaacgaucgcuguuagcauggccaacaucuuucgcggcucuuaccuggccggggcuggacugcucuucuccauuaugaagaacaccacaaauaccagacggggcacaggcaacaccggggaaacgcuuggagagaaguggaaaaaucgccugaacagccugggcaagucugaguuucagaucuauaaaagauccgggauucaagaaguggaccggacacucgccaaggagggaaucaaaagaggcgaaaccgaucaccaugcggucagccgcgggucugccaagcugcggugguucguggagagaaaucuuguuaccccggagggaaaaguggucgaccugggcugcggccgcgggggauggagcuacuauuguggcgggcucaagaacgugcgggaagugaagggacugacaaaaggcgggccuggacacgaggaacccauucccauguccaccuacggcuggaaucugguuagacuccagucuggcgucgauguguucuuuacaccucccgagaagugcgacacgcuucugugugauaucggggaaagcuccccuaacccgaccguggaggcuggacgcacacugcggguccucaaucugguugagaacuggcuuaauaacgacacccaguucugcaucaaagugcugaaucccuauaugccuagcgugauugaaaagauggaggcccuccagagaaaauacggcggggcucugguccgcaacccccugucccggaauucuacacaugaaauguacugggugagcaacgccuccggaaacaucguuucuagcgugaauaugauuuccagaaugcucaucaaccgcuuuaccaugcggcacaagaaggcgacguaugagccugaugucgaccuuggcucugggaccagaaauauuggaaucgaaagcgagacacccaaccuggacaucauuggcaaacgcaucgagaagauuaaacaagaacacgagaccuccuggcauuacgaucaggaccacccguauaagacaugggccuaccauggcagcuaugaaaccaaacagacagggucugcuuccagcauggugaauggaguugugagacugcucaccaagccuugggaugucauccccauggugacgcagauggccaugacagacaccaccccuuucggccaacagcggguguuuaaggagaaagucgauacacgcacgcaggaacccaaggaggggaccaaaaagcugaugaaaauuacagcugaguggcuuuggaaggaacugggaaagaaaaagaccccuagaauguguacacgggaggaauucaccagaaaaguucggucuaacgccgcucucggcgccaucuuuacagacgagaauaaguggaaauccgcgcgcgaggccguggaagauagcagauucugggagcuggugaacaaggaacggaaucugcaccucgaggggaaaugcgaaaccugugucuacaacaugaugggaaagcgcgagaagaaaauuggcgaguuuggcaaggcuaaagggucuagagccaucugguauauguggcugggagcucgguuccuugaauuugaggcccugggcuuccucaaugaagaccacugguuuucccgcgagaacagccuguccgggguggaaggagagggccuucauaagcugggguacauccucagagagguuagcaaaaaggaaggcggagccauguacgcggaugacacggcuggcugggauacccggauuacacuggaggaccugaagaaugaagagauggugaccaaccacauggaaggggagcauaaaaagcucgccgaggccaucuucaaacugacauaucagaauaaggucgugcgcguucaaagacccaccccgcggggaacggugauggacauuaucucucgcagagaucagcggggcagcgggcaggucggaacauacggccuuaacaccuucacaaacaugggggcucaacugauucgccagauggaaggcgagggaguguuuaaaggcauccagcaccucaccgccacggaagagaccgcuguucaugacuggcuggccagaguggggcgggagagacuuucccgcauggcgaucucuggagaugacugcgucgugaagccucuggaugaccgguucgccagcgcucucacagcccugaaugauaugggcaaggucagaaaagacauucagcaaugggaacccucccgcggguggaacgauuggacccaggugcccuuuugcucucaccacuuccaugagcugaucaugaaggacggacggguucucguggucccuuguagaaaucaggaugaacugauuggccgcgcucggaucagccagggggccggcuggucccuuagagagacagcgugccugggaaaaucuuaugcccaaauguggagccucauguacuuucaccgccgggaccugagacuugcugccaacgcuauuuguuccgccgugccgagccauugggugcccaccucucgcacaaccugguccauccacgcucggcacgaauggaugacgacagaggauaugcugaccguuuggaauagaguguggauccaggagaacccuuggauggaagacaagacccccgucgagagcugggaagagauuccuuaucucggcaaacgggaagaccaguggugcgggucucugaucggacugacauccagagccaccugggcgaagaauauucagacagccaucaaccaagugcgcagccucauuggcuccgaggaguacacggauuauaugcccucuaugaagcgguucagacgcgaagaggaagaggcugggguucugugguga

SEQ ID NO: 20236 - RNA, 9876 nt, Artificial Sequence
  derived and/or modified CDS sequence (opt5) from DENV-2__KR779782__SS-prME
accgccggaaucauuaucaugaugauucccaccgugauggcuuuccaccugacgaccagaaacggggaaccucauaugaucgucagccggcaggaaaagggaaaaagccuccuguuuaagacggaaaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaacaggggauuuguggcaucagaucugugacgcgccuggagaaccuuauguggaagcagauuaccccggaacugaaucauauccucacagagaacgagguuaaacugaccauuaugacaggagacaucaagggcaucaugcaggccgggaaacggagccugagaccucaacccaccgaacuuaaguacuccuggaaagcguggggaaaggccaagaugcucagcacggagcugcacaaucauaccuuccugauugauggcccugaaacagcugagugccccaacaccaaucgcgccuggaacucucucgaaguggaggacuauggguuuggagucuucacaaccaauaucuggcugaaacuuaaggagcggcaggauguguuuugugacuccaaacugaugagcgcugccauuaaggacaacagagcggugcacgccgauaugggcuacuggaucgaaucugcucucaacgacacauggaaaauugagaaggccuccuucaucgaagucaagagcugccacuggccuaaaucucauacccuguggagcaauggcguucuggaguccgagaugaucauucccaagaacuucgcugggccggugagccagcacaauuaucgcccuggauaccauacgcagacagccggccccuggcaccuugggcggcucgaaauggauuuugacuucugugagggaaccaccguggucgugacagaagauugcggcaacagagggcccucucugcggaccacgacagccuccggaaaacugaucaccgaguggugcugucgcagcugcacacucccuccgcugagauaccggggcgaagacggcuguugguaugggauggagauuagaccccuuaaggagaaagaagagaaucugguuaacucccucgugaccgcuggacauggccaaaucgauaauuuuucucuggggguccugggaauggcgcuuuuccucgaagagaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggaacugaugaugacaaccaucggcaucgugcuccugagccaguccacaauucccgagucuauccuugagcugaccgaugcccucgcccuggggaugaugguccugaaaauuguucgcaauauggaaaaguaucagcuugcugugaccaucauggccauucugugcgugccuaacgcggucauccuccaaaaugcuuggaaagugagcuguacaacgcuggccguuguguccgucagcccccuccugcuuaccucuucccagcagaaggccgacuggaucccucuggcucucacaauuaagggacugaaccccaccgccaucuuucugacaacccuuagcagaacgucuaaaaagcgguccuggccgcugaaugaggcuauuauggccgugggcaugguuagcauccucgcgucuucccugcucaaaaacgauauuccuaugacagggccccugguggccggaggccuucugaccgucugcuacgugcugaccggccgcagcgcugaccucgaacuggagagagccgcugacguccggugggaagaacaggccgagaucuccgggagcucuccuauccuuagcauuacaaucuccgaagauggaucuaugagcauuaagaaugaggaagaggagcaaacccugacaauccucauucgcacgggccugcucgugaucuccgggcuguuccccguuucuauuccgaucaccgccgcugcgugguaucuuugggaagugaaaaagcagagagccggaguccugugggacgugccuucucccccucccguuggcaaagcugagcuggaagauggggccuaccggaucaagcagaagggcauucucggcuauucccagaucggcgccgggguguacaaagagggaacauuucacaccauguggcaugucacacgcggcgcugugcugaugcacaaggggaaaagaauugaacccuccugggccgacgugaagaaagaucuuaucagcuacggaggcggguggaagcuggagggagaguggaaggaaggcgaggaaguucaaguccucgcgcuggagccuggcaaaaacccgcgggcugugcagaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagaaaaguccauugaggacaacccugagaucgaagaugacauuuuccgcaaaaagcggcugacgaucauggaucugcaucccggggccggaaaaaccaagagauaucucccugcgauuguucgcgaggcuaucaaacggggccugagaacacuuauccuggccccgacccgcguggucgccgcugaaauggaggaagcccuccgggggcugcccauuagauaccagaccccugcuauccgcgccgagcacacaggacgggagauuguggaccucaugugucaugcgacguucaccaugagacugcuuagccccauccggguuccuaauuauaaccugauuaucauggaugaagcccacuuuacagaccccgcuuccauugccgcucgcggcuacaucucuaccagaguggagaugggggaagccgccggcaucuucaugacagcuaccccgccuggaagccgggaccccuuuccccaauccaaugcgccuauuauggaugaggagcgcgaaauccccgagagaagcuggaacucuggccacgaaugggucacggacuucaaggggaagacagugugguuugugccuuccauuaaagccggaaaugauaucgcugccugccugcggaagaacggcaaaaaggucauucagcucagcagaaaaaccuucgacucugaguauaucaagacccgcacaaaugauugggacuuuguugugaccacagauaucagcgaaaugggggccaacuucaaggcugagcgggugauugacccgagacgcuguaugaaacccgucauccugaccgauggagaggaacgggugauucuugccggcccuaugcccguuacgcauuccucugcggcucagagacgcgggcgggugggcagaaauccuaagaacgagaaugaccaauacaucuacaugggagaaccccuggagaacgaugaagacugcgcccacuggaaagaggccaagaugcuccuggacaauauuaacacaccggagggcaucaucccuagcauguuugaacccgagcgcgaaaaagucgaugcuauugacggggaguauagacugcggggagaagcccgcaagaccuucguggaucucaugagacggggcgaccuuccuguuuggcuggcguaccgcguggccgcugaggggaucaacuaugccgauagacggugguguuuugacggagucaaaaauaaccagauucuggaggaaaauguggaggucgaaaucuggacaaaggagggcgagagaaagaaacucaagccccgcuggcuggaugcucggauuuacuccgacccucuugcccugaaagaguucaaggaguucgcugccgggagaaaaucucucacccugaaccugaucacggaaaugggccgccuccccaccuuuaugacacagaaggcgaagaaugcccuugauaaccuggcugugcugcauaccgccgaggcuggaggccgggccuauaaucacgcccucagcgaacugccggagacacuugagacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucaaccucacuggaucgcugccucuauuauccuggaguucuuucucaucgugcugcugauucccgagcccgaaaaacagagaaccccucaggacaaccagcucacauauguggucaucgccauucuuaccguuguggcugccacaauggcgaaugagaugggcuuccuggaaaagacgaaaaaggauuuugggcugggauccaucaccacacaacagccggagagcaacauucucgacaucgaucugcggcccgccuccgcuuggacccuuuacgccguggcuacaaccuucaucacgccuaugcugcgccauucuauugagaauagcuccgucaacgugucucucaccgccaucgcgaaucaggccacaguucugaugggccuggggaagggauggccccucagcaaaauggacauuggcgugccucuucuggcuaucggguguuacucccaggucaaccccauuacccugacagccgcucuccugcuucugguggcccacuaugcuaucauuggaccuggccuccaagccaaggcgaccagagaagcccagaaacgggcugccgcuggcaucaugaagaauccgacggucgacgggaugacagugaucgaucuggaccccauuccuuacgaucccaaauuugagaagcagcugggacagguuaugcuccuugugcugugcgucacccaagugcugaugaugcgcacaaccugggcccucugugaagcccugacccuugcgacaggcccuaucagcacgcugugggaggggaaccccggaagauucuggaauaccacaauugcuguuucuauggccaacaucuuucggggcuccuaucucgcuggggccggacugcuguucagcauuaugaagaacaccgccaauacacgcagaggcaccggcaacacgggggaaacacucggagagaaauggaagaaucggcuuaacgcucugggcaaaucugaguuucagaucuacaagaaauccgggauccaggaaguggaccgcacccuggccaaggagggaauuaaaagaggcgaaaccgaucaucacgcggucagccgggggucugccaagcucagaugguucguggagcgcaaucuggugacaccggagggaaagguugucgaccuuggcugcggcagagggggauggagcuauuacuguggcgggcugaaaaacgugaaggaagugaaaggacucaccaagggcgggccuggacaugaggaacccauccccauguccacauauggcuggaaucuggucagacugcaaucuggcguugauguguucuuuacgccucccgagaaaugcgacacccuccuuugugauauuggggaaagcuccccuaacccgacaguggaggcuggacgcacccugcggguccugaaucucguggagaacuggcugaauaacaauacacaguucugcaucaagguucuuaaccccuacaugccuagcgugauugaaaagauggaggcccugcagagaaaauacggcggggcucucguccgcaauccccugucccggaacucuacccacgaaauguauugggugagcaacgccuccggaaauaucguuucuagcgugaacaugaucuccagaaugcugauuaaucgcuuuacgaugcggcacaagaaagcgaccuacgagccugacgucgaucucggcucugggacaagaaacaucggaauugaaagcgagacccccaaucuugacaucauuggcaagcgcaucgagaaaaucaagcaggaacaugagacauccuggcacuaugaucaagaccauccguacaagaccugggccuaucacggcagcuacgaaacaaaacagaccgggucugcuuccagcauggugaacggagugguccggcugcugacgaagccuugggacguuauucccauggugacacagauggccaugaccgauaccacaccuuucggccagcaaagaguguuuaaagagaaggucgacacgcgcacccaggaacccaaagaggggacaaagaagcucaugaaaaucaccgcugaguggcuguggaaggaacuuggcaaaaagaaaacaccuagaauguguacccgggaggaguucacacgcaaggugagaucuaaugccgcucugggcgccauuuuuaccgaugagaacaaauggaaguccgcgcgggaggccguugaagacagcggguucugggagcucguggauaaggaaagaaaucugcaccuggagggaaaaugcgaaacgugugucuauaacaugaugggcaagcgggagaaaaagcucggcgaguuugggaaagcuaagggaucucgcgccaucugguacauguggcugggcgcuagauuccuugaauuugaggcccugggguuccucaaugaagaccauugguuuucccgggagaacagccuguccggaguggaaggcgaggggcuucacaagcugggcuacauucuccgcgauguuagcaaaaaggagggaggcgccauguaugcggacgauaccgcugggugggacacaagaaucacccuggaagaucugaaaaaugaggaaauggugacaaaccauauggagggagaacacaagaaacucgccgaggccauuuucaagcugaccuaccagaauaaggucgugcggguucagcgccccacgccgagaggcacagugauggacaucaucucucggcgcgaccaaagagggagcggacaggucgugaccuauggccuuaacacauucaccaacauggaggcucagcugauucggcaaauggaaggggagggcgucuuuaaauccauccagcagcucacggugaaggaagagauugccguuaaaaauuggcugauccgcgugggaagagagcggcuuucucgcauggcuauuagcggcgaugacugcgucgugaagccucuggaugacagauucgccuccgcgcucaccgcccugaacgauauggggaaagugcggaaggacauccagcaaugggaacccucuagaggauggaaugauuggacacagguucccuuuugcagccaucacuuccacgagcugaucaugaaggacggccgcgugcucgucgugccuugucggaaccaggaugaacugauugggagagcucgcaucucccagggagccggcuggucucuucgggagaccgcuugccuggggaaaagcuacgcccaaauguggucccucauguauuuucauagacgcgaccugcggcuugcggccaaugcuauuuguagcgccguuccgucucacugggugcccacauccagaaccacauggagcauccaugcuacccacgaauggaugacgacagaggauaugcugaccgucuggaaccgcguguggauucaggagaauccuuggauggaagacaagacccccgucgagucuugggaagagaucccuuaccucggcaaacgggaagaucaguggugcggaucccugaucggccugacaagcagagccaccugggcuaagaacauucagacagccaucaaucaagugcgcucccucauugggaacgaggaguauacggacuacaugcccucuaugaaacgguucagacgggaagaggaagaggcgggaguucugugguga

SEQ ID NO: 20237 - RNA, 9876 nt, Artificial Sequence
  derived and/or modified CDS sequence (opt5) from DENV-2__KM279608__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagugaccggcgagcacagacgggaaaaacgcuccgucgcgcuggugccucauguugggaugggacucgagacaagaaccgaaacguggaugucuagcgagggcgcuuggaagcacgcccagcggaucgagacauggauucugcgccaucccggcuucaccaucauggccgcuauucuggccuacacaaucgggaccaccuaucuccagagagugcugauuuuuauccuucugacagcugucacgccuuccauggccaugcggugcauuggaaucucuaaccgcgacuucguggaaggcguuagcgggggauccuggguggauaucguccucgagcacggcagcugugugaccacaauggcgaaaaauaagcccacccuggacuuugaacuuauuaagacagaggccaaacacccugcuacccugagaaaguacugcguggaagccaaacucacgaacacaaccaccgcuucucgguguccgacacagggggagcccucccugaaugaggaacaagauaagcgcuucgucugcaaacauagcaugguugacagaggauggggcaacggcugugggcuguuuggaaagggcgggaucgugaccugcgccauguucacaugcaagaaaaauauggagggaaaggugguccagccugaaaaccucgaguauacgauugugaucaccccccacucuggcgaagagaaugcgguugggaacgauacaggaaaacauggcaaggagauuaaagugaccccucaguccagcaucacagaagccgagcugaccggcuacgggacggucaccauggaauguucuccccggacaggacuugacuuuaaugagauggugcugcuccagauggaaaacaaggcuuggcugguucaccgccaaugguuccuugaucugccgcucccuuggcugcccggcgccgacacccagggguccaacuggauccagaaagagacacuggugaccuuuaagaauccucacgcuaagaaacaggaugucgugguccucggaagccaagagggcgccaugcauacggcccugacaggggcuaccgaaauucagauguccucuggcaaccuucuguucacaggacaccucaagugcagacugcggauggacaaacuucagcugaagggcaugagcuauuccauguguaccgggaaauuuaaggugguuaaggagaucgcggaaacccaacauggaacaauugugaucagaguccaguacgagggcgacgggagccccugcaaaauucccuucgagaucauggaucucgaaaagcgccacgugcugggacggcugaucacgguuaauccuauugugaccgagaaagacaacccggucaauaucgaagccgagcccccuuucggcgauucuuacauuaucauugggguggaacccggccagcucaagcuguccugguauaaaaagggaagcucuaucggccagauguuugagacaaccaugagaggggcuaagcgcauggccauucuuggagacacagccugggauuucggcagccuggggggaguguuuaccuccaucggcaaagcucuccaucaaguuuucggggccaucuacggcgcggcuuuuucuggagucagcuggacgaugaagauucugaucggcguggugauuacauggaucgggaugaacucccggagcaccucucuguccgucagccuugugcucguuggaguggucacccuguaucugggcgugaugguucaggccgacucuggguguguggucuccuggagaaauaaagagcucaagugcggaagcggcauuuucaucacagauaacgugcacaccuggacagaacaguacaaauuucagccugagucccccucuaagcuggccagcgcuauccaaaaggcccacgaagaggggauuuguggcauccgcuccguuacgcggcuugaaaaucugauguggaaacagauuaccccggagcucaaccauauccugacagagaaugaagugaagcugaccauuaugacaggagacaucaaaggcaucaugcaggcugggaagagaucucuucgcccucagcccaccgagcucaaauauagcuggaaggccuggggaaaagcgaagaugcuguccacggaacugcacaaccauaccuuccucauugauggcccugagacagccgaaugccccaauaccaaccgggcuuggaauagccuggaggucgaggacuacggguuuggaguguucacaaccaacaucuggcuuaagcugaaagaaagacaagauguguuuugugacucuaagcucauguccgccgcuauuaaagacaaccgcgccguccacgcggauaugggcuauuggaucgagagcgcccugaaugacacauggaagauugaaaaagcuucuuucaucgagguuaaguccugccacuggccuaagagccauacccuguggucuaacggcgugcuugagagcgaaaugaucauucccaaaaauuuugccgggccggugucccagcacaacuaccggccuggauaccauacgcagacagcuggccccuggcaccucgggagacuggagauggauuucgacuucugugaaggaaccaccgucgugguuacagaggauugcggcaaucgggggcccagccugcgcaccacgacagccucuggaaagcucaucaccgaauggugcuguagauccugcacacugccuccgcuucgguauagaggcgaggacggcuguugguacgggauggagauucgcccccugaaagaaaaggaggaaaaccucgugaauagccuggucaccgccggacauggccagaucgauaacuuuucccugggggugcuuggaauggcucucuuccuggaggaaaugcugcggacaagaguuggcaccaaacacgcgauucuccugguggccgucucuuuugugacgcuuaucaccgggaauaugagcuuccgcgaccugggaagaguuauggugauggucggcgcuacaaugaccgaugacauuggcaugggggugacauaucucgcccugcuggccgcuuuuaaggugcggccuaccuucgccgcgggacuucugcuccgcaagcugacguccaaagagcucaugaugacaaccaucggcaucguccugcuuucucaaagcacaauucccgaguccauccuggaacucaccgaugcucuggcccuggggaugaugguucuuaagauugugagaaacauggagaaauaccagcuggccgugaccaucauggcuauucucugcgucccuaaugccgugauccuggaaaacgcguggaagguuucuuguacaacgcucgcuguggucagcguguccccccugcuucugaccagcucucagcaaaaagccgacuggaucccucucgcccugacaauuaagggacugaaucccaccgcuaucuuucuuacaacccugucccggacgagcaagaaacgcucuuggccgcucaacgaggccauuauggcuguuggcaugguguccauccuggccagcucucuccugaagaaugauauuccuaugacagggccccuugucgcgggaggccugcugaccgugugcuauguccucaccggcagauccgccgaccuggaacuugagcgggcugccgacgugcgcugggaggaacaggcugagaucagcggguccagcccuauccugucuauuacaaucagcgaagauggauccaugucuauuaaaaacgaggaggaagagcagacccucacaauccugauuagaacgggccuccugguuaucagcgggcuuuuccccguguccauuccgaucaccgccgccgcuugguaccugugggaagucaagaaacagcgggcgggagugcugugggacguuccuucucccccucccgugggcaaggccgagcucgaagauggggcuuaucgcaucaaacaaaagggaauucugggcuacagccagaucggcgccggggucuacaaggagggaacauuucacaccauguggcaugugacaagaggcgccgugcuuaugcacaaagggaagcggauugagcccuccugggcugacguuaaaaaggaucugaucucuuauggaggcggguggaaacucgaaggagaguggaaggaaggcgaggaaguccaggugcuggcccucgagccuggcaagaacccgagagcggugcagaccaaacccgggcuguucaagacgaauaccggaacaauuggcgcugucagccuugacuuuuccccugggaccagcggaucucccaucguggauaaaaagggcaaaguuguggggcuguacggaaacggcgucgugacacgcuccggcaccuauguuagcgccaucgcccaaacagagaagucuauugaagacaauccugagaucgaagaugacauuuuccggaagaaaagacugacgaucauggaucuccaucccggggcuggaaagaccaaacgcuaccugccugccauugugcgggaggcgaucaagagaggccuucgcacacugauccucgcuccgacccgggucguggccgccgaaauggaggaggcucugagagggcuccccauucgcuaucagaccccugccauccgggcugaacacacaggaagagagauuguugaccugaugugucaugccacguuuaccaugcggcuucugucccccauccgcgugccuaacuacaaucugauuaucauggaugaagcgcacuucacagaccccgccagcauugcugccagaggcuauaucuccacccgggucgagaugggggaggcugccggcaucuucaugacagccaccccgccuggaucucgcgaccccuuuccccagagcaacgcuccuauuauggaugaagagagagaaauccccgagcgguccuggaauagcggccacgaaugggugacggacuucaaagggaagacagugugguuugucccuucuauuaaggcgggaaacgauaucgccgcuugccucagaaaaaauggcaagaaaguuauucagcugucccgcaagaccuucgacagcgaguacaucaaaacccggacaaacgauugggacuuuguggugaccacagauaucucugagaugggggccaauuucaaggccgaaagagucauugacccgcgccgguguaugaagcccgugauccuuaccgauggagaggaaagaguuauucuggcuggcccuaugcccgugacgcauagcuccgccgcgcaacgccgggggagagucggccgcaacccuaaaaaugagaacgaccaguacaucuauaugggagaaccccucgagaaugaugaggacugcgcucacuggaaggaagccaaaaugcugcuggacaacauuaacacaccggagggcaucaucccuucuauguuugaacccgagagagaaaagguggaugccauugacggggaguaccggcuccgcggagaggcuagaaaaaccuucguugaucuuaugcggcgcggcgaccugccuguguggcuggccuauaaggucgcggccgaagggaucaauuacgcugauagacggugguguuuugacggagugaaaaacaaucagauucucgaggaaaacgucgagguggagaucuggacaaaggaaggcgagagaaagaaacugaagccccgcuggcuugaugcccggauuuauagcgacccucuggcucucaaagaauucaaggaguuugccgcugggagaaaaucccugacccugaaucucaucacggaaaugggccgccuucccaccuucaugacacaaaaggccaagaacgcgcuggauaaucuggccguucuccauaccgcugaggccggaggccgggcuuacaaccacgcccugucugagcuuccggaaacacuggagacccuccugcugcucacacuucuggccaccgugacggggggaauuuuccuguuucucaugagcggcaaagggaucggaaagaugacacugggcaugugcugcaucauuaccgcuuccauccuucugugguaugcgcagauucagccucacuggaucgccgcuagcauuauccucgaauucuuucugaucgugcugcucauucccgagcccgaaaaacagagaaccccucaagacaaucagcuuacauacgucguuaucgccauucugaccgugguggccgcuacaauggccaacgagaugggcuuccuggagaagacgaaaaaggauuuugggcucggaucuaucaccacacagcagccggaauccaauauucuggacaucgaucuucggcccgcgagcgccuggacccuguacgcugucgccacaaccuucaucacgccuaugcuccgccauuccauugagaacucuagcgugaauguuucccugaccgcuaucgccaaccaagcgacagugcugaugggccucgggaagggauggccccuuucuaaaauggacauuggcgucccucugcuggccaucggguguuauagccaggugaaucccauuacccucacagcugcccugcuucugcucgucgcucacuacgccaucauuggaccuggccugcaggcuaaggccaccagagaagcgcagaaacgggccgcugccggcaucaugaagaacccgacgguggacgggaucacaguuauugaucuggaccccaucccuuaugaucccaaauuugagaagcaacucggacaggugaugcuucugguccugugcgugacccagguucucaugaugcgcacaaccugggcucugugugaagcccuuacccuggccacaggcccuauuuccacgcucugggaggggaaucccggaagauucuggaacaccacaaucgcggugagcauggcuaacauuuuucggggcucuuaccuggccggggcuggacugcucuucuccaucaugaagaauaccgccaacacacgcagaggcaccggcaauacgggggagacacuuggagaaaaauggaagaaccggcugaaugcccugggcaaaagcgaguuucagaucuauaagaaaucugggauucaagaagucgaccgcacccucgcuaaggagggaaucaaaagaggcgagaccgaucaucacgccgugucccgggggagcgcgaagcugagaugguucguggaacgcaaccuuguuacaccggagggaaaggucguggaccugggcugcggccgggggggauggucuuacuauuguggcgggcucaaaaaugugaaggaagucaaaggacugaccaagggcgggccuggacaugaggaacccauucccaugagcacauacggcuggaaccugguuagacuccaguccggcguggauguguuuuucacgccucccgagaaaugcgacacccuucugugugauaucggggagucuagcccuaauccgacagucgaagccggacgcacccugcgggugcucaaccugguugagaauuggcuuaacaauaacacacaguucugcauuaaggugcugaaucccuacaugccuuccgucaucgaaaagauggaggcucuccaaagaaaauauggcggggcccuggugcgcaacccccugagccggaacuccacccacgaaauguacuggguuucuaaugcuagcggaaacaucguguccucugucaauaugauuagcagaaugcucaucaaccgcuuuacgaugcggcacaagaaagccaccuaugagccugacguggaucuuggcuccgggacaagaaauauuggaaucgagucugaaacccccaaccuggacauuaucggcaagcgcaucaaaaagauuaagcaggagcaugaaacaagcuggcacuacgaucaggaccauccguauaaaaccugggcguaccacggcuccuaugagacaaagcagaccgggagcgccucuuccauggugaauggagucguucggcugcucacgaaaccuugggacgugauccccauggugacacaaauggcuaugaccgauaccacaccuuucggccagcagagagucuuuaaggaaaaaguggacacgcgcacccaggagcccaaggaggggacaaagaaacugaugaagauuaccgccgaauggcuuuggaaagagcugggaaagaaaaagacaccuagaauguguacccgggaagaguucacacgcaaaguuagaagcaacgcugcccucggcgcuaucuuuaccgaugagaauaaguggaagucugcccgggaagcgguggaggacuccggguucugggaacuggucgauaaagagagaaaccugcaccucgaaggaaagugcgagacguguguguacaauaugaugggcaaacgggagaagaaacugggcgaauuugggaaggccaagggaagccgcgcuauuugguacauguggcuuggcgccagauuccuggaguuugaagcucucggguuccugaacgaggaccauugguuuucucgggaaaauucccuuagcggaguugagggcgaggggcugcacaaacucggcuauauccugcgcgauguguccaagaaagaaggaggcgccauguacgccgacgauaccgcggggugggacacaagaauuacccuggaggaucucaagaacgaagagauggucacaaaucauauggaaggagagcacaaaaagcuggcugaggccaucuucaagcuuaccuaucaaaacaaagugguucgggugcagcgccccacgccgagaggcacagucauggacaucauuagccggcgcgaccagagagggucuggacagguggucaccuacggccugaacacauuuaccaauauggaagcccaacucauccggcagauggagggggaaggcguguucaagagcauucagcaacugacgguuaaagaggagaucgcugugaagaacuggcuuauucgcgucggaagagaacggcugucccgcauggccaucucuggcgaugacugcguggugaaaccucucgaugacagauucgcuagcgcccugaccgcgcugaaugauauggggaagguucggaaggacauccagcagugggagcccuccagaggauggaacgauuggacacaggugcccuuuugcucucaucacuuccacgaacucauuaugaaagacggccgcguccuggugguuccuugucggaaucaagaugagcuuaucgggagagcccgcauuagccagggagcuggcuggucccugcgggaaaccgccugccucgggaagucuuaugcucagauguggagccugauguacuuucauagacgcgaccuucggcuggccgcgaacgccaucuguuccgcugugccgagccacuggguccccacaucuagaaccacaugguccauucaugccacccacgaguggaugacgacagaggauaugcucaccguguggaaucgcgucuggauccaggaaaacccuuggauggaggacaaaacccccguggaaagcugggaggaaaucccuuaucugggcaagcgggaggaucaauggugcggaucucugauuggccucacauccagagcuaccugggccaaaaauauccagacagcuauuaaccagguucgcagccugaucgggaaugaggaauacacggacuacaugcccuccaugaagcgguucagacgggaggaagaggaagccggagugcuuugguga

SEQ ID NO: 20238 - RNA, 9876 nt, Artificial Sequence
  derived and/or modified CDS sequence (opt5) from DENV-2__KM279605__SS-prME
accgccggaaucauuaucaugaugauucccaccgugauggcuuuccaccugacgaccagaaacggggagccucauaugaucgucucccggcaggaaaagggaaaaucccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacaacccggugaauaucgaagcugagcccccuuuuggcgauucuuacauuaucauuggggucgaacccggccagcugaagcucuccugguucaaaaagggaagcucuaucggccagauguuugagacaaccaugagaggggccaagcgcauggccauucugggagacacagcuugggauuucggcagccuugggggaguguuuaccuccaucggcaaagcccugcaucaaguguucggggcgaucuauggcgcugccuuuucuggaguuagcuggacgaugaagauucucaucggcgucgugauuacauggaucgggaugaacucccggagcaccucucuguccgugagccugguccuugugggaguugugacccucuaccugggcgucauggugcaggccgacucuggguguguuguguccuggaaaaauaaggagcugaaaugcggaagcggcauuuucaucacagauaacguccacaccuggacagaacaguauaaguuucagccugagucccccucuaagcucgcuagcgccauccaaaaagcucacgaagaggggauuuguggcaucagauccgugacgcgccuggaaaaucuuauguggaagcagauuaccccggagcugaaccauauccucacagagaaugaaguuaaacugaccauuaugacaggagacaucaagggcaucaugcaggccgggaaacggucucugagaccucagcccaccgagcuuaaguacagcuggaaagcguggggaaaggccaagaugcucuccacggaacugcacaaccauaccuuccugauugauggcccugagacagcugaaugccccaauaccaaccgcgccuggaauagccucgagguggaggacuauggguuuggagucuucacaaccaacaucuggcugaaacuuaaggaacggcaagauguguuuugugacucuaaacugauguccgcugccauuaaggacaacagagcggugcacgccgauaugggcuacuggaucgagagcgcucucaaugacacauggaaaauugaaaaggccucuuucaucgaggucaaguccugccacuggccuaaaagccauacccuguggucuaacggcguucuggagagcgaaaugaucauucccaagaauuucgcugggccggugucccagcacaacuaucgcccuggauaccauacgcagacagccggccccuggcaccuugggcggcucgagauggauuuugacuucugugaaggaaccaccguggucgugacagaggauugcggcaauagagggcccagccugcggaccacgacagccucuggaaaacugaucaccgaauggugcugucgcuccugcacacucccuccgcugagauaccggggcgaggacggcuguugguaugggauggagauuagaccccuuaaggaaaaagaggaaaaccugguuaauagccucgugaccgcuggacauggccagaucgauaacuuuucccuggggguccugggaauggcgcuuuuccucgaggaaaugcugcgcacacgggugggcaccaagcacgccauucugcucguugcugugucuuuugucacgcugaucaccgggaauaugagcuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacguccaaggagcugaugaugacaaccaucggcaucgugcuccugucucaaagcacaauucccgaguccauccuugaacugaccgaugcccucgcccuggggaugaugguccugaaaauuguucgcaacauggagaaguaucagcuugcugugaccaucauggccauucugugcgugccuaaugcggucauccucgaaaacgcuuggaaagugucuuguacaacgcuggccguugugagcgucagcccccuccugcuuaccagcucucagcaaaaggccgacuggaucccucuggcucucacaauuaagggacugaaucccaccgccaucuuucugacaacccuuuccagaacgagcaaaaagcggucuuggccgcugaacgaggcuauuauggccgugggcaugguuuccauccucgcgagcucucugcucaaaaaugauauuccuaugacagggccccugguggccggaggccuucugaccgucugcuacgugcugaccggccgcuccgcugaccucgaacuggagagagccgcugacguccggugggaggaacaggccgagaucagcggguccagcccuauccuuucuauuacaaucagcgaagauggauccaugucuauuaagaacgaggaggaagaacagacccugacaauccucauucgcacgggccugcucgugaucagcgggcuguuccccguuuccauuccgaucaccgccgcugcgugguaucuuugggaagugaaaaagcagagagccggaguccugugggacgugccuucucccccucccguuggcaaagcugagcuggaagauggggccuaccggaucaagcaaaagggcauucucggcuauagccagaucggcgccgggguguacaaagagggaacauuucacaccauguggcaugucacacgcggcgcugugcugaugcacaaggggaaaagaauugagcccuccugggccgacgugaagaaagaucuuaucucuuacggaggcggguggaagcuggaaggagaguggaaggaaggcgaggaaguucagguccucgcgcuggagccuggcaaaaacccgcgggcugugcagaccaagcccggacucuucaaaacgaauaccggaacaauuggcgccgugagccuggacuuuuccccugggaccagcggaucucccaucgucgauaagaaaggcaaggugguugggcuuuauggaaacggcguggucacaagauccggcaccuacgugagcgccaucgcucaaacagagaagucuauugaagacaauccugagaucgaagaugacauuuuccgcaaaaagcggcugacgaucauggaucugcaucccggggccggaaaaaccaagagauaucucccugcgauuguucgcgaggcuaucaaacggggccugagaacacuuauccuggccccgacccgcguggucgccgcugaaauggaggaggcccuccgggggcugcccauuagauaccagaccccugcuauccgcgccgaacacacaggacgggagauuguggaccucaugugucaugcgacguucaccaugagacugcuuucccccauccggguuccuaacuauaaucugauuaucauggaugaagcccacuuuacagaccccgcuagcauugccgcucgcggcuacaucuccaccagaguggagaugggggaggccgccggcaucuucaugacagcuaccccgccuggaucucgggaccccuuuccccagagcaacgcgccuauuauggaugaagaacgcgaaauccccgagagauccuggaauagcggccacgaaugggucacggacuucaaggggaagacagugugguuugugccuucuauuaaagccggaaacgauaucgcugccugccugcggaagaauggcaaaaaggucauucagcucuccagaaaaaccuucgacagcgaguauaucaagacccgcacaaacgauugggacuuuguugugaccacagauaucucugagaugggggccaauuucaaggcugaacgggugauugacccgagacgcuguaugaaacccgucauccugaccgauggagaggaacgggugauucuugccggcccuaugcccguuacgcauagcuccgcggcucaaagacgcgggcgggugggcagaaacccuaagaaugagaacgaccaguacaucuacaugggagaaccccuggagaaugaugaggacugcgcccacuggaaagaagccaagaugcuccuggacaacauuaacacaccggagggcaucaucccuucuauguuugaacccgagcgcgaaaaagucgaugcuauugacggggaguauagacugcggggagaggcccgcaagaccuucguggaucucaugagacggggcgaccuuccuguuuggcuggcguacaaaguggccgcugaagggaucaauuaugccgaucgcagaugguguuuugacggagucaagaacaaucagauucuggaggaaaacguggaggucgagaucuggacaaaggaaggcgagcggaaaaagcucaaacccagauggcuggaugcucgcauuuacagcgacccucuugcccugaaggaguucaaagaguucgcugccgggcggaagucccucacccugaaucugaucacggaaaugggcagacuccccaccuuuaugacacaaaaggcgaaaaacgcccuugauaaucuggcugugcugcauaccgccgaggcuggaggccgcgccuauaaccacgcccucucugagcugccggaaacacuugagacccugcuccugcugacacuccuugcuaccguuacaggcgggauuuuccuguuucugaugagcgggaaggggaucggaaaaaugacacucggcaugugcugcaucauuaccgcguccauccugcuuugguacgcccagauucagccucacuggaucgcugccagcauuauccuggaguucuuucucaucgugcugcugauucccgagcccgaaaagcagcggaccccucaagacaaucagcucacauauguggucaucgccauucuuaccguuguggcugccacaauggcgaacgagaugggcuuccuggagaaaacgaagaaggauuuugggcugggaucuaucaccacacagcagccggaauccaauauucucgacaucgaucugagacccgccagcgcuuggacccuuuacgccguggcuacaaccuucaucacgccuaugcugcggcauuccauugagaacucuagcgucaaugugucccucaccgccaucgcgaaccaagccacaguucugaugggccuggggaaaggauggccccucucuaagauggacauuggcgugccucuucuggcuaucggguguuacagccaggucaaucccauuacccugacagccgcucuccugcuucugguggcccacuaugcuaucauuggaccuggccuccaggccaaagcgacccgcgaagcccagaagagagcugccgcuggcaucaugaaaaacccgacggucgacgggaucacagugauugaucuggaccccaucccuuacgaucccaaguuugagaagcaacugggacagguuaugcuccuugugcugugcgucacccaggugcugaugaugcggacaaccugggcccucugugaagcccugacccuugcgacaggcccuauuuccacgcugugggaggggaaucccggacgcuucuggaacaccacaaucgcuguuagcauggccaacauuuuuagaggcucuuaucucgcuggggccggacugcuguucuccaucaugaaaaauaccgccaacacacggcgcggcaccggcaauacgggggagacacucggagaaaaguggaaaaacagacuuaaugcucugggcaagagcgaguuucagaucuacaaaaagucugggauucaagaaguggaccggacccuggccaaagagggaaucaagcgcggcgagaccgaucaucacgcggucuccagagggagcgccaagcuccggugguucguggaaagaaaccuggugacaccggagggaaaaguugucgaccuuggcugcggccgcgggggauggucuuauuacuguggcgggcugaagaaugugaaagaagugaagggacucaccaaaggcgggccuggacaugaggaacccauucccaugagcacauauggcuggaaccugguccggcugcaguccggcguugauguguucuuuacgccucccgagaagugcgacacccuccuuugugauaucggggagucuagcccuaauccgacaguggaagcuggaagaacccugcgcguccugaaccucguggagaauuggcugaacaauaacacacaguucugcauuaagguucuuaaucccuacaugccuuccgugaucgagaaaauggaggcccugcaacggaaguacggcggggcucucgucagaaacccccugagccgcaacuccacccacgaaauguauugggugucuaaugccagcggaaacaucguuuccucugugaauaugauuagccggaugcugaucaacagauuuacgaugcgccacaaaaaggcgaccuacgagccugacgucgaucucggcuccgggacacggaauauuggaaucgagucugaaacccccaaccuugacauuaucggcaaaagaaucgagaagauuaagcaggaacaugagacaagcuggcacuaugaucaggaccauccguacaaaaccugggccuaucacggcuccuacgaaacaaagcagaccgggagcgcuucuuccauggugaauggagugguccgccugcugacgaaaccuugggacguuauccccauggugacacaaauggccaugaccgauaccacaccuuucggccagcagcggguguuuaaggagaaagucgacacgagaacccaggagcccaaggaagggacaaagaaacucaugaagauuaccgcugaguggcuguggaaagaacuuggaaagaaaaagacaccucgcauguguaccagagaggaguucacacggaaagugcgcagcaacgccgcucugggcgccaucuuuaccgaugaaaauaaguggaagucugcgagagaggccguugaagacuccggguucugggagcucguggauaaagaacggaaccugcaccuggagggaaagugcgagacgugugucuauaauaugaugggcaaaagagaaaagaaacucggcgaguuugggaaggcuaagggaagccgggccauuugguacauguggcugggcgcucgcuuccuugaauuugaggcccugggguuccucaacgaagaccauugguuuucuagagaaaauucccugagcggaguggagggcgaagggcuucacaaacugggcuacauccuccgggauguuuccaagaaagagggaggcgccauguaugcggacgauaccgcugggugggacacacgcauuacccuggaagaucugaagaacgaggaaauggugacaaaucauauggagggagagcacaaaaagcucgccgaagccaucuucaagcugaccuaccaaaacaaagucgugagaguucagcggcccacgccgcgcggcacagugauggacaucauuagcagacgggaccagcgcgggucuggacaggucgugaccuauggccuuaacacauucaccaauauggaggcucaacugaucagacagauggaaggggagggcgucuuuaagagcauucagcaacucacggugaaagaggaaaucgccguuaagaacuggcugauucgggugggacgcgagagacuuucccggauggcuaucucuggcgaugacugcgucgugaaaccucuggaugaccgcuucgccagcgcgcucaccgcccugaaugauauggggaaggugagaaaggacauccagcagugggaacccucccggggauggaacgauuggacacagguucccuuuugcucucaucacuuccacgagcugauuaugaaagacggcagagugcucgucgugccuugucgcaaucaagaugaacugaucgggcgggcuagaauuagccagggagccggcuggucccuucgcgagaccgcuugccuggggaagucuuacgcccagauguggagccucauguauuuucaucggagagaccugcgccuugcggccaacgcuaucuguuccgccguuccgagccacugggugcccacaucucggaccacaugguccauucaugcuacccacgaguggaugacgacagaagauaugcugaccgucuggaauagaguguggauccaggagaacccuuggauggaagacaaaacccccgucgagagcugggaagagaucccuuaccucggcaagcgcgaggaucaauggugcggaucucugauuggccugacaucccgggccaccugggcuaaaaauauccagacagccauuaaccaggugagaagccucaucgggaaugaagaguauacggacuacaugcccuccaugaagcgcuuccggagagaagaggaagaggcgggaguucugugguga

SEQ ID NO: 20239 - RNA, 9876 nt, Artificial Sequence
  derived and/or modified CDS sequence (opt5) from DENV-2__KM279609__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccacgagugggucacggacuucaaggggaagacagugugguuugugcccuccauuaaagccggaaaugauaucgcugccugccuccggaagaacggcaaaaaggucauucaacugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcauuccucugcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugccgauagacggugguguuuugacggagucaaaaauaaccaaauucucgaagagaauguggaagucgagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacagaaggcgaagaaugcccuggauaaccuggcugugcuccauaccgccgaagcuggaggccgggccuauaaucacgcccugagcgagcuucccgagacacuggaaacccuccugcugcucacacuucuggcuaccguuacagggggaauuuuccuguuucucauguccggcaaagggaucggaaagaugacacugggcaugugcugcaucauuaccgcgagcauccuucugugguacgcccagauucagccgcacuggaucgcugccucuauuauccucgaguucuuucugaucgugcugcucauuccugaacccgagaaacaaagaacaccccaggacaaccagcuuacauauguggucaucgccauucugaccguuguggcugccacaauggcgaaugaaaugggcuuccuggagaagacgaaaaaggauuuugggcucggauccaucaccacacagcaaccugagagcaacauucuggacaucgaucuucggccggccuccgcuuggacccuguacgccguggcuacaaccuucaucacgcccaugcuccgccauucuauugaaaauagcuccgucaacgugucucugaccgccaucgcgaaucaggccacaguucugaugggccucgggaagggauggccucuuagcaaaauggacauuggcgugccccugcuggcuaucggguguuacucccaggucaacccuauuacccucacagccgcucugcuucugcucguggcccacuaugcuaucauuggacccggccugcaggccaaggcgaccagagaggcccaaaaacgggcugccgcuggcaucaugaagaauccuacggucgacgggaugacagugaucgaucuggacccgauucccuacgauccuaaauuugaaaagcagcucggacagguuaugcuucuggugcugugcgucacccaggugcucaugaugcgcacaaccugggcccugugugaggcccuuacccuggcgacaggccccaucagcacgcucugggaagggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucaaaucuacaagaaauccgggauccaggagguggaccgcacccucgccaaggaaggaauuaaaagaggcgagaccgaucaucacgcggucagccgggggucugccaagcugagaugguucguggagcgcaaucuugugacacccgaaggaaagguugucgaccugggcugcggcagagggggauggagcuauuacuguggcgggcucaaaaacgugaaggaggugaaaggacugaccaagggcgggccgggacaugaagaaccuauccccauguccacauauggcuggaaucuggucagacuccagucuggcguugauguguucuuuacgcccccugaaaaaugcgacacccuucugugugauauuggggagagcucccccaacccuacaguggaggcuggacgcacccugcggguccucaaucugguggaaaacuggcuuaauaacaauacacaauucugcaucaagguucugaacccguacaugcccagcgugauugagaagauggaagcccuccagagaaaauacggcggggcucugguccgcaauccucugucccggaacucuacccacgagauguauugggugagcaacgccuccggaaauaucguuucuagcgugaacaugaucuccagaaugcucauuaaucgcuuuacgaugcggcacaagaaagcgaccuacgaacccgacgucgaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggccuaucacggcagcuacgagacaaaacaaaccgggucugcuuccagcauggugaacggagugguccggcugcucacgaagccgugggacguuauuccuauggugacacagauggccaugaccgauaccacacccuucggccagcagagaguguuuaaagaaaaggucgacacgcgcacccaagagccuaaagaggggacaaagaagcugaugaaaaucaccgcugaauggcuuuggaaggagcugggcaaaaagaaaacacccagaauguguacccgggaagaguucacacgcaaggugagaucuaaugccgcucucggcgccauuuuuaccgaugagaacaaauggaaguccgcgcgggaagccguugaggacagcggguucugggaacugguggauaaggagagaaaucugcaccucgaaggaaaaugcgagacgugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggaguggagggcgaggggcugcacaagcucggcuacauucugcgcgauguuagcaaaaaggaaggaggcgccauguaugcggacgauaccgcugggugggacacaagaaucacccuggaggaucucaaaaaugaagagauggugacaaaccauauggaaggagagcacaagaaacuggccgaggccauuuucaaacuuaccuaccagaauaaggucgugcggguucagcgcccuacgcccagaggcacagugauggacaucaucucucggcgcgaccagagagggagcggacaagucgugaccuauggccugaacacauucaccaacauggaagcucagcucauucggcagauggagggggaaggcgucuuuaaauccauccaacagcugacggugaaggaggagauugccguuaaaaauuggcuuauccgcgugggaagagaacggcugucucgcauggcuauuagcggcgaugacugcgucgugaagccgcucgaugacagauucgccuccgcgcugaccgcccugaacgauauggggaaagugcggaaggacauccagcagugggagccuucuagaggauggaaugauuggacacaaguucccuuuugcagccaucacuuccacgaacucaucaugaaggacggccgcgugcuggucgugcccugucggaaccaggaugagcuuauugggagagcucgcaucucccagggagccggcuggucucugcgggaaaccgcuugccucgggaaaagcuacgcccagauguggucccugauguauuuucauagacgcgaccuucggcuggcggccaaugcuauuuguagcgccguuccuucucacuggaucccgacauccagaaccacauggagcauucaugcuacccacgaguggaugacgacagaggauaugcucaccguguggaaccgcgucuggauccaagaaaaucccuggauggaggacaagaccccuguggaaucuugggaggaaauccccuaccugggcaaacgggaggaucaguggugcggaucccugauuggccucacaagcagagccaccugggcuaagaacauccagacagccauuaaucagguccgcucccugaucgggaacgaggaauauacggacuacaugccuucuaugaaacgguucagacgggaggaagaggaagcgggagugcuuugguga

SEQ ID NO: 20240 - RNA, 9876 nt, Artificial Sequence
  derived and/or modified CDS sequence (opt5) from DENV-2__KM279607__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuaucuccagagaguucugauuuuuauccuucugacagccgugacgccuuccauggcgaugcggugcauuggaaucucuaaccgcgacuucgucgaaggcgugagcgggggauccuggguugauaucgugcucgagcacggcagcugugucaccacaauggccaaaaauaagcccacccuggacuuugaacuuauuaagacagaggcuaaacacccugccacccugagaaaguacugcguggaagcuaaacucacgaacacaaccaccgccucucgguguccgacacagggggagcccucccugaaugaggaacaagauaagcgcuucgugugcaaacauagcauggucgacagaggauggggcaacggcugugggcuguuuggaaagggcgggaucguuaccugcgcgauguucacaugcaagaaaaauauggagggaaagguggugcagccugaaaaccucgaguauacgauugucaucaccccccacucuggcgaagagaaugccguggggaacgauacaggaaaacauggcaaggagauuaaaguuaccccucaguccagcaucacagaagcugagcugaccggcuacgggacggugaccauggaauguucuccccggacaggacuugacuuuaaugagaugguccugcuccagauggaaaacaaggccuggcuggugcaccgccaaugguuccuugaucugccgcucccuuggcugcccggcgcugacacccagggguccaacuggauccagaaagagacacugguuaccuuuaagaauccucacgccaagaaacaggauguggucgugcucggaagccaagagggcgccaugcauacggcucugacaggggcgaccgaaauucagauguccucuggcaaccuucuguucacaggacaccucaagugcagacugcggauggacaaacuucagcugaagggcaugagcuauuccauguguaccgggaaauuuaaggucgugaaggagaucgccgaaacccaacauggaacaauuguuaucagagugcaguacgagggcgacgggagccccugcaaaauucccuucgagaucauggaucucgaaaagcgccacguccugggacggcugaucacggugaauccuauuguuaccgagaaagacaacccggugaauaucgaagcugagcccccuuucggcgauucuuacauuaucauuggggucgaacccggccagcucaagcuguccugguauaaaaagggaagcucuaucggccagauguuugagacaaccaugagaggggccaagcgcauggccauucuuggagacacagcuugggauuucggcagccuggggggaguguuuaccuccaucggcaaagcccuccaucaaguguucggggcgaucuacggcgcugccuuuucuggaguuagcuggacgaugaagauucugaucggcgucgugauuacauggaucgggaugaacucccggagcaccucucuguccgugagccuuguccucgugggaguugugacccuguaucugggcgucauggugcaggccgacucuggguguguuguguccuggaaaaauaaggagcucaaaugcggaagcggcauuuucaucacagauaacguccacaccuggacagaacaguacaaguuucagccugagucccccucuaagcuggcuagcgccauccaaaaagcucacgaagaggggauuuguggcaucagauccgugacgcgccuugaaaaucugauguggaagcagauuaccccggagcucaaccauauccugacagagaaugaaguuaaacugaccauuaugacaggagacaucaagggcaucaugcaggccgggaaacggucucuuagaccucagcccaccgagcucaaguauagcuggaaagcguggggaaaggccaagaugcuguccacggaacugcacaaccauaccuuccucauugauggcccugagacagcugaaugccccaauaccaaccgcgccuggaauagccuggagguggaggacuacggguuuggagucuucacaaccaacaucuggcuuaaacugaaggaacggcaagauguguuuugugacucuaaacucauguccgcugccauuaaggacaacagagcggugcacgccgauaugggcuauuggaucgagagcgcucugaaugacacauggaaaauugaaaaggccucuuucaucgaggucaaguccugccacuggccuaaaagccauacccuguggucuaacggcguucuugagagcgaaaugaucauucccaagaauuuugcugggccggugucccagcacaacuaccgcccuggauaccauacgcagacagccggccccuggcaccucgggcggcuggagauggauuucgacuucugugaaggaaccaccguggucgugacagaggauugcggcaauagagggcccagccugcggaccacgacagccucuggaaaacucaucaccgaauggugcugucgcuccugcacacugccuccgcuuagauaucggggcgaggacggcuguugguacgggauggagauuagaccccugaaggaaaaagaggaaaaccucguuaauagccuggugaccgcuggacauggccagaucgauaacuuuucccuggggguccuuggaauggcgcucuuccuggaggaaaugcugcgcacacgggugggcaccaagcacgccauucuccugguugcugugucuuuugucacgcuuaucaccgggaauaugagcuucagagaccugggacgcgugaugguuauggugggcgccacaaugaccgaugacauuggcaugggggucacauaucucgcccugcuggcugccuuuaaggugagaccuaccuucgcggcuggacuucugcuccggaaacugacguccaaggagcucaugaugacaaccaucggcaucgugcugcuuucucaaagcacaauucccgaguccauccuggaacucaccgaugcccuggcccuggggaugaugguccuuaaaauuguucgcaacauggagaaguaccagcuggcugugaccaucauggccauucucugcgugccuaaugcggucauccuggaaaacgcuuggaaagugucuuguacaacgcucgccguugugagcgucuccccccugcuucugaccagcucucagcaaaaggccgacuggaucccucucgcucugacaauuaagggacugaaucccaccgccaucuuucuuacaacccuguccagaacgagcaaaaagcggucuuggccgcucaacgaggcuauuauggccgugggcaugguuuccauccuggcgagcucucuccugaaaaaugauauuccuaugacagggccccuuguggccggaggccugcugaccgucugcuaugugcucaccggccgcuccgcugaccuggaacuugagagagccgcugacguccggugggaggaacaggccgagaucagcggguccagcccuauccugucuauuacaaucagcgaagauggauccaugucuauuaagaacgaggaggaagagcagacccucacaauccugauucgcacgggccuccuggugaucagcgggcuuuuccccguuuccauuccgaucaccgccgcugcgugguaccugugggaagugaaaaagcagagagccggaguccugugggacgugccuucucccccucccguuggcaaagcugagcucgaagauggggccuaucggaucaagcaaaagggaauucugggcuacagccagaucggcgccgggguguacaaagagggaacauuucacaccauguggcaugucacacgcggcgcugugcuuaugcacaaggggaaaagaauugagcccuccugggccgacgugaagaaagaucugaucucuuauggaggcggguggaagcucgaaggagaguggaaggaaggcgaggaaguucagguccuggcgcucgagccuggcaaaaacccgcgggcugugcagaccaagcccgggcuguucaaaacgaauaccggaacaauuggcgccgugagccuugacuuuuccccugggaccagcggaucucccaucgucgauaagaaaggcaaggugguugggcuguacggaaacggcguggucacaagauccggcaccuaugugagcgccaucgcucaaacagagaagucuauugaagacaauccugagaucgaagaugacauuuuccgcaaaaagcggcugacgaucauggaucuccaucccggggccggaaaaaccaagagauaccugccugcgauuguucgcgaggcuaucaaacggggccuuagaacacugauccucgccccgacccgcguggucgccgcugaaauggaggaggcccugcgggggcuccccauuagauaucagaccccugcuauccgcgccgaacacacaggacgggagauuguggaccugaugugucaugcgacguuuaccaugagacuucugucccccauccggguuccuaacuacaaucugauuaucauggaugaagcccacuucacagaccccgcuagcauugccgcucgcggcuauaucuccaccagaguggagaugggggaggccgccggcaucuucaugacagcuaccccgccuggaucucgggaccccuuuccccagagcaacgcgccuauuauggaugaagagcgcgaaauccccgagagauccuggaauagcggccacgaaugggucacggacuucaaggggaagacagugugguuugugccuucuauuaaagccggaaacgauaucgcugccugccuccggaagaauggcaaaaaggucauucagcuguccagaaaaaccuucgacagcgaguacaucaagacccgcacaaacgauugggacuuuguugugaccacagauaucucugagaugggggccaauuucaaggcugaacgggugauugacccgagacgcuguaugaaacccgucauccuuaccgauggagaggaacgggugauucuggccggcccuaugcccguuacgcauagcuccgcggcucaaagacgcgggcgggugggcagaaacccuaagaaugagaacgaccaguacaucuauaugggagaaccccucgagaaugaugaggacugcgcccacuggaaagaagccaagaugcugcuggacaacauuaacacaccggagggcaucaucccuucuauguuugaacccgagcgcgaaaaagucgaugcuauugacggggaguacagacuccggggagaggcccgcaagaccuucguggaucuuaugagacggggcgaccugccuguuuggcuggcguauaaaguggccgcugaagggaucaauuacgccgaucgcagaugguguuuugacggagucaagaacaaucagauucucgaggaaaacguggaggucgagaucuggacaaaggaaggcgagcggaaaaagcugaaacccagauggcuugaugcucgcauuuauagcgacccucuggcccucaaggaauucaaagaguuugcugccgggcggaagucccugacccugaaucucaucacggaaaugggcagacuucccaccuucaugacacaaaaggcgaaaaacgcccuggauaaucuggcugugcuccauaccgccgaggcuggaggccgcgccuacaaccacgcccugucugagcuuccggaaacacuggagacccuccugcugcucacacuucuggcuaccguuacggggggaauuuuccuguuucucaugagcggcaaggggaucggaaaaaugacacugggcaugugcugcaucauuaccgcguccauccuucugugguaugcccagauucagccucacuggaucgcugccagcauuauccucgaauucuuucugaucgugcugcucauucccgagcccgaaaagcagcggaccccucaagacaaucagcuuacauacguggucaucgccauucugaccguuguggcugccacaauggcgaacgagaugggcuuccuggagaaaacgaagaaggauuuugggcucggaucuaucaccacacagcagccggaauccaauauucuggacaucgaucuuagacccgccagcgcuuggacccuguacgccguggcuacaaccuucaucacgccuaugcuccggcauuccauugagaacucuagcgucaaugugucccugaccgccaucgcgaaccaagccacaguucugaugggccucgggaaaggauggccccuuucuaagauggacauuggcgugccucugcuggcuaucggguguuauagccaggucaaucccauuacccucacagccgcucugcuucugcucguggcccacuacgcuaucauuggaccuggccugcaggccaaagcgacccgcgaagcccagaagagagcugccgcuggcaucaugaaaaacccgacggucgacgggaucacagugauugaucuggaccccaucccuuaugaucccaaguuugagaagcaacucggacagguuaugcuucuggugcugugcgucacccaggugcucaugaugcggacaaccugggcccugugugaagcccuuacccuggcgacaggcccuauuuccacgcucugggaggggaaucccggacgcuucuggaacaccacaaucgcuguuagcauggccaacauuuuuagaggcucuuaccuggcuggggccggacugcucuucuccaucaugaaaaauaccgccaacacacggcgcggcaccggcaauacgggggagacacuuggagaaaaguggaaaaacagacugaaugcucugggcaagagcgaguuucagaucuauaaaaagucugggauucaagaaguggaccggacccucgccaaagagggaaucaagcgcggcgagaccgaucaucacgcggucuccagagggagcgccaagcugcggugguucguggaaagaaaccuugugacaccggagggaaaaguugucgaccugggcugcggccgcgggggauggucuuacuauuguggcgggcucaagaaugugaaagaagugaagggacugaccaaaggcgggccuggacaugaggaacccauucccaugagcacauacggcuggaaccugguccggcuccaguccggcguugauguguuuuucacgccucccgagaagugcgacacccuucugugugauaucggggagucuagcccuaauccgacaguggaagcuggaagaacccugcgcguccucaaccugguggagaauuggcuuaacaauaacacacaguucugcauuaagguucugaaucccuacaugccuuccgugaucgaaaaaauggaggcccuccaacggaaguauggcggggcucuggucagaaacccccugagccgcaacuccacccacgaaauguacugggugucuaaugccagcggaaacaucguuuccucugugaauaugauuagccggaugcucaucaacagauuuacgaugcgccacaaaaaggcgaccuaugagccugacgucgaucuuggcuccgggacacggaauauuggaaucgagucugaaacccccaaccuggacauuaucggcaaaagaaucgagaagauuaagcaggaacaugagacaagcuggcacuacgaucaggaccauccguauaaaaccugggccuaccacggcuccuaugaaacaaagcagaccgggagcgcuucuuccauggugaauggaguggucaaacugcucacgaagccuugggacguuauccccauggugacacaaauggccaugaccgauaccacaccuuucggccagcagcgcguguuuaaagagaaggucgacacgcggacccaggagcccaaggaagggacaaaaaagcugaugaaaauuaccgcugaguggcuuuggaaggaacugggaaaaaagaaaacaccuagaauguguacccgcgaggaguucacaagaaaggugcggagcaacgccgcucucggcgccaucuuuaccgaugaaaauaaguggaaaucugcgcgcgaggccguugaagacuccggguucugggagcugguggauaaggaaagaaaccugcaccucgagggaaaaugcgagacgugugucuacaauaugaugggcaagcgggaaaaaaagcugggcgaguuugggaaggcuaaaggaagcagagccauuugguacauguggcuuggcgcucgguuccuggaauuugaggcccucggguuccugaacgaagaccauugguuuucucgcgagaauucccuuagcggaguggagggcgaagggcugcacaagcucggcuauauccugagagauguuuccaaaaaggagggaggcgccauguacgcggacgauaccgcugggugggacacacggauuacccuggaagaucucaaaaacgaggaaauggugacaaaucauauggagggagagcacaagaagcuggccgaagccaucuucaaacuuaccuaucaaaacaaggucgugcgcguucagagacccacgccgcggggcacagugauggacaucauuagccgcagagaccagcgggggucuggacaggucgugaccuacggccugaacacauuuaccaauauggaggcucaacucauccgccagauggaaggggagggcgucuucaaaagcauucagcaacugacggugaaggaggaaaucgccguuaaaaacuggcuuauuagagugggacgggagcgccuguccagaauggcuaucucuggcgaugacugcgucgugaagccucucgaugaccgguucgccagcgcgcugaccgcccugaaugauauggggaaggugcgcaaagacauccagcagugggaacccuccagaggauggaacgauuggacacagguucccuuuugcucucaucacuuccacgagcucauuaugaaggacggccgggugcuggucgugccuuguagaaaucaagaugaacuuaucgggcgcgcucggauuagccagggagccggcuggucccugagagagaccgcuugccucgggaaaucuuaugcccagauguggagccugauguacuuucaucgccgggaccuuagacuggcggccaacgcuaucuguuccgccguuccgagccacugggugcccacaucucgcaccacaugguccauucaugcuacccacgaguggaugacgacagaagauaugcucaccgucuggaaucggguguggauccaggagaacccuuggauggaagacaagacccccgucgagagcugggaagagaucccuuaucugggcaaaagagaggaucaauggugcggaucucugauuggccucacaucccgcgccaccugggcuaagaauauccagacagccauuaaccaggugcggagccugaucgggaaugaagaguacacggacuacaugcccuccaugaagagauuccgccgggaagaggaagaggcgggaguucuuugguga

SEQ ID NO: 20241 - RNA, 9876 nt, Artificial Sequence
  derived and/or modified CDS sequence (opt5) from DENV-2__KM279606__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucaccccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacaacccggugaauaucgaagcugagcccccuuuuggcgauucuuacauuaucauuggggucgaacccggccagcugaagcucuccugguauaaaaagggaagcucuaucggccagauguucgagacaaccaugagaggggccaagcgcauggccauucugggagacacagcuugggauuuuggcagccuugggggaguguucaccuccaucggcaaagcccugcaucaaguguuuggggcgaucuacggcgcugccuucucuggaguuagcuggacgaugaagauucucaucggcgucgugauuacauggaucgggaugaacucccggagcaccucucuguccgugagccugguccuugugggaguugugacccucuaucugggcgucauggugcaggccgacucuggguguguuguguccuggaaaaauaaggagcugaaaugcggaagcggcauuuuuaucacagauaacguccacaccuggacagaacaguacaaguuccagccugagucccccucuaagcucgcuagcgccauccaaaaagcucacgaagaggggauuuguggcaucagauccgugacgcgccuggaaaaucuuauguggaagcagauuaccccggagcugaaccauauccucacagagaaugaaguuaaacugaccauuaugacaggagacaucaagggcaucaugcaggccgggaaacggucucugagaccucagcccaccgagcuuaaguauagcuggaaagcguggggaaaggccaagaugcucuccacggaacugcacaaccauaccuuucugauugauggcccugagacagcugaaugccccaauaccaaccgcgccuggaauagccucgagguggaggacuacggguucggagucuuuacaaccaacaucuggcugaaacuuaaggaacggcaagauguguucugugacucuaaacugauguccgcugccauuaaggacaacagagcggugcacgccgauaugggcuauuggaucgagagcgcucucaaugacacauggaaaauugaaaaggccucuuuuaucgaggucaaguccugccacuggccuaaaagccauacccuguggucuaacggcguucuggagagcgaaaugaucauucccaagaauuucgcugggccggugucccagcacaacuaccgcccuggauaccauacgcagacagccggccccuggcaccuugggcggcucgagauggauuucgacuuuugugaaggaaccaccguggucgugacagaggauugcggcaauagagggcccagccugcggaccacgacagccucuggaaaacugaucaccgaauggugcugucgcuccugcacacucccuccgcugagauaucggggcgaggacggcuguugguacgggauggagauuagaccccuuaaggaaaaagaggaaaaccugguuaauagccucgugaccgcuggacauggccagaucgauaacuucucccuggggguccugggaauggcgcuuuuucucgaggaaaugcugcgcacacgggugggcaccaagcacgccauucugcucguugcugugucuuucgucacgcugaucaccgggaauaugagcuuuagagaccuuggacgcgugaugguuauggugggcgccacaaugaccgaugacauuggcaugggggucacauaucuggcccuccuggcugccuucaaggugagaccuaccuuugcggcuggacugcuucugcggaaacucacguccaaggagcugaugaugacaaccaucggcaucgugcuccugucucaaagcacaauucccgaguccauccuugaacugaccgaugcccucgcccuggggaugaugguccugaaaauuguucgcaacauggagaaguaccagcuugcugugaccaucauggccauucugugcgugccuaaugcggucauccucgaaaacgcuuggaaagugucuuguacaacgcuggccguugugagcgucuccccccuccugcuuaccagcucucagcaaaaggccgacuggaucccucuggcucucacaauuaagggacugaaucccaccgccaucuuccugacaacccuuuccagaacgagcaaaaagcggucuuggccgcugaacgaggcuauuauggccgugggcaugguuuccauccucgcgagcucucugcucaaaaaugauauuccuaugacagggccccugguggccggaggccuucugaccgucugcuaugugcugaccggccgcuccgcugaccucgaacuggagagagccgcugacguccggugggaggaacaggccgagaucagcggguccagcccuauccuuucuauuacaaucagcgaagauggauccaugucuauuaagaacgaggaggaagagcagacccugacaauccucauucgcacgggccugcucgugaucagcgggcuguuucccguuuccauuccgaucaccgccgcugcgugguaccuuugggaagugaaaaagcagagagccggaguccugugggacgugccuucucccccucccguuggcaaagcugagcuggaagauggggccuaucggaucaagcaaaagggaauucucggcuacagccagaucggcgccgggguguacaaagagggaacauuccacaccauguggcaugucacacgcggcgcugugcugaugcacaaggggaaaagaauugagcccuccugggccgacgugaagaaagaucuuaucucuuauggaggcggguggaagcuggaaggagaguggaaggaaggcgaggaaguucagguccucgcgcuggagccuggcaaaaacccgcgggcugugcagaccaagcccgggcucuuuaaaacgaauaccggaacaauuggcgccgugagccuggacuucuccccugggaccagcggaucucccaucgucgauaagaaaggcaaggugguugggcuuuacggaaacggcguggucacaagauccggcaccuaugugagcgccaucgcucaaacagagaagucuauugaagacaauccugagaucgaagaugacauuuuucgcaaaaagcggcugacgaucauggaucugcaucccggggccggaaaaaccaagagauaccucccugcgauuguucgcgaggcuaucaaacggggccugagaacacuuauccuggccccgacccgcguggucgccgcugaaauggaggaggcccuccgggggcugcccauuagauaucagaccccugcuauccgcgccgaacacacaggacgggagauuguggaccucaugugucaugcgacguucaccaugagacugcuuucccccauccggguuccuaacuacaaucugauuaucauggaugaagcccacuucacagaccccgcuagcauugccgcucgcggcuauaucuccaccagaguggagaugggggaggccgccggcaucuuuaugacagcuaccccgccuggaucucgggaccccuucccccagagcaacgcgccuauuauggaugaagagcgcgaaauccccgagagauccuggaauagcggccacgaaugggucacggacuuuaaggggaagacagugugguucgugccuucuauuaaagccggaaacgauaucgcugccugccugcggaagaauggcaaaaaggucauucagcucuccagaaaaaccuuugacagcgaguacaucaagacccgcacaaacgauugggacuucguugugaccacagauaucucugagaugggggccaauuuuaaggcugaacgggugauugacccgagacgcuguaugaaacccgucauccugaccgauggagaggaacgggugauucuugccggcccuaugcccguuacgcauagcuccgcggcucaaagacgcgggcgggugggcagaaacccuaagaaugagaacgaccaguacaucuauaugggagaaccccuggagaaugaugaggacugcgcccacuggaaagaagccaagaugcuccuggacaacauuaacacaccggagggcaucaucccuucuauguucgaacccgagcgcgaaaaagucgaugcuauugacggggaguacagacugcggggagaggcccgcaagaccuuuguggaucucaugagacggggcgaccuuccuguuuggcuggcguauaaaguggccgcugaagggaucaauuacgccgaucgcagaugguguuucgacggagucaagaacaaucagauucuggaggaaaacguggaggucgagaucuggacaaaggaaggcgagcggaaaaagcucaaacccagauggcuggaugcucgcauuuauagcgacccucuugcccugaaggaauuuaaagaguucgcugccgggcggaagucccucacccugaaucugaucacggaaaugggcagacuccccaccuucaugacacaaaaggcgaaaaacgcccuugauaaucuggcugugcugcauaccgccgaggcuggaggccgcgccuacaaccacgcccucucugagcugccggaaacacuugagacccugcuccugcugacacuccuugcuaccguuacggggggaauuuuucuguuccugaugagcggcaaggggaucggaaaaaugacacucggcaugugcugcaucauuaccgcguccauccugcuuugguaugcccagauucagccucacuggaucgcugccagcauuauccuggaauuuuuccucaucgugcugcugauucccgagcccgaaaagcagcggaccccucaagacaaucagcucacauacguggucaucgccauucuuaccguuguggcugccacaauggcgaacgagaugggcuuucuggagaaaacgaagaaggauuucgggcugggaucuaucaccacacagcagccggaauccaauauucucgacaucgaucugagacccgccagcgcuuggacccuuuacgccguggcuacaaccuuuaucacgccuaugcugcggcauuccauugagaacucuagcgucaaugugucccucaccgccaucgcgaaccaagccacaguucugaugggccuggggaaaggauggccccucucuaagauggacauuggcgugccucuucuggcuaucggguguuauagccaggucaaucccauuacccugacagccgcucuccugcuucugguggcccacuacgcuaucauuggaccuggccuccaggccaaagcgacccgcgaagcccagaagagagcugccgcuggcaucaugaaaaacccgacggucgacgggaucacagugauugaucuggaccccaucccuuaugaucccaaguucgagaagcaacugggacagguuaugcuccuugugcugugcgucacccaggugcugaugaugcggacaaccugggcccucugugaagcccugacccuugcgacaggcccuauuuccacgcugugggaggggaaucccggacgcuuuuggaacaccacaaucgcuguuagcauggccaacauuuucagaggcucuuaccucgcuggggccggacugcuguuuuccaucaugaaaaauaccgccaacacacggcgcggcaccggcaauacgggggagacacucggagaaaaguggaaaaacagacuuaaugcucugggcaagagcgaguuccagaucuauaaaaagucugggauucaagaaguggaccggacccuggccaaagagggaaucaagcgcggcgagaccgaucaucacgcggucuccagagggagcgccaagcuccggugguuuguggaaagaaaccuggugacaccggagggaaaaguugucgaccuuggcugcggccgcgggggauggucuuacuauuguggcgggcugaagaaugugaaagaagugaagggacucaccaaaggcgggccuggacaugaggaacccauucccaugagcacauacggcuggaaccugguccggcugcaguccggcguugauguguucuucacgccucccgagaagugcgacacccuccuuugugauaucggggagucuagcccuaauccgacaguggaagcuggaagaacccugcgcguccugaaccucgccgagaauuggcugaacaauaacacacaguuuugcauuaaggugcuuaaucccuacaugccuuccguuaucgaaaaaauggaggcucugcaacggaaguauggcggggcccucgugagaaacccccugagccgcaacuccacccacgaaauguacugggucucuaaugcgagcggaaacaucguguccucuguuaauaugauuagccggaugcugaucaacagauucacgaugcgccacaaaaaggccaccuaugagccugacguggaucucggcuccgggacacggaauauuggaaucgagucugaaacccccaaccuugacauuaucggcaaaagaaucgagaagauuaagcaggaacaugagacaagcuggcacuacgaucaggaccauccguauaaaaccugggcuuaccacggcuccuaugaaacaaagcagaccgggagcgccucuuccauggucaauggaguggugcgccugcugacgaaaccuugggacgucauccccaugguuacacaaauggcuaugaccgauaccacaccuuuuggccagcagcggguguucaaggagaaaguggacacgagaacccaggagcccaaggaagggacaaagaaacucaugaagauuaccgccgaguggcuguggaaagaacuuggaaagaaaaagacaccucgcauguguaccagagaggaguuuacacggaaaguccgcagcaacgcugcccugggcgcgaucuucaccgaugaaaauaaguggaagucugccagagaggcuguggaagacuccggguuuugggagcucguugauaaagaacggaaccugcaccuggagggaaagugcgagacguguguguacaauaugaugggcaaaagagaaaagaaacucggcgaguucgggaaggccaagggaagccgggcuauuugguacauguggcugggcgcccgcuuucuugaauucgaggcccugggguuucucaacgaagaccauugguucucuagagagaauucccugagcggagucgagggcgaagggcuucacaaacugggcuauauccuccgggauguguccaagaaagagggaggcgcgauguacgcugacgauaccgccgggugggacacacgcauuacccuggaagaucugaagaacgaggaaaugguuacaaaucauauggagggagagcacaaaaagcucgccgaagcuaucuuuaagcugaccuaucaaaacaaaguggucagagugcagcggcccacgccgcgcggcacaguuauggacaucauuagcagacgggaccagcgcgggucuggacagguggucaccuacggccuuaacacauucaccaauauggaggcccaacugaucagacagauggaaggggagggcguguucaagagcauucagcaacucacggucaaagaggaaaucgcugugaagaacuggcugauucggguuggacgcgagagacuuucccggauggccaucucuggcgaugacugcguggucaaaccucuggaugaccgcuuugcgagcgcccucaccgcucugaaugauauggggaaggugagaaaggacauccagcagugggaacccucccggggauggaacgauuggacacaggugcccuucugcucucaucacuuucacgagcugauuaugaaagacggcagaguucucguggucccuugucgcaaucaagaugaacugaucgggcgggccagaauuagccagggagcuggcuggucccuucgcgagaccgccugccuggggaagucuuaugcgcagauguggagccucauguacuuccaucggagagaccugcgccuugccgcuaacgccaucuguuccgcugugccgagccacuggguucccacaucucggaccacaugguccauucaugccacccacgaguggaugacgacagaagauaugcugaccguguggaauagagucuggauccaggagaacccuuggauggaagacaaaacccccguggagagcugggaagagaucccuuaucucggcaagcgcgaggaucaauggugcggaucucugauuggccugacaucccgggcuaccugggccaaaaauauccagacagcgauuaaccaggucagaagccucaucgggaaugaagaguacacggacuacaugcccuccaugaagcgcuuucggagagaagaggaagaggccggagugcugugguga

SEQ ID NO: 20242 - RNA, 9876 nt, Artificial Sequence
  derived and/or modified CDS sequence (opt5) from DENV-2__JN851113__SS-prME
accgccggaaucauuaucaugaugauucccaccgugauggcuuuccaccugacgaccagaaacggggagccucauaugaucgucagccggcaggaaaagggaaaaagccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauucccagaucggcgccgggguguacaaagaaggaacauuucacaccauguggcaugucacacgcggcgcugugcugaugcacaaggggaaaagaauugagcccuccugggccgacgugaagaaagaucuuaucagcuacggaggcggguggaagcuggagggagaauggaaggagggcgaagagguucagguccucgcgcuggaaccuggcaaaaacccgcgggcugugcaaaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuagccccauccggguuccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggucacggacuucaaggggaagacagugugguuugugccuuccauuaaagccggaaaugauaucgcugccugccugcggaagaacggcaaaaaggucauucaacucagcagaaaaaccuucgacucugaauauaucaagacccgcacaaaugauugggacuuuguugugaccacagauaucagcgagaugggggccaacuucaaggcugagcgggugauugacccgagacgcuguaugaaacccgucauccugaccgauggagaagaacgggugauucuugccggcccuaugcccguuacgcauuccucugcggcucagagacgcgggcgggugggcagaaauccuaagaacgaaaaugaccaguacaucuacaugggagagccccuggaaaacgaugaggacugcgcccacuggaaagaggccaagaugcuccuggacaauauuaacacaccggaaggcaucaucccuagcauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaacuaugccgauagacggugguguuuugacggagucaaaaauaaccaaauucuggaagagaauguggaagucgagaucuggacaaaggagggcgaaagaaagaaacucaagccccgcuggcuggaugcucggauuuacuccgacccucuugcccugaaagaguucaaggaguucgcugccgggagaaaaucucucacccugaaccugaucacggagaugggccgccuccccaccuuuaugacacagaaggcgaagaaugcccuugauaaccuggcugugcugcauaccgccgaagcuggaggccgggccuauaaucacgcccucagcgagcugccggagacacuugaaacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucagccucacuggaucgcugccucuauuauccuggaguucuuucucaucgugcugcugauucccgaacccgagaaacaaagaaccccucaggacaaccagcucacauauguggucaucgccauucuuaccguuguggcugccacaauggcgaaugaaaugggcuuccuggagaagacgaaaaaggauuuugggcugggauccaucaccacacagcaaccggagagcaacauucucgacaucgaucugcggcccgccuccgcuuggacccuuuacgccguggcuacaaccuucaucacgccuaugcugcgccauucuauugaaaauagcuccgucaacgugucucucaccgccaucgcgaaucaggccacaguucugaugggccuggggaagggauggccccucagcaaaauggacauuggcgugccucuucuggcuaucggguguuacucccaggucaaccccauuacccugacagccgcucuccugcuucugguggcccacuaugcuaucauuggaccuggccuccaggccaaggcgaccagagaggcccaaaaacgggcugccgcuggcaucaugaagaauccgacggucgacgggaugacagugaucgaucuggaccccauuccuuacgaucccaaauuugaaaagcagcugggacagguuaugcuccuugugcugugcgucacccaggugcugaugaugcgcacaaccugggcccucugugaggcccugacccuugcgacaggcccuaucagcacgcugugggaagggaaccccggaagauucuggaauaccacaauugcuguuucuauggccaacaucuuucggggcuccuaucucgcuggggccggacugcuguucagcauuaugaagaacaccgccaauacacgcagaggcaccggcaacacgggggagacacucggagagaaauggaagaaucggcuuaacgcucugggcaaaucugaauuucaaaucuacaagaaauccgggauccaggagguggaccgcacccuggccaaggaaggaauuaaaagaggcgagaccgaucaucacgcggucagccgggggucugccaagcucagaugguucguggagcgcaaucuggugacaccggaaggaaagguugucgaccuuggcugcggcagagggggauggagcuauuacuguggcgggcugaaaaacgugaaggaggugaaaggacucaccaagggcgggccuggacaugaagaacccauccccauguccacauauggcuggaaucuggucagacugcagucuggcguugauguguucuuuacgccucccgaaaaaugcgacacccuccuuugugauauuggggagagcuccccuaacccgacaguggaggcuggacgcacccugcggguccugaaucucguggaaaacuggcugaauaacaauacacaauucugcaucaagguucuuaaccccuacaugccuagcgugauugagaagauggaagcccugcagagaaaauacggcggggcucucguccgcaauccccugucccggaacucuacccacgagauguauugggugagcaacgccuccggaaauaucguuucuagcgugaacaugaucuccagaaugcugauuaaucgcuuuacgaugcggcacaagaaagcgaccuacgaaccugacgucgaucucggcucugggacaagaaacaucggaauugagagcgagacccccaaucuugacaucauuggcaagcgcaucgagaaaaucaagcaggagcaugaaacauccuggcacuaugaucaggaccauccguacaagaccugggccuaucacggcagcuacgagacaaaacaaaccgggucugcuuccagcauggugaacggagugguccggcugcugacgaagccuugggacguuauucccauggugacacagauggccaugaccgauaccacaccuuucggccagcagagaguguuuaaagaaaaggucgacacgcgcacccaagagcccaaagaggggacaaagaagcucaugaaaaucaccgcugaauggcuguggaaggagcuuggcaaaaagaaaacaccuagaauguguacccgggaagaguucacacgcaaggugagaucuaaugccgcucugggcgccauuuuuaccgaugagaacaaauggaaguccgcgcgggaagccguugaggacagcggguucugggaacucguggauaaggagagaaaucugcaccuggaaggaaaaugcgagacgugugucuauaacaugaugggcaagcgggagaaaaagcucggcgaauuugggaaagcuaagggaucucgcgccaucugguacauguggcugggcgcuagauuccuugaguuugaagcccugggguuccucaaugaggaccauugguuuucccgggaaaacagccuguccggaguggagggcgaggggcuucacaagcugggcuacauucuccgcgauguuagcaaaaaggaaggaggcgccauguaugcggacgauaccgcugggugggacacaagaaucacccuggaggaucugaaaaaugaagagauggugacaaaccauauggaaggagagcacaagaaacucgccgaggccauuuucaagcugaccuaccagaauaaggucgugcggguucagcgccccacgccgagaggcacagugauggacaucaucucucggcgcgaccagagagggagcggacaagucgugaccuauggccuuaacacauucaccaacauggaagcucagcugauucggcagauggagggggaaggcgucuuuaaauccauccaacagcucacggugaaggaggagauugccguuaaaaauuggcugauccgcgugggaagagaacggcuuucucgcauggcuauuagcggcgaugacugcgucgugaagccucuggaugacagauucgccuccgcgcucaccgcccugaacgauauggggaaagugcggaaggacauccagcagugggagcccucuagaggauggaaugauuggacacaaguucccuuuugcagccaucacuuccacgaacugaucaugaaggacggccgcgugcucgucgugccuugucggaaccaggaugagcugauugggagagcucgcaucucccagggagccggcuggucucuucgggaaaccgcuugccuggggaaaagcuacgcccagauguggucccucauguauuuucauagacgcgaccugcggcuugcggccaaugcuauuuguagcgccguuccgucucacugggugcccacauccagaaccacauggagcauccaugcuacccacgaguggaugacgacagaggauaugcugaccgucuggaaccgcguguggauucaagaaaauccuuggauggaggacaagacccccgucgaaucuugggaggaaaucccuuaccucggcaaacgggaggaucaguggugcggaucccugaucggccugacaagcagagccaccugggcuaagaacauucagacagccaucaaucaggugcgcucccucauugggaacgaggaauauacggacuacaugcccucuaugaaacgguucagacgggaggaagaggaagcgggaguucugugguga

SEQ ID NO: 20243 - RNA, 9876 nt, Artificial Sequence
  derived and/or modified CDS sequence (opt5) from DENV-2__GU370050__SS-prME
accgccggaaucauuaucaugaugauucccaccgugauggcuuuccaccugacgaccagaaacggggaaccucauaugaucgucagccggcaggaaaagggaaaaagccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauucccagaucggcgccgggguguacaaagaaggaacauuucacaccauguggcaugucacacgcggcgcugugcugaugcacaaggggaaaagaauugagcccuccugggccgacgugaagaaagaucuuaucagcuacggaggcggguggaagcuggagggagaauggaaggagggcgaagagguucagguccucgcgcuggaaccuggcaaaaacccgcgggcugugcaaaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuagccccauccggguuccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggucacggacuucaaggggaagacagugugguuugugccuuccauuaaagccggaaaugauaucgcugccugccugcggaagaacggcaaaaaggucauucaacucagcagaaaaaccuucgacucugaauauaucaagacccgcacaaaugauugggacuuuguugugaccacagauaucagcgagaugggggccaacuucaaggcugagcgggugauugacccgagacgcuguaugaaacccgucauccugaccgauggagaagaacgggugauucuugccggcccuaugcccguuacgcauuccucugcggcucagagacgcgggcgggugggcagaaauccuaagaacgaaaaugaccaguacaucuacaugggagagccccuggaaaacgaugaggacugcgcccacuggaaagaggccaagaugcuccuggacaauauuaacacaccggaaggcaucaucccuagcauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaacuaugccgauagacggugguguuuugacggagucaaaaauaaccaaauucuggaagagaauguggaagucgagaucuggacaaaggagggcgaaagaaagaaacucaagccccgcuggcuggaugcucggauuuacuccgacccucuugcccugaaagaguucaaggaguucgcugccgggagaaaaucucucacccugaaccugaucacggagaugggccgccuccccaccuuuaugacacagaaggcgaagaaugcccuugauaaccuggcugugcugcauaccgccgaagcuggaggccgggccuauaaucacgcccucagcgagcugccggagacacuugaaacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucagccucacuggaucgcugccucuauuauccuggaguucuuucucaucgugcugcugauucccgaacccgagaaacaaagaaccccucaggacaaccagcucacauauguggucaucgccauucuuaccguuguggcugccacaauggcgaaugaaaugggcuuccuggagaagacgaaaaaggauuuugggcugggauccaucaccacacagcaaccggagagcaacauucucgacaucgaucugcggcccgccuccgcuuggacccuuuacgccguggcuacaaccuucaucacgccuauucugcgccauucuaucgaaaauagcuccgucaacgugucucucaccgccauugcgaaucaggccacaguucugaugggccuggggaagggauggccccucagcaaaauggacaucggcgugccucuucuggcuauuggguguuacucccaggucaaccccaucacccugacagccgcucuccugcuucugguggcccacuaugcuauuaucggaccuggccuccaggccaaggcgaccagagaggcccaaaaacgggcugccgcuggcaucaugaagaauccgacggucgacgggaugacagugauugaucuggaccccaucccuuacgaucccaaauuugaaaagcagcugggacagguuaugcuccuugugcugugcgucacccaggugcugaugaugcgcacaaccugggcccucugugaggcccugacccuugcgacaggcccuauuagcacgcugugggaagggaaccccggaagauucuggaauaccacaaucgcuguuucuauggccaacauuuuucggggcuccuaucucgcuggggccggacugcuguucagcaucaugaagaacaccgccaauacacgcagaggcaccggcaacacgggggagacacucggagagaaauggaagaaucggcuuaacgcucugggcaaaucugaauuucaaaucuacaagaaauccgggauucaggagguggaccgcacccuggccaaggaaggaaucaaaagaggcgagaccgaucaucacgcggucagccgggggucugccaagcucagaugguucguggagcgcaaucuggugacaccggaaggaaagguugucgaccuuggcugcggcagagggggauggagcuauuacuguggcgggcugaaaaacgugaaggaggugaaaggacucaccaagggcgggccuggacaugaagaacccauucccauguccacauauggcuggaaucuggucagacugcagucuggcguugauguguucuuuacgccucccgaaaaaugcgacacccuccuuugugauaucggggagagcuccccuaacccgacaguggaggcuggacgcacccugcggguccugaaucucguggaaaacuggcugaauaacaauacacaauucugcauuaagguucuuaaccccuacaugccuagcgugaucgagaagauggaagcccugcagagaaaauacggcggggcucucguccgcaauccccugucccggaacucuacccacgagauguauugggugagcaacgccuccggaaauaucguuucuagcgugaacaugauuuccagaaugcugaucaaucgcuuuacgaugcggcacaagaaagcgaccuacgaaccugacgucgaucucggcucugggacaagaaacauuggaaucgagagcgagacccccaaucuugacauuaucggcaagcgcaucgagaaaauuaagcaggagcauaagacauccuggcacuaugaucaggaccauccguacaaaaccugggccuaucacggcagcuacgaaacaaagcaaaccgggucugcuuccagcauggugaacggagugguccggcugcugacgaaaccuugggacguuauccccauggugacacagauggccaugaccgauaccacaccuuucggccagcagagaguguuuaaggagaaagucgacacgcgcacccaagaacccaaggaggggacaaagaaacucaugaagauuaccgcugaguggcuguggaaagaacuuggaaagaaaaagacaccuagaauguguacccgggaggaguucacacgcaaagugagaucuaaugccgcucugggcgccaucuuuaccgaugagaacaaguggaaguccgcgcgggaggccguugaagacagcggguucugggagcucguggauaaagaaagaaaucugcaccuggagggaaagugcgaaacgugugucuauaacaugaugggcaaacgggagaagaaacucggcgaguuugggaaggcuaagggaucucgcgccauuugguacauguggcugggcgcuagauuccuugaauuugaggcccugggguuccucaaugaagaccauugguuuucccgggagaacagccuguccggaguggaaggcgaggggcuucacaaacugggcuacauccuccgcgauguuagcaagaaagagggaggcgccauguaugcggacgauaccgcugggugggacacaagaauuacccuggaagaucugaagaaugaggaaauggugacaaaccauauggagggagaacacaaaaagcucgccgaggccaucuuccggcugaccuaccagaauaaggucgugcgcguucagagacccacgccgcggggcacagugauggacaucauuucucgcagagaccagcgggggagcggacaagucgugaccuauggccuuaacacauucaccaacauggaggcucagcugauccgccagauggaaggggagggcgucuuuaaauccauucaacagcucacggugaaggaagagaucgccguuaaaaauuggcugauuagagugggacgggagcgccuuucuagaauggcuaucagcggcgaugacugcgucgugaagccucuggaugaccgguucgccuccgcgcucaccgcccugaacgauauggggaaagugagaaaggacauccagcagugggaacccucucgcggauggaaugauuggacacaaguucccuuuugcagccaucacuuccacgagcugauuaugaaggacggccgggugcucgucgugccuuguagaaaccaggaugaacugaucgggcgcgcucggauuucccagggagccggcuggucucuuagagagaccgcuugccuggggaaaagcuacgcccagauguggucccucauguauuuucaucgccgggaccugagacuugcggccaaugcuaucuguagcgccguuccgucucacugggugcccacaucccgcaccacauggagcauucaugcuacccacgaauggaugacgacagaggauaugcugaccgucuggaaccggguguggauccaagagaauccuuggauggaagacaagacccccgucgagucuugggaagagaucccuuaccucggcaaaagagaagaucaguggugcggaucccugauuggccugacaagccgcgccaccugggcuaagaacauccagacagccauuaaucaggugcggucccucaucgggaacgaggaguauacggacuacaugcccucuaugaaaagauuccggagagaagaggaagaggcgggaguucugugguga

SEQ ID NO: 20244 - RNA, 9876 nt, Artificial Sequence
  derived and/or modified CDS sequence (opt5) from DENV-2__JN851129__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucagcgaggaacaagauaagcgcuuugugugcaaacauucuauggucgacagaggauggggcaauggcugugggcuguucggaaagggcgggaucguuaccugcgcgauguuuacaugcaagaaaaacauggagggaaagguggugcagccugaaaaucuggaguauacgauugucaucaccccccacuccggcgaagagaacgccguggggaaugauacaggaaaacauggcaaggagauuaaaguuaccccucagagcucuaucacagaagcugagcucaccggcuacgggacggugaccauggaauguuccccccggacaggacuggacuucaacgagaugguccuucugcagauggaaaauaaggccuggcucgugcaccgccaaugguuucuggaucuuccgcugccuuggcuccccggcgcugacacccaggggagcaacuggauccagaaagagacacugguuaccuucaagaacccucacgccaagaaacaggauguggucgugcugggaucccaagagggcgccaugcauacggcucucacaggggcgaccgaaauucagaugucuagcggcaaucugcuuuuuacaggacaccugaagugcagacuccggauggacaaacugcagcuuaagggcauguccuauagcauguguaccgggaaauucaaggucgugaaggagaucgccgaaacccaacauggaacaauuguuaucagagugcaguacgagggcgacgggucucccugcaaaauucccuucgagaucauggaucuggaaaagcgccacguccucggacggcugaucacggugaacccuauuguuaccgagaaagacuccccggugaauaucgaagcugagcccccuuuuggcgauagcuacauuaucauuggggucgaacccggccagcugaagcucucuugguucaaaaagggaagcuccaucggccagauguuugagacaaccaugagaggggccaagcgcauggccauucugggagacacagcuugggauuucggcucucuugggggaguguuuaccagcaucggcaaagcccugcaucaaguguucggggcgaucuauggcgcugccuuuuccggaguuagcuggacgaugaagauucucaucggcgucgugauuacauggaucgggaugaacucucgguccaccagccugucugugucccugguccuugugggaguugugacccucuaccugggcgucauggugcaggccgacagcggguguguuguguccuggaaaaauaaggagcugaaaugcggaucuggcauuuucaucacagauaacguccacaccuggacagaacaguauaaguuucagccugagagccccuccaagcucgcuucugccauccaaaaagcucacgaagaggggauuuguggcaucagaagcgugacgcgccuggaaaaucuuauguggaagcagauuaccccggagcugaaccauauccucuccgagaaugaaguuaaacugacaauuaugaccggagacaucaagggcaucaugcaggccgggaaacggagccugagaccucagcccacagagcuuaaguacucuuggaaagcguggggaaaggccaagaugcucuccaccgaacugcacaaccauacguuccugauugauggcccugagaccgcugaaugccccaauacaaaccgcgccuggaauagccucgagguggaggacuauggguuuggagucuucaccacaaaccuguggcuuaaacugaaggaacggcaagauguguuuugugacucuaaacucauguccgcugccaucaaggacaauagagcggugcacgccgauaugggcuacuggauugagagcgcucugaacgacaccuggaaaaucgaaaaggccucuuucauugaggucaagagcugccacuggccuaaaucccauacacuguggagcaacggcguucuugagucugaaaugaucauccccaaguccuucgcugggccggugagccagcacaauuaucgcccuggauaccauacccagacggccggccccuggcaccucgggcggcuggagauggauuuugacuucugugaaggaacaaccguggucgugaccgaggauugcggcaacagagggcccucccugcggacaaccacggccucuggaaaacucauuacagaauggugcugucgcagcugcacccugccuccgcuuagauaccggggcgaggacggcuguugguaugggauggagaucagaccccugaaggaaaaagaggaaaaucucguuaacucccuggugacagcuggacauggccagauugauaauuuuucucuggggguccuuggaauggcgcucuuccuggaggaaaugcugcgcacccgggugggcacaaagcacgccauccuccugguugcugugagcuuugucacccuuauuacggggaacauguccuucagagaccugggacgcgugaugguuauggugggcgccaccaugacagaugacaucggcaugggggucaccuaccucgcccugcuggcugccuuuaaggugagaccuacauucgcggcuggacuucugcuccggaaacugaccucuaaggagcucaugaugacgacaauuggcaucgugcugcuuagccaauccaccauccccgagacaauucuggaacucaccgaugcccuggcccuggggaugaugguccuuaaaaucguucgcaauauggagaaguaucagcuggcugugaccauuauggccauccucugcgugccuaacgcggucauucugcagaaugcuuggaaagugagcuguacaacgcucgccguugugucugucuccccccugcuucugaccagcucucaacagaaggccgacuggaucccucucgcucugacaaucaagggacugaaccccaccgccauuuuucuuacaacccuguccagaacgagcaaaaagcggucuuggccgcucaaugaagcuaucauggccgugggcaugguuuccauucuggcgagcucccuccugaaaaacgauaucccuaugacagggccccuuguggccggaggccugcugaccgucugcuacgugcucaccggccgcagcgcugaccuggagcuugaaagagccgcugacguccggugggaggagcaggccgaaauuucugggagcuccccuauccugucuaucacaauuagcgaggauggauccaugucuaucaagaaugaagaggaggaacagacccucacaauucugauccgcacgggccuccuggugauuagcgggcuuuuccccguuuccaucccgauuaccgccgcugcgugguaucugugggaggugaaaaagcaaagagccggaguccugugggacgugccuucucccccucccguuggcaaagcugaacucgaggauggggccuaccggaucaagcagaagggaauccugggcuauagccagauuggcgccgggguguacaaagaaggaacauuucacaccauguggcaugucacacgcggcgcugugcuuaugcacaaggggaaaagaaucgagcccuccugggccgacgugaagaaagaucugauuagcuacggaggcggguggaagcucgagggagaauggaaggagggcgaagagguucagguccuggcgcucgaaccuggcaaaaacccgcgggcugugcaaaccaagcccgggcuguucaaaacgaauaccggaacaaucggcgccgugucucuugacuuuuccccugggaccagcggaucucccauugucgauaagaaaggcaaggugguugggcuguauggaaacggcguggucacaagauccggcaccuacgugagcgccaucgcucagacagagaaguccaucgaggacaacccugaaauugaggaugacaucuuccgcaaaaagcggcugacgauuauggaucuccaucccggggccggaaaaaccaagagauaucugccugcgaucguucgcgaagcuauuaaacggggccuuagaacacugauccucgccccgacccgcguggucgccgcugagauggaagaggcccugcgggggcuccccaucagauaccagaccccugcuauucgcgccgagcacacaggacgggaaaucguggaccugaugugucaugcgacguucaccaugagacuucugucucccauucggguuccuaauuauaaccugaucauuauggaugaggcccacuuuacagaccccgcuagcaucgccgcucgcggcuacauuuccaccagaguggaaaugggggaggccgccggcaucuucaugacagcuaccccgccuggaagccgggaccccuuuccccagucuaaugcgccuaucauggaugaggaacgcgagauucccgaaagauccuggaacagcggccacgagugggucacggacuucaaggggaagacagugugguuugugccuucuaucaaagccggaaaugauauugcugccugccuccggaagaacggcaaaaaggucauccaacugagcagaaaaaccuucgacuccgaauauauuaagacccgcacaaaugauugggacuuuguugugaccacagauaucucugagaugggggccaacuucaaggcugagcgggugaucgacccgagacgcuguaugaaacccgucauucuuaccgauggagaagagcgggugauccuggccggcccuaugcccguuacgcauagcuccgcggcucagagacgcgggcgggugggcagaaauccuaagaacgaaaaugaccaguacauuuacaugggagagccccucgaaaacgaugaggacugcgcccacuggaaagaggccaagaugcugcuggacaauaucaacacaccggaaggcauuaucccuucuauguuugagcccgaacgcgagaaagucgaugcuaucgacggggaauauagacuccggggagaggcccgcaagaccuucguggaucuuaugagacggggcgaccugccuguuuggcuggcguaccgcguggccgcugaggggauuaauuaugccgauagacggugguguuuugacggaaucaaaaacaaccaaauucucgaagagaaugucgaaguggagaucuggacaaaggagggcgaaagaaagaaacugaagccccgcuggcuugaugcucggauuuacagcgacccucuggcccucaaagaguucaaggaauucgcugccgggagaaaaucccugacccugaaccucaucacggagaugggccgccuucccaccuuuaugacacagaaggcgcggaaugcccuggauaaccuggcuguccuccauaccgccgaagcuggaggcagagccuauaaucacgcccugagcgagcuuccggagacacuggaaacccuccugcugcucacacuucuggcuaccgugacggggggaauuuuccuguuucucaugucuggcaaggggaucggaaaaaugacacugggcaugugcugcaucauuaccgcguccauccuucugugguacgcccagauucagccucacuggaucgcugccagcauuauccucgaguucuuucugaucguucugcucauucccgaacccgagaagcaacggaccccucaggacaaccagcuuacauauguggugaucgccauucugaccgucguugcugccacaauggcgaaugaaaugggcuuccuggagaaaacgaagaaagauuuugggcucggauccaucaccacacagcaaccggagucuaacauucuggacaucgaucuucgccccgccagcgcuuggacccuguacgccguggcuacaaccuucaucacgccuaugcucagacauuccauugaaaauucuagcgugaacgucucccugaccgccaucgcgaaucaggccacagugcugaugggccucgggaagggauggccccuuagcaagauggacauuggcguuccucugcuggcuaucggguguuacucucaggugaaccccauuacccucacagccgcucugcuucugcucgucgcccacuaugcuaucauuggaccuggccugcaggccaaagcgacccgggaggcccaaaagcgcgcugccgcuggcaucaugaaaaauccgacgguggacgggaucacagucauugaucuggaccccaucccuuacgaucccaaguuugaaaaacagcucggacaggugaugcuucugguucugugcgugacccagguccucaugaugagaacaaccugggcccugugugaggcccuuacccuggcgacaggcccuauuuccacgcucugggaagggaaccccggacgguucuggaauaccacaaucgcugugagcauggccaacauuuuucgcggcucuuaucuggcuggggccggacugcucuucuccaucaugaagaauaccgccaacacaagacggggcaccggcaacacgggggagacacuuggagagaaguggaaaaaucgccugaacgcucugggcaagagcgaauuucaaaucuacaaaaagucugggauucaggagguugacagaacccucgccaaagaaggaaucaagcggggcgagaccgaucaucacgcggugagcagaggguccgccaaacugcgcugguucgucgagcggaaucuugugacaccggaaggaaaggugguugaccugggcugcggcagagggggauggucuuauuacuguggcgggcucaagaacgucaaagaggugaagggacugaccaaaggcgggccuggacaugaagagcccauucccaugagcacauauggcuggaaucuggugcgccuccaguccggcgucgauguuuucuuuacgccucccgaaaagugcgacacccuucugugugauaucggggagagcuccccuaacccgacaguggaggcuggacggacccugagagugcucaaucuggucgaaaacuggcuuaauaacaauacacaauucugcauuaaagugcugaaccccuacaugccuucuguuaucgagaagauggaagcccuccagcgcaaguacggcggggcucuggugcggaauccccugagcagaaacuccacccacgagauguauugggucucuaaugccagcggaaacaucguguccucuguuaacaugauuagccgcaugcucaucaaucgguuuacgaugagacacaaaaaggcgaccuacgaaccugacguggaucuuggcuccgggacacgcaacauuggaaucgagagcgagacccccaaucuggacauuaucggcaaacggaucgaaaagauuaaacaggagcaugaaacaucuuggcacuaugaucaggaccauccguacaagaccugggccuaucacggcuccuacgagacaaagcaaaccgggagcgcuucuuccauggucaacggaguggugagacugcucacgaaaccuugggacaucauucccauggucacacagauggccaugaccgauaccacaccuuucggccagcagcgcguuuuuaaggaaaaaguggacacgagaacccaagagcccaaggaggggacaaaaaagcugaugaagaucaccgcugaauggcuuuggaaagagcugggaaagaaaaagacaccucggauguguacccgcgaagaguucacaagaaaagugcggagcaaugccgcucucggcgccauuuuuaccgaugagaacaaguggaaaucugcgagagaagccgucgaggacuccggguucugggaacugguggauaaggagcggaaucugcaccucgaaggaaagugcgagacguguguuuauaacaugaugggcaaacgcgagaagaaacugggcgaauuugggaaggcuaaaggaagcagagccaucugguacauguggcuuggcgcucgguuccuggaguuugaagcccucggguuccugaaugaggaccauugguuuucccgcgaaaacagccuuucuggaguggagggcgaggggcugcacaagcucggcuacauucugagagaugucagcaagaaagaaggaggcgccauguaugcggacgauaccgcugggugggacacacggaucacccuggaggaucucaagaaugaagagauggugacaaaccauauggaaggagagcacaaaaagcuggccgaggccaucuucaaacuuaccuaccagaauaagguugugcgcguccagagacccacgccgcggggcacagugauggacauuaucucccgcagagaccagcgggggucuggacaaguugugaccuauggccugaacacauucaccaauauggaagcucagcucauucgccagauggagggggaaggcgucuuuaagagcauccaacagcugacggugaccgaggagauugccgucaaaaacuggcuugugagaguuggacgggaacgccuguccagaauggcuaucucuggcgaugacugcguggucaagccucucgaugaccgguucgccagcgcgcugacagcccugaacgauauggggaaagugagaaaggacauccagcagugggagcccucccgcggauggaaugauuggacccaagugcccuuuugcucucaucacuuccacgaacucauuaugaaagacggccggguucugguggucccuuguagaaaccaggaugagcuuaucgggcgcgcucggauuagccagggagccggcuggucccugagagaaacagcuugccucgggaagagcuacgcccagauguggucucugauguauuuucaucgccgggaccuuagacuggcggccaaugcuaucuguuccgccgugccgagccacuggguucccaccucucgcacaaccugguccauucaugcuacgcacgaguggaugacaaccgaggauaugcucaccguguggaaccgggucuggauccaagaaaauccuuggauggaggacaagacacugguggaaagcugggaggaaauccccuaccugggcaaaagagaggaucaguggugcggaucccucauuggccugaccucucgcgccacaugggcuaagaacauccagacggccauuaaucagguccggagccuuaucgggaacgaggaauauaccgacuacaugccuuccaugaaaagauuccggagagaggaagaggaagcgggagugcugugguga

SEQ ID NO: 20245 - RNA, 9876 nt, Artificial Sequence
  derived and/or modified CDS sequence (opt5) from DENV-2__JN851128__SS-prME
accgccggaaucauuaucaugaugauucccaccgugauggcuuuccaccugacgaccagaaauggggagccucauaugaucgucucccggcaggaaaagggaaaaucccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaccacccugccacccuuagaaaauacugcauugaagcuaagcugacgaauacaaccaccgccucucgguguccgacacagggggagcccucccucagcgaggaacaagauaaacgcuuugugugcaagcauucuauggucgacagaggauggggcaacggcugugggcuguucggaaaaggcgggaucguuaccugcgcgauguuuacaugcaagaagaauauggagggaaaaguggugcagccugaaaaccuggaguauacgauugucaucacaccccacuccggcgaagagaaugccguggggaacgauacaggaaagcauggcaaagagauuaagguuaccccucagagcucuaucacagaagcugagcucaccggcuacgggacggugaccauggaauguagcccccggacaggacuggacuucaaugagaugguccuucugcagauggaaaacaaagccuggcucgugcaccgccaaugguuucuggaucuuccgcugccuuggcuccccggcgcugacacccaggggagcaacuggauccagaaggagacacugguuaccuucaaaaauccucacgccaagaagcaggauguggucgugcugggaucccaagagggcgccaugcauacggcucucacaggggcgaccgaaauucagaugucuagcggcaaccugcuuuuuacaggacaccugaaaugcagacuccggauggacaagcugcagcuuaaaggcauguccuauagcauguguaccgggaaguucaaagucgugaaggagaucgccgaaacccaacauggaacaauuguuaucagagugcaguacgagggcgacgggucucccugcaagauucccuucgagaucauggaucuggaaaaacgccacguccucggacggcugaucacggugaauccuauuguuaccgagaaggacuccccggugaacaucgaagcugagcccccuuuuggcgauagcuacauuaucauuggggucgaacccggccagcugaaacucucuugguucaagaaaggaagcuccaucggccagauguuugagacaaccaugagaggggccaagcgcauggccauucugggagacacagcuugggauuucggcucucuugggggaguguuuaccagcaucggcaaggcccugcaucaaguguucggggcgaucuauggcgcugccuuuuccggaguuagcuggacgaugaaaauucucaucggcgucgugauuacauggaucgggaugaacucucgguccaccagccugucugugucccugguccuugugggaguugugacccucuaccugggcgucauggugcaggccgacagcggguguguuguguccuggaagaacaaagagcugaagugcggaucuggcauuuucaucacagauaauguccacaccuggacagaacaguauaaauuucagccugagagccccuccaagcucgcuucugccauccaaaaggcucacgaagaggggauuuguggcaucagaagcgugacgcgccuggaaaaccuuauguggaaacagauuaccccggagcugaaucauauccucuccgagaacgaaguuaagcugacaauuaugaccggagacaucaaaggcaucaugcaggccgggaagcggagccugagaccucagcccacagagcuuaaauacucuuggaaggcguggggaaaagccaagaugcucuccaccgaacugcacaaucauacguuccugauugauggcccugagaccgcugaaugccccaacacaaaucgcgccuggaacagccucgagguggaggacuauggguuuggagucuucaccacaaaucuguggcuuaagcugaaagaacggcaagauguguuuugugacucuaagcucauguccgcugccaucaaagacaacagagcggugcacgccgauaugggcuacuggauugagagcgcuaucaacgacaccuggaagauugaaaaagccucuuucaucgaggucaagagcugccacuggccuaagucccauacacuguggagcaauggcguucuggagucugaaaugaucauucccaaaaacuucgcugggccggugucccagcacaauuaucgcccuggauaccauacccagacggccggccccuggcaccuugggcggcucgagauggauuuugacuucugugaaggaacaaccguggucgugaccgaggauugcggcaacagagggcccagccugcggacaaccacggccuccggaaagcugaucacagaauggugcugucgcucuugcacccucccuccgcugagauaccggggcgaggacggcuguugguaugggauggagauuagaccccuuaaagaaaaggaggaaaaucugguuaacagccucgugacagcuggacauggccagaucgauaauuuuucccuggggguccugggaauggcgcuuuuccucgaggaaaugcugcgcacccgggugggcacaaaacacgccauucugcucguugcugugucuuuugucacccugaucacggggaacaugagcuucagagaccuuggacgcgugaugguuauggugggcgccaccaugacagaugacauuggcaugggggucaccuaccuggcccuccuggcugccuuuaaggugagaccuacauucgcggcuggacugcuucugcggaagcucaccuccaaagagcugaugaugacgacaaucggcaucgugcuccugucucaaagcaccauucccgagacaauccuugaacugaccgaugcccucgcccuggggaugaugauucugaagaucguccgcaauauggagaaauaucagcuugcuguuaccauuauggccauccugugcgugccuaacgcggugauccuccagaaugcuuggaaggucuccuguacaacgcuggccgugguuagcgugucuccccuccugcuuaccuccagccaacagaaagccgacuggauuccucuggcucucacaaucaagggacugaaccccaccgccauuuuucugacaacccuuucuagaacguccaagaaacggagcuggccgcugaaugaagcuaucauggccgucggcauggugucuauucucgcguccagccugcucaagaacgauaucccuaugacagggccccugguugccggaggccuucugaccgugugcuacguccugaccggccgcuccgcugaccucgagcuggaaagagccgcugacgugcggugggaggagcaggccgaaaucagcgggucuagcccuauucuuuccaucacaauuucugaggauggaagcauguccaucaaaaaugaagaggaggaacagacccugacaauucucauccgcacgggccugcucgucauuucugggcuguuccccgugagcaucccgaucaccgccgcugcgugguaucuuugggagguuaagaaacaaagagccggagugcugugggacgucccuucucccccucccgugggcaaggcugaacuggaggauggggccuaccggauuaaacagaagggaauccucggcuauagccagauuggcgccgggguuuacaaggaaggaacauuucacaccauguggcaugugacacgcggcgcuguccugaugcacaaagggaagagaaucgagcccagcugggccgacgugaaaaaggaucuuauuuccuacggaggcggguggaaacuggagggagaauggaaggagggcgaagaggugcagguucucgcgcuggaaccuggcaagaacccgcgggcuguccaaaccaaacccggacucuucaagacgaacaccggaacaaucggcgccgugagccuggacuuuucuccugggaccuccggaagccccaucguggauaaaaagggcaaagucguggggcuuuauggaaauggcguugugacaagaucuggcaccuacgucuccgccauugcucagacagaaaaguccaucgaggacaacccugaaauugaggaugacaucuuccgcaagaaacggcugacgauuauggaucugcaucccggggccggaaagaccaaaagauaucucccugcgaucgugcgcgaagcuaucaagcggggccugagaacacuuauucuggccccgacccgcguuguggccgcugagauggaagaggcccuccgggggcugcccaucagauaccagaccccugcuauucgcgccgagcacacaggacgggaaaucgucgaccucaugugucaugcgacguucaccaugagacugcuuucccccauucgggugccuaauuauaaccugaucauuauggaugaggcccacuuuacagaccccgcuucuaucgccgcucgcggcuacaucagcaccagaguugaaaugggggaggccgccggcauuuucaugacagcuaccccgccuggaucccgggaccccuuuccccagagcaaugcgccuaucauggaugaggaacgcgagauucccgaaagaucuuggaacuccggccacgagugggugacggacuucaaagggaagacagucugguuugugccuagcaucaaggccggaaaugauauugcugccugccugcggaaaaacggcaagaaagugauccaacucucuagaaagaccuucgacagcgaauauaucaaaacccgcacaaaugauugggacuuugucguuaccacagauauuuccgagaugggggccaacuucaaggcugagcgggugaucgacccgagacgcuguaugaagcccgugauucugaccgauggagaagaacgggucauccuugccggcccuaugcccgugacgcauucuagcgcggcucagagacgcgggcggguuggcagaaauccuaaaaacgaaaaugaccaguacauuuacaugggagagccccuggaaaacgaugaggacugcgcccacuggaaggaggccaaaaugcuccuggacaauaucaacacaccggaaggcaucauuccuuccauguuugagcccgaacgcgagaagguggaugcuaucgacggggaauauagacugcggggagaggcccgcaaaaccuucgucgaucucaugagacggggcgaccuuccuguguggcuggcguaccgcguugccgcugaggggauuaacuaugccgauagacggugguguuuugacggagugaagaauaaccaaauccuggaagagaaugucgaaguggagauuuggacaaaagagggcgaaagaaagaagcucaaaccccgcuggcuggaugcucggaucuacucugacccucuugcccugaaggaguucaaagaguucgcugccgggagaaagagccucacccugaaccugauuacggagaugggccgccuccccaccuuuaugacacagaaagcgcggaaugcccuugauaaccuggcuguccugcauaccgccgaagcuggaggcagagccuauaaucacgcccucuccgagcugccggagacacuugaaacccugcuccugcugacacuccuugcuaccgugacaggcgggaucuuccuguuucugaugagcgggaaggggaucggaaagaugacacucggcaugugcugcauuaucaccgcgucuauucugcuuugguacgcccagauccagccucacuggauugcugccuccaucauccuggaguucuuucucauuguucugcugauccccgaacccgagaaacaacggaccccucaggacaaccagcucacauauguggugauugccauccuuaccgucguugcugccacaauggcgaaugaaaugggcuuccuggagaagacgaaaaaggauuuugggcugggaagcauuaccacacagcaaccggaguccaacauccucgacaucgaucugcgccccgccucugcuuggacccuuuacgccguggcuacaaccuucauuacgccuaugcugagacauagcaucgaaaauuccucugugaacgucagccucaccgccauugcgaaucaggccacagugcugaugggccuggggaaaggauggccccucuccaagauggacaucggcguuccucuucuggcuauuggguguuacagccaggugaaccccaucacccugacagccgcucuccugcuucuggucgcccacuaugcuauuaucggaccuggccuccaggccaaggcgacccgggaggcccaaaaacgcgcugccgcuggcaucaugaagaauccgacgguggacgggauuacagucaucgaucuggaccccauuccuuacgaucccaaauuugaaaagcagcugggacaggugaugcuccuuguucugugcgugacccagguccugaugaugagaacaaccugggcccucugugaggcccugacccuugcgacaggcccuaucucuacgcugugggaagggaaccccggacgguucuggaauaccacaauugcuguguccauggccaacaucuuucgcggcagcuaucucgcuggggccggacugcuguucucuaucaugaaaaacaccgccaauacaagacggggcaccggcaacacgggggagacacucggagagaaguggaagaaucgccuuaacgcucugggcaaauccgaauuucaaauuuacaagaaaagcgggauccaggagguugacagaacccuggccaaggaaggaauuaaacggggcgagaccgaucaucacgcggugucuagagggagcgccaagcuccgcugguucgucgagcggaaucuggugacaccggaaggaaaagugguugaccuuggcugcggcagagggggaugguccuauuacuguggcgggcugaagaacgucaaggaggugaaaggacucaccaagggcgggccuggacaugaggaacccauccccaugucuacauauggcuggaaucuggugcgccugcagagcggcgucgauguuuucuuuacgccucccgaaaaaugcgacacccuccuuugugauauuggggaguccagcccuaacccgacaguggaggcuggacggacccugagagugcugaaucucgucgaaaacuggcugaauaacaauacacaauucugcaucaaggugcuuaaccccuacaugccuuccguuaucgagaaaauggaagcccugcagcgcaaguacggcggggcucucgugcggaauccccugucuagaaacagcacccacgagauguauugggucuccaacgccucuggaaauauugugagcuccguuaacaugaucucucgcaugcugauuaaucgguuuacgaugagacacaagaaagcgaccuacgaaccugacguggaucucggcagcgggacacgcaacaucggaauugaguccgagacccccaaucuugacaucaucggcaagcggauugagaaaaucaagcaggagcaugaaacaagcuggcacuaugaucaggaccauccguacaaaaccugggccuaucacggcucuuacgagacaaagcaaaccggguccgcuagcucuauggucaacggaguggugagacugcugacgaagccuugggacauuauccccauggucacacagauggccaugaccgauaccacaccuuucggccagcagcgcguuuuuaaagaaaagguggacacgagaacccaagagcccaaagaggggacaaagaaacucaugaagauuaccgcugaauggcuguggaaggagcuuggcaaaaagaaaacaccucggauguguacccgcgaagaguucacaagaaaggugcgguccaaugccgcucugggcgccaucuuuaccgaugagaacaaauggaaaagcgcgagagaagccgucgaggacucuggguucugggaacucguggauaaggagcggaaucugcaccuggaaggaaagugcgagacguguguuuauaacaugaugggcaagcgcgagaaaaagcucggcgaauuugggaaagcuaagggauccagagccauuugguacauguggcugggcgcucgguuccuugaguuugaagcccugggguuccucaaugaggaccauugguuuagccgcgaaaacucccugagcggaguggagggcgaggggcuucacaaacugggcuacauccucagagaugucucuaagaaggaaggaggcgccauguaugcggacgauaccgcugggugggacacacggaucacccuggaggaucugaaaaaugaagagauggugacaaaccauauggaaggagagcacaagaaacucgccgaggccauuuucaagcugaccuaccagaauaaaguugugcgcguccagagacccacgccgcggggcacagugauggacaucauuagccgcagagaccagcggggguccggacaaguugugaccuauggccuuaacacauucaccaacauggaagcucagcugauccgccagauggagggggaaggcgucuuuaagucuauucaacagcucacggugaccgaggagaucgccgucaagaauuggcuggugagaguuggacgggaacgccuuagcagaauggcuaucuccggcgaugacugcguggucaaaccucuggaugaccgguucgccucugcgcucacagcccugaacgauauggggaaggugagaaaagacauucagcagugggagcccagccgcggauggaaugauuggacccaagugcccuuuugcucccaucacuuccacgaacugaucaugaaggacggccggguucucguggucccuuguagaaaccaggaugagcugauugggcgcgcucggaucucucagggagccggcuggagccuuagagaaacagcuugccuggggaaauccuacgcccagauguggagccucauguauuuucaucgccgggaccugagacuugcggccaaugcuauuuguucugccgugccgucccacuggguucccaccagccgcacaaccuggucuauccaugcuacgcacgaguggaugacaaccgaggauaugcugaccguguggaaccgggucuggauccaagaaaauccuuggauggaggacaagacacucguggaauccugggaggaaauucccuaccugggcaagagagaggaucaguggugcggaagccugaucggccucaccucccgcgccacaugggcuaaaaacauucagacggccaucaaucagguccggucucugauugggaacgaggaauauaccgacuacaugccuagcaugaagagauuccggagagaggaagaggaagcgggagugcuuugguga

SEQ ID NO: 20246 - RNA, 9876 nt, Artificial Sequence
  derived and/or modified CDS sequence (opt5) from DENV-2__JN851130__SS-prME
acagccggcaucauuaucaugaugauucccacagugauggcuuuccaccugacgaccagaaacggggagccucauaugaucgugagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugcuauuggccuaaaagccacacccugugguccaauggcguccuggagagcgaaaugauuauccccaagaacuucgccgggccgguuucucagcauaauuaccgcccuggauaccacacgcagacagcuggccccuggcaucuugggcggcucgagauggauuuugacuucugugaaggaaccaccgugguggucacagaggauugcggcaacagagggcccucccugcggaccacgacagccagcggaaaacugauuaccgaauggugcugucgcuccugcacacucccuccgcugagauaucggggcgaggacggcuguugguacgggauggagaucagaccccuuaaggaaaaagaggaaaaucuggugaacucucucguuaccgccggacacggccagauugauaauuuuagccugggggugcugggaauggcucuuuuccucgaggaaaugcugcgcacacgggucggcaccaagcaugcgauccugcucguggccguuuccuuugugacgcugauuaccgggaacaugucuuucagagaccuuggacgcgucauggugaugguuggcgcuacaaugaccgaugacaucggcaugggggugacauaucuggcccuccuggccgcuuuuaaggucagaccuaccuucgccgcgggacugcuucugcggaaacucacgagcaaggagcugaugaugacaaccaucggcauugugcuccugucccaaucuacaauccccgagaccauucuugaacugaccgaugcucucgcccuggggaugauggcccugaaaaucgugcgcaauauggagaaguaccagcuugcugucacaauuauggccauccugugcguuccuaacgcggugauccuccagaaugcuuggaaagugagcuguacgacccuggccgucguguccguuagcccccuccugcuuacaucuucccaacagaaggccgacuggauuccucuggcucucaccaucaagggacugaaccccacagccauuuuucugaccacgcuuagcagaacaucuaaaaagcgguccuggccgcugaaugaagcuaucauggccgugggcauggucagcauucucgcgucuucccugcucaaaaacgauaucccuaugaccgggccccugguggccggaggccuucugaccguuugcuaugugcugacaggccgcagcgcugaccucgagcuggaaagagccgcugacguccggugggaggagcaggccgaaaucuccgggagcucuccuauucuuagcaucaccauuuccgaggauggaucuaugagcaucaagaaugaagaggaggaacagacacugacgauucucauccgcaccggccugcucgugauuuccgggcuguuccccgucucuaucccgaucacagccgcugcgugguaccuuugggaggugaaaaagcaaagagccggaguucugugggacgugccuucucccccucccgucggcaaagcugaacuggaggauggggccuaucggauuaagcagaagggaauccucggcuacucccagauuggcgccgggguguacaaagaaggaaccuuucacacaauguggcacguuacccgcggcgcugugcugaugcauaaggggaaaagaaucgagcccuccugggccgacgucaagaaagaucuuauuagcuauggaggcggguggaagcuggagggagaauggaaggagggcgaagagguccaggugcucgcgcuggaaccuggcaaaaacccgcgggcuguucaaacgaagcccggacucuucaaaaccaacacaggaaccaucggcgccgucucccuggacuuuagcccugggacaucuggaucccccaucguggauaagaaaggcaagguggucgggcuuuacggaaauggcgugguuaccagaagcggcacauaugugucugccauugcucagacggagaaguccaucgaggacaacccugaaauugaggaugacaucuuccgcaaaaagcggcugaccauuauggaucugcaccccggggccggaaaaacaaagagauaccucccugcgaucguccgcgaagcuaucaaacggggccugagaacccuuauucuggccccgacccgcgugguugccgcugagauggaagaggcccuccgggggcugcccaucagauaucagaccccugcuauucgcgccgagcauacgggacgggaaaucguggaccucaugugucacgcgaccuucacaaugagacugcuuagccccauucgggucccuaauuacaaccugaucauuauggaugaggcccauuuuaccgaccccgcuuccaucgccgcucgcggcuauaucucuacaagaguggaaaugggggaggccgccggcauuuucaugaccgcuacgccgccuggaagccgggaccccuuuccccaguccaaugcgccuaucauggaugaggaacgcgagauucccgaaagaagcuggaacucuggccacgaguggguuacagacuucaaggggaagaccgugugguuugucccuuccaucaaagccggaaaugauauugcugccugccugcggaagaacggcaaaaaggugauccaacucagcagaaaaaccuucgacucugaauacaucaagacacgcaccaaugauugggacuuuguggucacaaccgauauuagcgagaugggggccaacuucaaggcugagcggguuaucgacccgagacgcuguaugaaacccgugauucugacggauggagaagaacgggugauccuugccggcccuaugcccgucacacacuccucugcggcucagagacgcgggcgggugggcagaaauccuaagaacgaaaaugaccaguacauuuauaugggagagccccuggaaaacgaugaggacugcgcccauuggaaagaggccaagaugcuccuggacaauaucaacaccccggaaggcaucauuccuagcauguuugagcccgaacgcgagaaaguugaugcuaucgacggggaauacagacugcggggagaggcccgcaagacauucguggaucucaugagacggggcgaccuuccugucuggcuggcguaucgcguggccgcugaggggauuaacuacgccgauagacggugguguuuugacggaguuaaaaauaaccaaauccuggaagagaauguggaagucgagauuuggaccaaggagggcgaaagaaagaaacucaagccccgcuggcuggaugcucggaucuauuccgacccucuugcccugaaagaguucaaggaguucgcugccgggagaaaaucucucacgcugaaccugauuaccgagaugggccgccuccccacauuuaugacccagaaggcgcggaaugcccuugauaaccuggcugugcugcacacagccgaagcuggaggcagagccuacaaucaugcccucagcgagcugccggagacccuugaaacacugcuccugcugacccuccuugcuacggucacagggggaaucuuccuguuucugauguccggcaaggggaucggaaaaaugacccucggcaugugcugcauuaucaccgcgagcauucugcuuugguaugcccagauccagccucacuggauugcugccucuaucauccuggaguucuuucucauugugcugcugauccccgaacccgagaagcaacggacaccucaggacaaccagcucaccuacguugugauugccauccuuacaguggucgcugccacgauggcgaaugaaaugggcuuccuggagaaaaccaagaaagauuuugggcugggauccauuacaacccagcaaccggagagcaacauccucgacaucgaucugcgccccgccuccgcuuggacacuuuacgccguugcuaccacguucauuaccccuaugcugagacacucuaucgaaaauagcuccgugaacgugucucucacagccauugcgaaucaggccaccguccugaugggccuggggaagggauggccccucagcaagauggacaucggcgugccucuucuggcuauuggguguuauucccagguuaaccccaucacacugaccgccgcucuccugcuucugguggcccauuacgcuauuaucggaccuggccuccaggccaaagcgacgcgggaggcccaaaagcgcgcugccgcuggcaucaugaaaaauccgacagucgacgggauuaccgugaucgaucuggaccccauuccuuaugaucccaaguuugaaaaacagcugggacaggucaugcuccuugugcugugcguuacacaggugcugaugaugagaaccaccugggcccucugugaggcccugacacuugcgacgggcccuaucagcacccugugggaagggaaccccggacgguucuggaauacaaccauugcugucucuauggccaacaucuuucgcggcuccuaccucgcuggggccggacugcuguucagcaucaugaagaacacagccaauaccagacggggcacgggcaacacaggggagacccucggagagaaguggaaaaaucgccuuaacgcucugggcaagucugaauuucaaauuuauaaaaaguccgggauccaggagguggacagaacccuggccaaagaaggaauuaagcggggcgagacagaucaccaugcgguuagcagagggucugccaaacuccgcugguucguggagcggaaucuggucaccccggaaggaaaggugguggaccuuggcugcggcagagggggauggagcuacuauuguggcgggcugaagaacguuaaagaggucaagggacucacaaaaggcgggccuggacacgaggaacccauccccauguccacguacggcuggaaucuggugcgccugcagucuggcguggaugucuucuuuaccccucccgaaaagugcgacacacuccuuugugauauuggggagagcuccccuaacccgaccguugaggcuggacggacacugagagugcugaaucucguggaaaacuggcugaauaacaauacccaauucugcaucaaaguccuuaaccccuacaugccuagcgugaucgagaagauggaagcccugcagcgcaaguauggcggggcucucguucggaauccccuguccagaaacucuacgcaugagauguacugggugagcaacgccuccggaaauauugucucuagcgugaacaugaucucccgcaugcugauuaaucgguuuaccaugagacacaaaaaggcgacauaugaaccugacguugaucucggcucugggacccgcaacaucggaauugagagcgagauccccaaucuugacaucauuggcaaacggaucgaaaagauuaaacaggagcacgaaacauccuggcauuacgaucaggaccacccguauaagaccugggccuaccauggcagcuaugagacaaagcaaaccgggucugcuuccagcauggugaacggagucgugagacugcugacgaaaccuugggacgugauccccauggucacacagauggccaugaccgauaccacaccuuucggccagcagcgcguuuuuaaggaaaaaguggacacgagaacccaagagcccaaggaggggaccaaaaagcucaugaagauuaccgcugaauggcuguggaaagagcuuggaaagaaaaagacaccucggauguguacccgcgaagaguucacaagaaaagugcggucuaaugccgcucugggcgccaucuuuaccgaugagaacaaguggaaauccgcgagagaagccgucgaggacagcggguucugggaacucguggauaaggagcggaaucugcaccuggaaggaaagugcgagacguguguuuacaacaugaugggcaaacgcgagaagaaacucggcgaauuugggaaggcuaaaggaucuagagccauuugguacauguggcugggcgcucgguuccuugaguuugaagcccugggguuccucaaugaggaccacugguuuucccgcgaaaacagccuguccggaguggagggcgaggggcuucauaagcugggcuauauccucagagaugucagcaagaaagaaggaggcgccauguacgcggacgauaccgcugggugggacacacggaucacccuggaggaucugaagaaugaagagauggugacaaaccacauggaaggagagcauaaaaagcucgccgaggccauuuucaaacugaccuaucagaauaagguugugcgcguccagagacccacgccgcggggcacagugauggacaucauuucucgcagagaccagcgggggagcggacaaguugugaccuacggccuuaacacauucaccaacauggaagcucagcugauccgccagauggagggggaaggcgucuuuaaguccauucaacagcucacggugaccgaggagaucgccgucaaaaauuggcuggugagaguuggacgggaacgccuuucuagaauggcuaucagcggcgaugacugcguggucaagccucuggaugaccgguucgccuccgcgcucacagcccugaacgauauggggaaagugagaaaggacauucagcagugggagcccucucgcggauggaaugauuggacccaagugcccuuuugcagccaccauuuccacgaacugaucaugaaagacggccggguucucguggucccuuguagaaaccaggaugagcugauugggcgcgcucggaucucccagggagccggcuggucucuuagagaaacagcuugccugggaaagagcuaugcccagauguggucccucauguacuuucaccgccgggaccugagacuugcggccaaugcuauuuguagcgccgugccgucucauuggguucccaccucccgcacaaccuggagcauccacgcuacgcaugaguggaugacaaccgaggauaugcugaccguguggaaccgggucuggauccaagaaaauccuuggauggaggacaagacacccguggaaucuugggaggaaauuccuuaucucggcaaaagagaggaucaguggugcggaucccugaucggccugaccagccgcgccacaugggcuaagaacauucagacggccaucaaucagguccggucccucauugggaacgaggaauacaccgacuacaugcccucuaugaaaagauuccggagagaggaagaggaagcgggagugcugugguga

SEQ ID NO: 20247 - RNA, 9876 nt, Artificial Sequence
  derived and/or modified CDS sequence (opt5) from DENV-2__JN851125__SS-prME
accgccggaaucauuaucaugaugauucccaccgugauggcuuuccaccugacgacccggaacggggaaccucauaugaucgugagccggcaggaaaagggaaaaagccuccuguuuaagacggagaauggcguuaacaugugcacccuuauggccauggaccugggggaacucugugaggauacaauuaccuacaauugcccgcugcuuaaacaaaacgaacccgaggacaucgauuguuggugcaauucuacaagcaccugggugacguauggaaccuguacagcgaccggcgagcaccgccgggaaaagcgguccguggcucuggucccucauguggggaugggacucgagacacgcaccgaaacguggaugucuagcgagggcgccuggaaacacgcccagcggaucgagacauggguucugcggcaucccggcuucaccgugauggcugccauucuggcuuacacaaucgggaccaccuauuuucagcgcguccucauuuucauccugcuuacagccguggcgccuuccaugacgaugagaugcauuggaaucucuaaccgggacuuuguugaaggcgugagcgggggauccugggucgauauugugcuggagcacggcagcugugugaccacaauggccaagaauaagcccacccucgacuucgaacugaucaaaacagaggcuaagcacccugccacccuucgcaaauacugcaucgaagcuaagcugacgaacacaaccaccgccucuagauguccgacacagggggagcccucccucaaugaggaacaagauaaacgguuugucugcaagcauagcaugguugaccgcggauggggcaacggcugugggcuguucggaaagggcgggauugugaccugcgcgauguuuacaugcaaaaagaauauggagggaaaagugguccagccugaaaaccuggaguauacgaucgugauuacaccccacucuggcgaagagaaugccguugggaacgauacaggaaagcauggcaaagagaucaaggugaccccucaguccagcauuacagaagcugagcucaccggcuacgggacggucaccauggaauguucucccagaacaggacuggacuucaaugagauggugcuucugcagauggaaaacaaagccuggcucguucaccggcaaugguuucuggaucuuccgcugccuuggcuccccggcgcugacacccagggguccaacuggauccagaaggagacacuggugaccuucaagaauccucacgccaaaaagcaggaugucgugguccugggaagccaagagggcgccaugcauacggcucucacaggggcgaccgaaauccagauguccucuggcaaccugcuuuuuacaggacaccugaaaugccgccucagaauggacaagcugcagcuuaaaggcaugagcuauuccauguguaccgggaaguucaaggugguuaaagagauugccgaaacccaacauggaacaaucgugauucggguccaguacgagggcgacgggagccccugcaagauccccuucgagauuauggaucuggagaagcggcacgugcucggacgccugaucacgguuaauccuaucgugaccgagaaggacucuccggucaacauugaagcugagcccccuuuuggcgauuccuacaucauuaucgggguggaacccggccagcugaaacucagcugguucaagaagggaucuagcauuggccagauguuugagacaaccaugagaggggccaaaagaauggccauccugggagacacagcuugggauuucggcucccuugggggaguguuuaccucuauuggcaaggcccugcaucaaguuuucggggcgaucuauggcgcugccuuuagcggagucuccuggacgaugaaaauccucauuggcguggugaucacauggauugggaugaauagccgcucuaccucccugagcgucucucuggugcuuguuggaguggucacccucuaccugggcgugaugguucaggccgacuccggguguguggucagcuggaagaacaaagagcugaagugcggauccggcaucuucauuacagauaaugugcacaccuggacagaacaguauaaguuucagccugagucucccagcaaacucgcuuccgccauccaaaaggcucacgaagaggggaucuguggcauucggucuguuacgagacuggaaaaccuuauguggaaacagaucaccccggagcugaaucauauucucagcgagaacgaagugaagaugacaaucaugaccggagacauuaaaggcaucaugcaggccgggaagcgcucccugcggccucagcccacagagcugaaauacagcuggaaggcguggggaaaggccaaaaugcuuucuaccgaacuccacaaucauacguuccugaucgauggcccugagaccgcugaaugccccaacacaaauagagccuggaacucccuggaggucgaggacuauggguuuggaguguucaccacaaauauuuggcucaagcugaaagaacgccaagaugugagcugugacucuaaacuuauguccgcugccaucaaagacaaccgggcgguccacgccgauaugggcuacuggauugagagcgcucugaacgacaccuggaagaucgaaaaggccucuuuuauugagguuaaaagcugccacuggccuaagucccauacacucuggagcaauggcgugcuggagucugaaaugaucauccccaaaaacuucgcugggccggugucccagcacaauuauagaccuggauaccauacccagacggccggccccuggcaccuggggcgccuugagauggauuucgacuuuugugaaggaacaaccgucgugguuaccgaggauugcggcaaccgggggcccagccucagaacaaccacggccuccggaaagcugauuacagaauggugcugucggucuugcacccugccuccgcuccgcuacagaggcgaggacggcuguugguaugggauggagauccggccccugaaagaaaaggaggaaaaucuugugaacagccuggucacagcuggacauggccagauugauaauuucucccucggggugcugggaauggcgcuguuucuugaggaaaugcucagaacccgcguuggcacaaagcacgccauccugcugguggcugucucuuucgugacccucauuacggggaacaugagcuuucgggaccugggaagaguuauggugauggucggcgccaccaugacagaugacaucggcaugggggugaccuaccuugcccugcucgcugccuucaaagugcgcccuacauuugcggcuggacugcugcuuagaaagcugaccuccaaagagcucaugaugacgacaauuggcaucguccugcucucucaaagcaccauccccgagacaauucuggaacuuaccgaugcccuggcccucgggaugaugguucugaagguggugcggaauauggagaaauaucagcuggcugucaccaucauggccauucuuugcgugccuaacgcgguuauccugcagaaugcuuggaagguguccuguacaacgcucgccgucgugagcguuuucccccugcuccugaccucuucccaacagaaggccgacuggauuccucuugcucugacaaucaaaggacucaaccccaccgccaucuuucugacaacccugagccgcacgucuaagaaaagauccuggccgcuuaaugaagcuauuauggccgugggcauggucagcauccuggcgucuucccuccugaagaacgauauuccuaugacagggccccucguggccggaggccugcuuaccgucugcuacgugcugaccggccggagcgcugaccuggagcucgaacgcgccgcugacguuagaugggaggagcaggccgaaaucuccgggagcucuccuauucugagcaucacaaucuccgaggauggaucuaugagcauuaaaaaugaagaggaggaacagacccuuacaauccugauucggacgggccuccuggugaucuccggacuguuccccgucucuauuccgaucaccgccgcugcgugguaucugugggaggugaagaaacaacgcgccggaguucuuugggacgugccuucucccccucccgucggcaaggcugaacuggaggauggggccuacagaauuaagcagaaaggaauccugggcuauucccagaucggcgccgggguguacaaggaaggaacauuucacaccauguggcaugugacacggggcgcuguucucaugcacaaagggaagcgcauugagcccuccugggccgacgucaaaaaggaucugaucagcuacggaggcggguggaaacuugagggagaauggaaagagggcgaagagguccaggugcuggcgcucgaaccuggcaagaacccgagagcuguccaaaccaaacccgggcuguucaagacgaacaccggaacaauuggcgccgugucccucgacuuuagcccugggaccucuggaucccccaucguugauaaaaagggcaagguggucgggcuguauggaaauggcgugguuacacggagcggcaccuacgugucugccauugcucagacagagaaauccaucgaggacaacccugaaaucgaggaugacauuuucagaaagaaacgccuuacgaucauggaucugcaucccggggccggaaagaccaaacgguaucugccugcgauugucagagaagcuaucaagcgcggccuccggacacugauucuugccccgaccagagugguugccgcugagauggaagaggcccugcgcgggcuccccauccgguaccagaccccugcuaucagagccgagcacacaggacgcgaaauuguggaccugaugugucaugcgacguucaccaugcggcuccugagccccaucagagucccuaauuauaaccuuauuaucauggaugaggcccacuuuacagaccccgcuuccauugccgcucggggcuacaucucuacccgcguggaaaugggggaggccgccggcauuuucaugacagcuaccccgccuggaagcagagaccccuuuccccaguccaaugcgccuaucauggaugaggaacgggagauccccgaacgcagcuggaacucuggccacgagugggugacggacuucaaggggaaaacagucugguuuguuccuuccauuaaggccggaaaugauaucgcugccugccugcgcaaaaacggcaagaaagugauucaacugagccggaagaccuucgacucugaauauaucaagaccagaacaaaugauugggacuuuguggucaccacagauauuagcgagaugggggccaacuucaaagcugagcgcgugaucgacccgcggagauguaugaagcccguuauccucaccgauggagaagaaagagugauucuggccggcccuaugcccgucacgcauuccucugcggcucagcggagagggcgcgugggccggaauccuaaaaacgaaagcgaccaguacaucuacaugggagagccccuugaaaaugaugaggacugcgcccacuggaaggaggccaaaaugcugcucgacaacauuaauacaccggaaggcaucauuccuuccauguuugagcccgaaagagagaagguugaugcuaucgacggggaauaucgccugagaggagaggcccggaaaaccuucguggaucugaugcgcagaggcgaccucccugucuggcuugcguaccggguggccgcugaggggaucaacuaugccgaucgcagaugguguuuugacggagucaagaacaaucaaauucuggaagagaacguggaaguugagaucuggacaaaggagggcgaacggaaaaagcugaaacccagauggcucgaugcucgcauuuacucugacccucuggcccuuaaggaguucaaagaguucgcugccgggagaaagagccugacccucaaucugaucacggagaugggcagacugcccaccuuuaugacacagaaggcgcgcaacgcccucgauaaucuugcugugcugcauaccgccgaagcuggaggccgggccuauaaccacgcccuguccgagcucccggagacacuggaaacccuucugcuccugacacugcucgcuaccgugacaggcgggauuuuccuuuuucugaugagcgggaaagggaucggaaagaugacacugggcaugugcugcauuaucaccgcgucuauccuccugugguacgcccagauucagccucacuggaucgcugccuccauuauccuugaguucuuucugauuguccuccugauccccgaacccgagaaacaaagaaccccucaggacaaucagcugacauauguugugaucgccauucucaccguggucgcugccacaauggcgaacgaaaugggcuuccuugagaagacgaaaaaggauuuugggcugggaagcuccaccacacagcaacaugagucuaauauccuggacauugaucuccggccggccagcgcuuggacccuguacgccguggcuacaaccuucaucacgcccaugcuucgccacuccauugaaaacucuagcguuaaugugucccugaccgccaucgcgaaccaggccacaguccucaugggccuggggaagggauggccucugagcaaaauggacaucggcgugccccuccuugcuauuggguguuacucucaggucaauccuaucacccugacagccgcucugcucucccugguggcccauuaugcuauuaucggacccggccuucaggccaaggcgaccagagaggcccaaaaacgggcugccgcuggcauuaugaagaacccuacgguugacgggaucacagugauugaucuggacccgauccccuacgauccuaaauuugaaaagcagcucggacaggucaugcugcuggugcucugcguuacccaggugcuuaugaugcgcacaaccugggcccugugugaggcccugacccucgcgacaggccccaucagcacgcugugggaagggaauccuggaagauucuggaacaccacaauugcugucucuauggccaauaucuuucggggcuccuaucuugcuggggccggacuccucuucagcauuaugaagaacaccgccaacacacgcagaggcaccggcaauacgggggagacacugggagagaaauggaagaaccggcugaaugcucucggcaaaucugaauuucaaaucuacaagaaaagcgggauucaggagguggaccgcacccuugccaaggaaggaaucaaaagaggcgagaccgaucaccaugcggugucccgggggucugccaagcugagaugguucguugagcgcaaccuggucacacccgaaggaaaggugguggaccucggcugcggcagagggggauggagcuauuacuguggcgggcugaaaaaugucaaggagguuaaaggacuuaccaagggcgggccgggacacgaagaaccuauccccauguccacauauggcuggaaccuggugagacuccagagcggcguggaugucuucuuuacgcccccugaaaaaugcgacacccugcugugugauauuggggaguccucucccaauccuacaguggaggcuggacgcacccuccggguucuuaaccugguggaaaauuggcugaacaauaacacacaauucugcaucaagguccucaauccguacaugcccagcgugauugagaagauggaagcccugcagagaaaauacggcggggcucuuguucgcaacccucuguccagaaauucuacccacgagauguauugggugagcaacgccuccggaaacaucgucucuagcgugaauaugauuuccagaaugcucaucaaccgcuuuacgaugcggcauaagaaagcgaccuacgaacccgacguggaucugggcagcgggacaagaaauaucggaauugagucugagaccccuaaccuggacaucauuggcaagcgcaucgagaagauuaagcaggagcacgaaacauccuggcauuaugaucaggaccaccccuacaagaccugggccuaucacggcagcuacgagacaaaacaaaccgggucugcuuccagcauggucaauggaguugugcggcuccuuacgaagccgugggacgugaucccuauggucacacagauggccaugaccgauaccacacccuucggccagcagagaguguuuaaagaaaagguugacacgcgcacccaagagccuaaagaggggacaaagaagcugaugaaaaucaccgcugaauggcuguggaaggagcucggcaaaaagaaaacacccagaauguguacccgggaagaguucacacgcaaggugagaucuaacgccgcucugggcgccauuuuuaccgaugagaauaaauggaaguccgcgcgggaagccgucgaggacagcggguucugggaacuuguggauaaggagagaaaccugcaucucgaaggaaaaugcgagacguguguuuauaauaugaugggcaagcgggagaaaaagcugggcgaauuugggaaagcuaagggaucccgcgccaucugguacauguggcugggcgcuagauuccucgaguuugaagcccugggguuccuuaacgaggaccacugguuuagccgggaaaauucucugagcggaguggagggcgaggggcuccauaagcugggcuacauucuucgcgaugucuccaaaaaggaaggaggcgccauguaugcggacgauaccgcugggugggacacaagaaucacccuggaggaucucaaaaacgaagagauggugacaaaucacauggaaggagagcauaagaaacuggccgaggccauuuucaagcugaccuaccagaacaagguugugcggguccagcgcccuacgcccagaggcacagugauggacaucauuucucggcgcgaccagagagggagcggacaagucgugaccuauggccucaauacauucaccaacauggaagcucagcugauccggcagauggagggggaaggcguuuuuaaauccauccaacagcuuacggccaccgaggagauugcugugaagaacuggcugguccgcgugggaagagaacggcucucucgcauggccaucagcggcgaugacugcgugguuaaaccgcuggaugacagauucgcguccgcccuuacagcucugaaugauauggggaaggugcggaaagacauucagcagugggagccuucuagaggauggaacgauuggacccaaguccccuuuugcagccaccacuuccaugaacucaucaugaaggacggccgcgugcugguugugcccugucggaaucaggaugagcugauugggagagcccgcaucucccagggagcuggcuggagccuccgggaaacagccugccuggggaagucuuacgcgcagauguggucccuuauguauuuucacagacgcgaccugcggcucgccgcuaacgccaucuguagcgcugucccuucucauugggugccgaccuccagaacaaccuggagcauucacgccacgcacgaguggaugacaaccgaggauaugcugaccgucuggaaucgcguguggauccaagaaaaccccuggauggaggacaaaacaccuguugaauccugggaggaaauucccuaccuuggcaagcgggaggaucaguggugcggaucucugaucggccucaccagcagagcuacaugggccaaaaauauucagacggcgaucaaccaggugcgcucccugaucgggaaugaggaauauaccgacuacaugccuagcaugaagcgguucagacgggaggaagaggaagccggaguccugugguga

SEQ ID NO: 20248 - RNA, 9876 nt, Artificial Sequence
  derived and/or modified CDS sequence (opt5) from DENV-2__JN851123__SS-prME
accgccggaaucauuaucaugaugauucccaccgugauggcuuuccaccugacgaccagaaacggggaaccucauaugaucgugagccggcaggaaaagggaaaaagccuccuguuuaagacggagaauggaguuaacaugugcacccuuauggccauggaccugggggaacucugugaggauacaauuaccuacaauugcccgcugcuuaaacaaaacgaacccgaggacaucgauuguuggugcaauucuacaagcaccugggugacguauggaaccuguacagcgaccggcgagcaccgccgggaaaagcgguccguggcucuggucccucauguggggaugggacucgagacacgcaccgaaacguggaugucuagcgagggcgccuggaaacacgcccagagaaucgagacauggguucugcggcaucccggcuucaccauuauggcugccauccuggcuuacacaauugggaccaccuauuuucagcgcgugcucaucuucauucugcuuacagccgucgcgccuuccaugacgaugagaugcaucggaauuucuaaccgggacuuuguggaaggcguuagcgggggauccuggguggauaucguccuggagcacggcagcugugugaccacaauggccaagaauaagcccacccucgacuucgaacugaucaaaacagaggcuaagcacccugccacccuucgcaaauacugcauugaagcuaagcugacgaacacaaccaccgccucuagauguccgacacagggggagcccucccucaaugaggaacaagauaaacgguuugugugcaagcauagcauggucgaccgcggauggggcaacggcugugggcuguucggaaagggcgggaucguuaccugcgcgauguuuacaugcaaaaagaauauggagggaaaaauugugcagccugaaaaccuggaguauacgaucgugauuacaccccacucuggcgaagagaaugccgucgggaacgauacaggaaagcauggcaaagagaucaaggugaccccucaguccagcaucacagaagcugagcucaccggcuacgggacgguuaccauggaauguucucccagaacaggacuggacuucaaugagauggugcuucugcagauggaaaacaaagccuggcucguccaccggcaaugguuucuggaucuuccgcugccuuggcuccccggcgcugacacccagggguccaacuggauucagaaggagacacuggugaccuucaagaauccucacgccaaaaagcaggauguugugguccugggaagccaagagggcgccaugcauacggcucucacaggggcgaccgaaauccagauguccucuggcaaccugcuuuuuacaggacaccugaaaugccgccucagaauggacaagcugcagcuuaaaggcaugagcuauuccauguguaccgggaaguucaagguggucaaagagauugccgaaacccaacauggaacaaucgugauucggguucaguacgagggcgacgggagccccugcaagauccccuucgagaucauggaucuggagaagcggcacgugcucggacgccugauuacggucaauccuaucgugaccgagaaggacucuccgguuaacauugaagcugagcccccuuuuggcgauuccuacaucauuaucgggguggaacccggccagcugaaacucagcugguucaagaagggaucuagcauuggccagauguuugagacaaccaugagaggggccaaaagaauggccauccugggagacacagcuugggauuucggcucccuugggggagucuuuaccucuaucggcaaggcccugcaucaaguguucggggcgauuuauggcgcugccuuuagcggaguguccuggacgaugaaaauccucauuggcguugucaucacauggauugggaugaauagccgcucuaccucccugagcgugucucuggugcuugucggagugguuacccucuaccugggcgugaugguccaggccgacuccgggugugugguuagcuggaagaacaaagagcugaagugcggauccggcaucuucaucacagauaaugugcacaccuggacagaacaguauaaguuucagccugagucucccagcaaacucgcuuccgccauucaaaaggcucacgaagaggggaucuguggcauucggucugucacgagacuggaaaaccuuauguggaaacagaucaccccggagcugaaucauauucucagcgagaacgaaaucaagcugacaaucaugaccggagacauuaaaggcaucaugcaggccgggaagcgcucccugcggccucagcccacagagcuuaaauacagcuggaaggcguggggaaaggccaaaaugcucucuaccgaacugcacaaucauacguuccugauugauggcccugagaccgcugaaugccccaacacaaauagagccuggaacucccucgagguggaggacuauggguuuggaguuuucaccacaaauaucuggcugaaacuuaaagaacgccaagauguguuuugugacagcaagcugaugucugcugccauuaaagacaaccgggcgguccacgccgauaugggcuacuggaucgaguccgcucucaacgacaccuggaagaucgaaaaggccagcuucauugaggugaaaucuugccacuggccuaagagccauacacugugguccaauggcgugcuggagagcgaaaugaucauucccaaaaacuucgcugggccggucucucagcacaauuauagaccuggauaccauacccagacggccggccccuggcaccuugggcgccucgagauggauuuugacuucugugaaggaacaaccguuguggugaccgaggauugcggcaaccgggggcccucccugagaacaaccacggccagcggaaagcugaucacagaauggugcugucgguccugcacccucccuccgcugcgcuacagaggcgaggacggcuguugguaugggauggagauucggccccuuaaagaaaaggaggaaaaucuggucaacucucucgugacagcuggacauggccagaucgauaauuuuagccuggggguucugggaauggcgcuuuuccucgaggaaaugcugagaacccgcgugggcacaaagcacgccauucugcucgucgcuguguccuuuguuacccugaucacggggaacaugucuuuccgggaccuuggaagagugauggucauggugggcgccaccaugacagaugacaucggcauggggguuaccuaccuggcccuccuggcugccuuuaaagugcgcccuacauucgcggcuggacugcuucugagaaagcucaccagcaaagagcugaugaugacgacaauuggcaucguccuccugucccaaucuaccauucccgagacaauccuugaacugaccgaugcccucgcccuggggaugauggugcugaagauugugcggaauauggagaaauaucagcuugcugucaccaucauggccauccugugcguuccuaacgcggugauucuccagaaugcuuggaaggugagcuguacaacgcuggccgucguguccguuagcccccuccugcuuaccucuucccaacagaaggccgacuggaucccucuggcucucacaauuaaaggacugaaccccaccgccaucuuucugacaacccuuagccgcacgucuaagaaaagauccuggccgcugaaugaagcuauuauggccgugggcauggucagcauccucgcgucuucccugcucaagaacgauaucccuaugacagggccccugguggccggaggccuucugaccguuugcuacgugcugaccggccggagcgcugaccucgagcuggaacgcgccgcugacgucagaugggaggagcaggccgaaauuuccgggagcucuccuauccuuagcauuacaaucuccgaggauggaucuaugagcauuaaaaaugaagaggaggaacagacccugacaauccucauucggacgggccugcucgugaucuccgggcuguuccccgucucuaucccgauuaccgccgcugcgugguaucuuugggaggugaagaaacaacgcgccggaguucugugggacgugccuucucccccucccgucggcaaggcugaacuggaggauggggccuacagaaucaagcagaaaggcauucucggcuauucccagaucggcgccgggguguacaaggaaggaacauuucacaccauguggcauguuacacggggcgcugugcugaugcacaaagggaagcgcauugagcccuccugggccgacgucaaaaaggaucuuaucagcuacggaggcggguggaagcuggagggagaauggaaagagggcgaagagguccaggugcucgcgcuggaaccuggcaagaacccgagagcuguucaaaccaaacccggacucuucaagacgaacaccggaacaaucggcgccgucucccuggacuuuagcccugggaccucuggaucccccauuguggauaaaaagggcaagguggucgggcuuuauggaaauggcgugguuacacggagcggcaccuacgugucugccaucgcucagacagagaaauccauugaggacaacccugaaaucgaggaugacauuuucagaaagaaacgccugacgaucauggaucugcaucccggggccggaaagaccaaacgguaucucccugcgaucgucagagaagcuauuaagcgcggccugcggacacuuauccuggccccgaccagagugguugccgcugagauggaagaggcccuccgcgggcugcccauucgguaccagaccccugcuaucagagccgagcacacaggacgcgaaauuguggaccucaugugucaugcgacguucaccaugcggcugcuuagccccaucagagucccuaauuauaaccugauuaucauggaugaggcccacuuuacagaccccgcuuccaucgccgcucggggcuacauuucuacccgcguggaaaugggggaggccgccggcaucuucaugacagcuaccccgccuggaagcagagaccccuuuccccaguccaaugcgccuauuauggaugaggaacgggagauccccgaacgcagcuggaacucuggccacgaguggguuacggacuucaaggggaaaacagugugguuugucccuuccauuaaggccggaaaugauaucgcugccugccugcgcaaaaacggcaagaaagugauccaacucagccggaagaccuucgacucugaauauauuaagaccagaacaaaugauugggacuuuguggucaccacagauaucagcgagaugggggccaacuucaaagcugagcgcguuauugacccgcggagauguaugaagcccgugauccugaccgauggagaagaaagagugauucuugccggcccuaugcccgucacgcauuccucugcggcucagcggagagggcgcgugggccggaauccuaaaaacgaaaaugaccaguacaucuacaugggagagccccuggaaaacgaugaggacugcgcccacuggaaggaggccaaaaugcuccuggacaauaucaacacaccggaaggcauuaucccuagcauguuugagcccgaaagagagaagguugaugcuauugacggggaauaucgccugagaggagaggcccggaaaaccuucguggaucucaugcgcagaggcgaccuuccugucuggcuggcguaccggguggccgcugaggggaucaacuaugccgaucgcagaugguguuuugacggaguuaagaauaaccaaauucuggaagagaauguggaagucgagaucuggacaaaggagggcgaacggaaaaagcucaaacccagauggcuggaugcucgcauuuacuccgacccucuugcccugaaggaguucaaagaguucgcugccgggcggaagucucucacccugaaccugaucacggagaugggcagacuccccaccuuuaugacacagaaggcgcgcaaugcccuugauaaccuggcugugcugcauaccgccgaagcuggaggccgggccuauaaucacgcccucagcgagcugccggagacacuugaaacccugcuccugcugacacuccuugcuaccgucacaggcgggaucuuccuguuucugauguccgggaaagggauuggaaagaugacacucggcaugugcugcaucauuaccgcgagcauccugcuuugguacgcccagauucagccucacuggaucgcugccucuaucauucuggaguucuuucucaucgugcugcugauucccgaacccgagaaacaaagaaccccucaggacaaccagcucacauauguugugaucgccauucuuaccguggucgcugccacaauggcgaaugaaaugggcuuccuggagaagacgaaaaaggauuuugggcugggauccaucaccacacagcaaccggagagcaacauccucgacauugaucugcggcccgccuccgcuuggacccuuuacgccguugcuacaaccuucaucacgccuaugcugcgccauucuauugaaaauagcuccgugaacgugucucucaccgccaucgcgaaucaggccacaguccugaugggccuggggaagggauggccccucagcaaaauggacauuggcgugccucuucuggcuaucggguguuacucccagguuaaccccauuacccugacagccgcucuccugcuucugguggcccacuaugcuaucaucggaccuggccuccaggccaaggcgaccagagaggcccaaaaacgggcugccgcuggcauuaugaagaauccgacggucgacgggaucacagugauugaucuggaccccaucccuuacgaucccaaauuugaaaagcagcugggacaggucaugcuccuugugcugugcguuacccaggugcugaugaugcgcacaaccugggcccucugugaggcccugacccuugcgacaggcccuauuagcacgcugugggaagggaaccccggaagauucuggaauaccacaaucgcugucucuauggccaacaucuuucggggcuccuaucucgcuggggccggacugcuguucagcauuaugaagaacaccgccaauacacgcagaggcaccggcaacacgggggagacacucggagagaaauggaagaaucggcuuaacgcucugggcaaaucugaauuucaaaucuacaagaaauccgggauucaggagguggaccgcacccuggccaaggaaggaaucaaaagaggcgagaccgaucaucacgcgguuagccgggggucugccaagcucagaugguucauugagcgcaaucuggugacaccggaaggaaaggucguggaccuuggcugcggcagaggcggguggagcuauuacuguggagggcugaaaaacgugaaggagguuaaagggcucaccaagggcgggccuggacaugaagaacccauccccauguccacauauggcuggaaucuggucagacugcagucuggcguggauguguucuuuacgccucccgaaaaaugcgacacccuccuuugugauaucggggagagcuccccuaacccgacagucgaggcuggacgcacccugcggguucugaaucucguggaaaacuggcugaauaacaauacacaauucugcauuaaggugcuuaaccccuacaugccuagcgucaucgagaagauggaagcccugcagagaaaauacggcggggcucucgugcgcaauccccugucccggaacucuacccacgagauguauuggguuagcaacgccuccggaaauauugugucuagcgucaacaugaucuccagaaugcugauuaaucgcuuuacgaugcggcacaagaaagcgaccuacgaaccugacguggaucucggcucugggacaagaaacaucggaaucgagagcgagacccccaaucuugacauuaucggcaagcgcauugagaaaaucaagcaggagcaugaaacauccuggcacuaugaucaggaccauccguacaagaccugggccuaucacggcagcuacgagacaaaacaaaccgggucugcuuccagcaugguuaacggagugguccggcugcugacgaagccuugggacgugauucccauggugacacagauggccaugaccgauaccacaccuuucggccagcagagagucuuuaaagaaaagguugacacgcgcacccaagagcccaaagaggggacaaagaagcucaugaaaaucaccgcugaauggcuguggaaggagcuuggcaaaaagaaaacaccuagaauguguacccgggaagaguucacacgcaaggugagaucuaaugccgcucugggcgccauuuuuaccgaugagaacaaauggaaguccgcgcgggaagccguggaggacagcggguucugggaacucgucgauaaggagagaaaucugcaccuggaaggaaaaugcgagacguguguguauaacaugaugggcaagcgggagaaaaagcucggcgaauuugggaaagcuaagggaucucgcgccaucugguacauguggcugggcgcuagauuccuugaguuugaagcccugggguuccucaaugaggaccauugguuuucccgggaaaacagccuguccggaguugagggcgaggggcuucacaagcugggcuacauccuccgcgaugugagcaaaaaggaaggaggcgccauguaugcggacgauaccgcugggugggacacaagaauuacccuggaggaucugaaaaaugaagagauggucacaaaccauauggaaggagagcacaagaaacucgccgaggccaucuuccggcugaccuaccagaauaaggugguucgcgugcagagacccacgccgcggggcacagucauggacauuaucucucgcagagaccagcgggggagcggacaagugguuaccuauggccuuaacacauucaccaacauggaagcucagcugauucgccagauggagggggaaggcguguuuaaguccauccaacaucucacggucaccgaggagaucgccgugaaaaauuggcuggucagagugggacgggaacgccuuucuagaauggcuauuagcggcgaugacugcguugugaagccucuggaugaccgguucgccuccgcgcucacagcccugaacgauauggggaaagucagaaaggacauccagcagugggagcccucucgcggauggaaugauuggacccaggugcccuuuugcagccaccacuuccaugaacugauuaugaaagacggccgggugcucguugugccuuguagaaaccaagaugagcugaucgggcgcgcucggauuucccagggagccggcuggucucuuagagaaacagcuugccugggaaagagcuacgcccagauguggucccucauguauuuucaccgccgggaccugagacuugcggccaaugcuaucuguagcgccgucccgucucauugggugcccaccucccgcacaaccuggagcauccacgcuacgcacgaguggaugacaaccgaggauaugcugaccguuuggaaccggguguggauucaggaaaauccuuggauggaggacaagacacccaucgaaucuugggaggaaauuccuuaccucggcaaaagagaggaucaauggugcggaucccugaucggccugaccagccgcgccacaugggcuaagaacauucagacggccaucaaucagguccggucccucauugggaacgaggaauauaccgacuacaugcccucuaugaaaagauuccggagagaggaagaggaagcgggagugcugugguga

SEQ ID NO: 20249 - RNA, 9876 nt, Artificial Sequence
  derived and/or modified CDS sequence (opt5) from DENV-2__JN851118__SS-prME
accgccggaaucauuaucaugaugauucccaccgugauggcuuuccaccugacgaccagaaacggggagccucauaugaucgucagccggcaggaaaagggaaaaagccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauucccagaucggcgccgggguguacaaagaaggaacauuucacaccauguggcaugucacacgcggcgcugugcugaugcacaaggggaaaagaauugagcccuccugggccgacgugaagaaagaucuuaucagcuacggaggcggguggaagcuggagggagaauggaaggagggcgaagagguucagguccucgcgcuggaaccuggcaaaaacccgcgggcugugcaaaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuagccccauccggguuccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggucacggacuucaaggggaagacagugugguuugugccuuccauuaaagccggaaaugauaucgcugccugccugcggaagaacggcaaaaaggucauucaacucagcagaaaaaccuucgacucugaauauaucaagacccgcacaaaugauugggacuuuguugugaccacagauaucagcgagaugggggccaacuucaaggcugagcgggugauugacccgagacgcuguaugaaacccgucauccugaccgauggagaagaacgggugauucuugccggcccuaugcccguuacgcauuccucugcggcucagagacgcgggcgggugggcagaaauccuaagaacgaaaaugaccaguacaucuacaugggagagccccuggaaaacgaugaggacugcgcccacuggaaagaggccaagaugcuccuggacaauauuaacacaccggaaggcaucaucccuagcauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaacuaugccgauagacggugguguuuugacggagucaaaaauaaccaaauucuggaagagaauguggaagucgagaucuggacaaaggagggcgaaagaaagaaacucaagccccgcuggcuggaugcucggauuuacuccgacccucuugcccugaaagaguucaaggaguucgcugccgggagaaaaucucucacccugaaccugaucacggagaugggccgccuccccaccuuuaugacacagaaggcgaagaaugcccuugauaaccuggcugugcugcauaccgccgaagcuggaggccgggccuauaaucacgcccucagcgagcugccggagacacuugaaacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucagccucacuggaucgcugccucuauuauccuggaguucuuucucaucgugcugcugauucccgaacccgagaaacaaagaaccccucaggacaaccagcucacauauguggucaucgccauucuuaccguuguggcugccacaauggcgaaugaaaugggcuuccuggagaagacgaaaaaggauuuugggcugggauccaucaccacacagcaaccggagagcaacauucucgacaucgaucugcggcccgccuccgcuuggacccuuuacgccguggcuacaaccuucaucacgccuaugcugcgccauucuauugaaaauagcuccgucaacgugucucucaccgccaucgcgaaucaggccacaguucugaugggccuggggaagggauggccccucagcaaaauggacauuggcgugccucuucuggcuaucggguguuacucccaggucaaccccauuacccugacagccgcucuccugcuucugguggcccacuaugcuaucauuggaccuggccuccaggccaaggcgaccagagaggcccaaaaacgggcugccgcuggcaucaugaagaauccgacggucgacgggaugacagugaucgaucuggaccccauuccuuacgaucccaaauuugaaaagcagcugggacagguuaugcuccuugugcugugcgucacccaggugcugaugaugcgcacaaccugggcccucugugaggcccugacccuugcgacaggcccuaucagcacgcugugggaagggaaccccggaagauucuggaauaccacaauugcuguuucuauggccaacaucuuucggggcuccuaucucgcuggggccggacugcuguucagcauuaugaagaacaccgccaauacacgcagaggcaccggcaacacgggggagacacucggagagaaauggaagaaucggcuuaacgcucugggcaaaucugaauuucaaaucuacaagaaauccgggauccaggagguggaccgcacccuggccaaggaaggaauuaaaagaggcgagaccgaucaucacgcggucagccgggggucugccaagcucagaugguucguggagcgcaaucuggugacaccggaaggaaagguugucgaccuuggcugcggcagagggggauggagcuauuacuguggcgggcugaaaaacgugaaggaggugaaaggacucaccaagggcgggccuggacaugaagaacccauccccauguccacauauggcuggaaucuggucagacugcagucuggcguugauguguucuuuacgccucccgaaaaaugcgacacccuccuuugugauauuggggagagcuccccuaacccgacaguggaggcuggacgcacccugcggguccugaaucucguggaaaacuggcugaauaacaauacacaauucugcaucaagguucuuaaccccuacaugccuagcgugauugagaagauggaagcccugcagagaaaauacggcggggcucucguccgcaauccccugucccggaacucuacccacgagauguauugggugagcaacgccuccggaaauaucguuucuagcgugaacaugaucuccagaaugcugauuaaucgcuuuacgaugcggcacaagaaagcgaccuacgaaccugacgucgaucucggcucugggacaagaaacaucggaauugagagcgagacccccaaucuugacaucauuggcaagcgcaucgagaaaaucaagcaggagcaugaaacauccuggcacuaugaucaggaccauccguacaagaccugggccuaucacggcagcuacgagacaaaacaaaccgggucugcuuccagcauggugaacggagugguccggcugcugacgaagccuugggacguuauucccauggugacacagauggccaugaccgauaccacaccuuucggccagcagagaguguuuaaagaaaaggucgacacgcgcacccaagagcccaaagaggggacaaagaagcucaugaaaaucaccgcugaauggcuguggaaggagcuuggcaaaaagaaaacaccuagaauguguacccgggaagaguucacacgcaaggugagaucuaaugccgcucugggcgccauuuuuaccgaugagaacaaauggaaguccgcgcgggaagccguugaggacagcggguucugggaacucguggauaaggagagaaaucugcaccuggaaggaaaaugcgagacgugugucuauaacaugaugggcaagcgggagaaaaagcucggcgaauuugggaaagcuaagggaucucgcgccaucugguacauguggcugggcgcuagauuccuugaguuugaagcccugggguuccucaaugaggaccauugguuuucccgggaaaacagccuguccggaguggagggcgaggggcuucacaagcugggcuacauucuccgcgauguuagcaaaaaggaaggaggcgccauguaugcggacgauaccgcugggugggacacaagaaucacccuggaggaucugaaaaaugaagagauggugacaaaccauauggaaggagagcacaagaaacucgccgaggccauuuucaagcugaccuaccagaauaaggucgugcggguucagcgccccacgccgagaggcacagugauggacaucaucucucggcgcgaccagagagggagcggacaagucgugaccuauggccuuaacacauucaccaacauggaagcucagcugauucggcagauggagggggaaggcgucuuuaaauccauccaacagcucacggugaaggaggagauugccguuaaaaauuggcugauccgcgugggaagagaacggcuuucucgcauggcuauuagcggcgaugacugcgucgugaagccucuggaugacagauucgccuccgcgcucaccgcccugaacgauauggggaaagugcggaaggacauccagcagugggagcccucuagaggauggaaugauuggacacaaguucccuuuugcagccaucacuuccacgaacugaucaugaaggacggccgcgugcucgucgugccuugucggaaccaggaugagcugauugggagagcucgcaucucccagggagccggcuggucucuucgggaaaccgcuugccuggggaaaagcuacgcccagauguggucccucauguauuuucauagacgcgaccugcggcuugcggccaaugcuauuuguagcgccguuccgucucacuggauccccacauccagaaccacauggagcauucaugcuacccacgaguggaugacgacagaggauaugcugaccguguggaaccgcgucuggauccaagaaaauccuuggauggaggacaagacccccguggaaucuugggaggaaaucccuuaccucggcaaacgggaggaucaguggugcggaucccugauuggccugacaagcagagccaccugggcuaagaacauccagacagccauuaaucagguccgcucccucaucgggaacgaggaauauacggacuacaugcccucuaugaaacgguucagacgggaggaagaggaagcgggagugcugugguga

SEQ ID NO: 20250 - RNA, 9876 nt, Artificial Sequence
  derived and/or modified CDS sequence (opt5) from DENV-2__JN851124__SS-prME
accgccggaaucauuaucaugaugauucccaccgugauggcuuuccaccugacgaccagaaacggggaaccucauaugaucgugucccggcaggaaaagggaaagucccuccuguuuaagacggaaaauggcguuaacaugugcacccuuauggccauggaccugggggaacucugugaagauacaauuaccuacaauugcccgcugcuuaaacaaaacgaacccgaagacaucgauuguuggugcaauucuacaagcaccugggugacguauggaaccuguacagcgaccggcgagcacagacgggaaaagcgguccguggcucuggucccucauguggggaugggacucgagacacgcaccgaaacguggaugucuagcgagggcgccuggaaacacgcccagagaaucgagacauggguuaugcggcaucccggcuucaccgugauggcugccauucuggcuuacacaaucgggaccaccuauuuucagcgcguccugauuuucauccuccugacagccguggcgccuuccaugacgaugagaugcauuggaaucucuaaccgggacuuuguugaaggcgugagcgggggauccugggucgauauugugcuugagcacggcagcugugugaccacaauggccaagaauaagcccacccuggacuucgaacucaucaaaacagaggcuaagcacccugccacccugcgcaaauacugcaucgaagcuaaacuuacgaacacaaccaccgccucuagauguccgacacagggggagcccucccugaaugaggaacaagauaaacgguuugucugcaagcauagcaugguugaccgcggauggggcaacggcugugggcuguucggaaagggcgggauugugaccugcgcgauguuuacaugcaaaaagaauauggagggaaaagugguccagccugaaaaccuggaguauacgaucgugauuacaccccacucuggcgaagagaaugccguugggaacgauacaggaaagcauggcaaagagaucaaggugaccccucaguccagcauuacagaagcugagcugaccggcuacgggacggucaccauggaauguucucccagaacaggacucgacuucaaugagauggugcugcuucagauggaaaacaaagccuggcugguucaccggcaaugguuucucgaucugccgcuuccuuggcugcccggcgcugacacccagggguccaacuggauccagaaggagacacucgugaccuucaagaauccucacgccaaaaagcaggaugucgugguccugggaagccaagagggcgccaugcauacggcucugacaggggcgaccgaaauccagauguccucuggcaaccuccuguuuacaggacaccuuaaaugccgccugagaauggacaagcuccagcugaaaggcaugagcuauuccauguguaccgggaaguucaaggugguuaaagagauugccgaaacccaacauggaacaaucgugauucggguccaguacgagggcgacgggagccccugcaagauccccuucgagauuauggaucuugagaagcggcacgugcugggacgccucaucacgguuaauccuaucgugaccgagaaggacucuccggucaacauugaagcugagcccccuuuuggcgauuccuacaucauuaucgggguggaacccggccagcugaaacugagcugguucaagaagggaucuagcauuggccagauguuugagacaaccaugagaggggccaaaagaauggccauccucggagacacagcuugggauuucggcucccucgggggaguguuuaccucuauuggcaaggcccuucaucaaguuuucggggcgaucuauggcgcugccuuuagcggagucuccuggacgaugaaaauccugauuggcguggugaucacauggauugggaugaauagccgcucuaccucccucagcgucucucuggugcugguuggaguggucacccuuuaccucggcgugaugguucaggccgacuccggguguguggucagcuggaagaacaaagagcugaagugcggauccggcaucuucauuacagauaaugugcacaccuggacagaacaguauaaguuucagccugagucucccagcaaacuggcuuccgccauccaaaaggcucacgaagaggggaucuguggcauucggucuguuacgagacucgaaaaccugauguggaaacagaucaccccggagcuuaaucauauucugagcgagaacgaagugaagaugacaaucaugaccggagacauuaaaggcaucaugcaggccgggaagcgcucccuccggccucagcccacagagcugaaauacagcuggaaggcguggggaaaggccaaaaugcugucuaccgaacuucacaaucauacguuccucaucgauggcccugagaccgcugaaugccccaacacaaauagagccuggaacucccuggaggucgaggacuauggguuuggaguguucaccacaaauauuuggcugaagcucaaagaacgccaagaugugagcugugacucuaagcugauguccgcugccaucaaagacaaccgggcgguccacgccgauaugggcuacuggauugagagcgcucuuaacgacaccuggaagaucgaaaaggccucuuuuauugagguuaaaagcugccacuggccuaagucccauacacuguggagcaauggcgugcucgagucugaaaugaucauccccaaaaacuucgcugggccggugucccagcacaauuauagaccuggauaccauacccagacggccggccccuggcaccuggggcgccuggagauggauuucgacuuuugugaaggaacaaccgucgugguuaccgaggauugcggcaaccgggggcccagccuuagaacaaccacggccuccggaaagcucauuacagaauggugcugucggucuugcacccugccuccgcugcgcuacagaggcgaggacggcuguugguaugggauggagauccggccccucaaagaaaaggaggaaaaucuggugaacagccuugucacagcuggacauggccagauugauaauuucucccugggggugcucggaauggcgcuguuucuggaggaaaugcuuagaacccgcguuggcacaaagcacgccauccuccugguggcugucucuuucgugacccugauuacggggaacaugagcuuucgggaccucggaagaguuauggugauggucggcgccaccaugacagaugacaucggcaugggggugaccuaccuggcccuucuggcugccuucaaagugcgcccuacauuugcggcuggacuccugcugagaaaacuuaccuccaaagagcugaugaugacgacaauuggcaucguccuccugucucaaagcaccauccccgagacaauucucgaacugaccgaugcccuugcccuggggaugaugguucucaagguggugcggaauauggagaaauaucagcuggcugucaccaucauggccauucugugcgugccuaacgcgguuauccuucagaaugcuuggaagguguccuguacaacgcuggccgucgugagcguuucuccccuccugcucaccuccagccaacagaaggccgacuggauuccucuggcucuuacaaucaaaggacugaaccccaccgccaucuuccucacaacccugucucgcacguccaagaaaagaagcuggccgcugaaugaagcuauuauggccgugggcauggucucuauccuugcguccagccugcucaagaacgauauuccuaugacagggccccugguggccggaggccuccugaccgucugcuacgugcuuaccggccgguccgcugaccuggagcuggaacgcgccgcugacguuagaugggaggagcaggccgaaaucagcgggucuagcccuauucucuccaucacaaucucugaggauggaagcauguccauuaaaaaugaagaggaggaacagacccugacaauccuuauucggacgggccugcucgugaucucugggcuguuucccgucagcauuccgaucaccgccgcugcgugguaucucugggaggugaagaaacaacgcgccggaguucugugggacgugccuucucccccucccgucggcaaggcugaacuugaggauggggccuacagaauuaagcagaaaggaauccugggcuauagccagaucggcgccgggguguacaaggaaggaacauuccacaccauguggcaugugacacggggcgcuguucugaugcacaaagggaagcgcauugagcccagcugggccgacgucaaaaaggaucucaucuccuacggaggcggguggaagcuggagggagaauggaaagagggcgaagagguccaggugcuugcgcuggaaccuggcaagaacccgagagcuguccaaaccaaacccgggcucuuuaagacgaacaccggaacaauuggcgccgugagccuggacuucucuccugggaccuccggaagccccaucguugauaaaaagggcaagguggucgggcucuauggaaauggcgugguuacacggucuggcaccuacguguccgccauugcucagacagagaaaagcaucgaggacaacccugaaaucgaggaugacauuuuuagaaagaaacgccugacgaucauggaucuucaucccggggccggaaagaccaaacgguaucugccugcgauugucagagaagcuaucaagcgcggccugcggacacucauucuggccccgaccagagugguugccgcugagauggaagaggcccuucgcgggcugcccauccgguaccagaccccugcuaucagagccgagcacacaggacgcgaaauuguggaccucaugugucaugcgacguucaccaugcggcugcucucccccaucagagucccuaauuauaaccugauuaucauggaugaggcccacuucacagaccccgcuucuauugccgcucggggcuacaucagcacccgcguggaaaugggggaggccgccggcauuuuuaugacagcuaccccgccuggauccagagaccccuucccccagagcaaugcgccuaucauggaugaggaacgggagauccccgaacgcucuuggaacuccggccacgagugggugacggacuuuaaggggaaaacagucugguucguuccuagcauuaaggccggaaaugauaucgcugccugccuucgcaaaaacggcaagaaagugauucaacugucucggaagaccuuugacagcgaauauaucaagaccagaacaaaugauugggacuucguggucaccacagauauuuccgagaugggggccaacuuuaaagcugagcgcgugaucgacccgcggagauguaugaagcccguuauccugaccgauggagaggaacgcgugauucucgccggcccuaugcccgucacgcauucuagcgcggcucagcggagagggcgcgugggccggaauccuaaaaacgaauccgaccaguacaucuacaugggagagccccuggaaaaugaugaggacugcgcccacuggaaggaggccaaaaugcuucuggacaacauuaauacaccggaaggcaucauuccuucuauguucgagcccgaaagagagaagguugaugcuaucgacggggaauaucgccucagaggagaggcccggaaaaccuuuguggaucugaugcgcagaggcgaccugccugucuggcucgcguaccggguggccgcugaggggaucaacuaugccgaucgcagaugguguuucgacggagucaagaacaaucaaauucuugaagagaacguggaaguugagaucuggacaaaggagggcgaacggaaaaagcugaaacccagauggcuggaugcucgcauuuacagcgacccucucgcccugaaggaguuuaaagaguucgcugccgggcggaagucccuuacccugaaucucaucacggagaugggcagacugcccaccuucaugacacagaaggcgcgcaacgcccuggauaaucucgcugugcuucauaccgccgaagcuggaggccgggccuauaaccacgcccugagcgagcugccggagacacucgaaacccugcuucugcucacacugcuggcuaccgugacagggggaauuuuucucuuccuuaugucuggcaaagggaucggaaagaugacacugggcaugugcugcauuaucaccgcguccauccugcucugguacgcccagauucagccucacuggaucgcugccagcauuauccuggaguuuuuccuuauuguccugcucauccccgaacccgagaaacaaagaaccccucaggacaaucagcugacauauguugugaucgccauucugaccguggucgcugccacaauggcgaacgaaaugggcuuucucgagaagacgaaaaaggauuucgggcuuggauccucuaccacacagcaacaugagagcaauauccuggacauugaucugcggccggccuccgcuuggacccucuacgccguggcuacaaccuuuaucacgcccaugcugcgccacucuauugaaaacagcuccguuaaugugagccuuaccgccaucgcgaaccaggccacaguccugaugggccucgggaagggauggccucugucuaaaauggacaucggcgugccccugcucgcuauuggguguuacucccaggucaauccuaucacccuuacagccgcucugcugagccucguggcccauuaugcuauuaucggacccggccugcaggccaaggcgaccagagaggcccaaaaacgggcugccgcuggcauuaugaagaacccuacgguugacgggaucacagugauugaucuugacccgauccccuacgauccuaaauucgaaaagcagcugggacaggucaugcuccuggugcugugcguuacccaggugcucaugaugcgcacaaccugggcccuuugugaggcccugacccuggcgacaggccccaucucuacgcucugggaagggaauccuggaagauuuuggaacaccacaauugcugucuccauggccaauaucuuccggggcagcuaucuggcuggggccggacuucuguuuucuauuaugaagaacaccgccaacacacgcagaggcaccggcaauacgggggagacacucggagagaaauggaagaaccggcugaaugcucugggcaaaagcgaguuccaaaucuacaagaaauccgggauucaggagguggaccgcacccucgccaaggaaggaaucaaaagaggcgagaccgaucaccaugcggugucucgggggagcgccaaacuuagaugguuuguugagcgcaaccuggucacacccgaaggaaaggugguggaccugggcugcggcagagggggaugguccuauuacuguggcgggcucaaaaaugucaaggagguuaaaggacugaccaagggcgggccgggacacgaagaaccuauccccaugagcacauauggcuggaaccuugugagacugcaguccggcguggaugucuucuucacgcccccugaaaaaugcgacacccuccugugugauauuggggagucuagccccaauccuacaguggaggcuggacgcacccugcggguucucaaccuuguggaaaauuggcugaacaauaacacacaauuuugcaucaagguccugaauccguacaugcccuccgugauugagaagauggaagcccuccagagaaaauacggcggggcucugguucgcaacccucuuucucggaauagcacccacgagauguauuggguguccaacgccucuggaaacaucgucagcuccgugaauaugauuagcagaaugcugaucaaccgcuucacgaugcggcauaagaaagugaccuacgaacccgacgucgaucucggcucugggacaagaaauaucggaauugaguccgagaccccuaaccuggacaucauuggcaagcgcaucgagaagauuaagcaggagcacgaaacaagcuggcauuaugaucaggaccaccccuacaagaccugggcguaucacggcucuuacgagacaaaacaaaccggguccgccagcucuaugguuaauggaguggugcggcugcucacgaagccgugggacgucaucccuauggugacacagauggcuaugaccgauaccacacccuuuggccagcagagaguuuucaaagaaaagguggacacgcgcacccaagagccuaaagaggggacaaagaaacuuaugaaaaucaccgccgaauggcuguggaaggagcugggcaagaagaaaacacccagaauguguacccgggaagaguuuacacgcaaggucagauccaacgcugcccucggcgcuauuuucaccgaugagaauaaauggaaaagcgcccgggaagcgguggaggacuccggguuuugggaacugguugauaaggagagaaaccuucaucuggaaggaaagugcgagacguguguguauaauaugaugggcaagcgggagaaaaagcucggcgaguucgggaaagccaagggaagccgcgcuaucugguacauguggcugggcgccagauuucuggaguucgaagcucucggguuucugaacgaggaccacugguucucucgggaaaauagccuuuccggagucgagggcgaggggcugcauaagcucggcuacauucugcgcgaugugucuaaaaaggaaggaggcgccauguaugccgacgauaccgcggggugggacacaagaaucacccuugaggaucugaaaaacgaagagaugguuacaaaucacauggaaggagagcauaagaaacucgcugaggccauuuuuaagcugaccuaccagaacaaggugguccgggugcagcgcccuacgcccagaggcacagucauggacaucauuagccggcgcgaccagagaggguccggacaagugguuaccuauggccugaauacauucaccaacauggaagcccagcucauccggcagauggagggggaaggcguguucaaaucuauccaacagcugacggcuaccgaggagauugccgucaagaacuggcuugugcgcgugggaagagaacggcugagccgcauggcuaucuccggcgaugacugcguugugaaaccgcucgaugacagauuugccucugcgcugacagcccuuaaugauauggggaagguccggaaagacauucagcagugggagccuagcagaggauggaacgauuggacccaagugcccuucugcucccaccacuuucaugaacugaucaugaaggacggccgcguucucgugguccccugucggaaucaggaugagcugauugggagagcucgcaucagccagggagccggcuggucucugcgggaaacagcuugccucgggaaguccuacgcccagauguggagccugauguauuuccacagacgcgaccuucggcuggcggccaacgcuaucuguucugccgugccuucccauugggucccgaccagcagaacaaccugguccauucacgcuacgcacgaguggaugacaaccgaggauaugcucaccguguggaaucgcguuuggauccaagaaaaccccuggauggaggacaaaacaccuguggaaucuugggaggaaauucccuaccugggcaagcgggaggaucaguggugcggaagccuuaucggccugaccuccagagccacaugggcuaaaaauauucagacggccaucaaccagguccgcagccucaucgggaaugaggaauauaccgacuacaugccuucuaugaagcgguuuagacgggaggaagaggaagcgggagugcugugguga

SEQ ID NO: 20251 - RNA, 9876 nt, Artificial Sequence
  derived and/or modified CDS sequence (opt5) from DENV-2__JN851114__SS-prME
accgccggaaucauuaucaugaugauucccaccgugauggcuuuccaccugacgaccagaaacggggaaccucauaugaucgucagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguugaaaaagcugagcuggaagauggcgccuaccggaucaagcagaaggggauucucggauauucccagaucggcgccggcguguacaaagaggggacauuucacaccauguggcaugucacacgcggagcugugcugaugcacaagggcaaaagaauugagcccuccugggccgacgugaagaaagaucuuaucagcuacgggggaggcuggaagcuggaaggggaguggaaggaaggagaggaaguucagguccucgcgcuggagccuggcaaaaacccgcgggcugugcaaaccaagcccggccucuucaaaacgaacaccgggacaauuggagccgugucccuggacuuuagcccuggcaccucugggucccccaucgucgauaagaaaggaaaggugguuggccuuuaugggaauggaguggucacaagaagcggcaccuacgugucugccaucgcucagacagagaaguccauugaagacaacccugagaucgaagaugacauuuuccgcaaaaagcggcugacgaucauggaucugcaucccggcgccgggaaaaccaagagauaucucccugcgauuguucgcgaggcuaucaaacggggacugagaacacuuauccuggccccgacccgcguggucgccgcugaaauggaggaggcccuccggggccugcccauuagauaccagaccccugcuauccgcgccgaacacacagggcgggagauuguggaccucaugugucaugcgacguucaccaugagacugcuuagccccauccggguuccuaauuauaaccugauuaucauggaugaagcccacuuuacagaccccgcuuccauugccgcucgcggauacaucucuaccagaguggagaugggcgaggccgccgggaucuucaugacagcuaccccgccuggcagccgggaccccuuuccccaguccaaugcgccuauuauggaugaagaacgcgaaauccccgagagaagcuggaacucuggacacgaaugggucacggacuucaagggcaagacagugugguuugugccuuccauuaaagccgggaaugauaucgcugccugccugcggaagaacggcaaaaaggucauucaacucagcagaaaaaccuucgacucugaguauaucaagacccgcacaaaugauugggacuuuguugugaccacagauaucagcgagaugggcgccaacuucaaggcugaacgggugauugacccgagacgcuguaugaaacccgucauccugaccgauggggaggaacgggugauucuugccggaccuaugcccguuacgcauuccucugcggcucagagacgcggccggguggggagaaauccuaagaacgagaaugaccaguacaucuacaugggcgaaccccuggagaacgaugaggacugcgcccacuggaaagaagccaagaugcuccuggacaauauuaacacaccggagggaaucaucccuagcauguuugaacccgagcgcgaaaaagucgaugcuauugacggcgaguauagacugcgcggggaagcccggaagaccuucguggaucucaugagacggggagaccuuccuguuuggcuggcguaccgcguggccgcugaaggcaucaacuaugccgauagacggugguguuuugacggggucaaaaauaaccaaauucuggaggaaaauguggaggucgagaucuggacaaaggaaggagagagaaagaaacucaagccccgcuggcuggaugcucggauuuacuccgacccucuugcccugaaagaguucaaggaguucgcugccggcagaaaaucucucacccugaaccugaucacggaaauggggcgccuccccaccuuuaugacacagaaggcgaagaaugcccuugauaaccuggcugugcugcauaccgccgaggcuggcggacgggccuauaaucacgcccucagcgagcugccggaaacacuugagacccugcuccugcugacacuccuugcuaccguuacgggcgggauuuuccuguuucugauguccggaaaaggcaucgggaagaugacacucggaaugugcugcaucauuaccgcgagcauccugcuuugguacgcccagauucagccucacuggaucgcugccucuauuauccuggaguucuuucucaucgugcugcugauucccgagcccgaaaaacaaagaaccccucaggacaaccagcucacauauguggucaucgccauucuuaccguuguggcugccacaauggcgaaugagaugggcuuccuggagaagacgaaaaaggauuuuggccugggguccaucaccacacagcaaccggaaagcaacauucucgacaucgaucugcggcccgccuccgcuuggacccuuuacgccguggcuacaaccuucaucacgccuaugcugcgccauucuauugagaauagcuccgucaacgugucucucaccgccaucgcgaaucaggccacaguucugaugggacugggcaagggguggccccucagcaaaauggacauuggagugccucuucuggcuaucggcuguuacucccaggucaaccccauuacccugacagccgcucuccugcuucugguggcccacuaugcuaucauugggccuggacuccaggccaaggcgaccagagaagcccaaaaacgggcugccgcuggcaucaugaagaauccgacggucgacggcaugacagugaucgaucuggaccccauuccuuacgaucccaaauuugagaagcagcuggggcagguuaugcuccuugugcugugcgucacccaggugcugaugaugcgcacaaccugggcccucugugaagcccugacccuugcgacaggaccuaucagcacgcugugggagggcaaccccgggagauucuggaauaccacaauugcuguuucuauggccaacaucuuucggggauccuaucucgcuggcgccgggcugcuguucagcauuaugaagaacaccgccaauacacgcagaggaaccggcaacacgggcgagacacucggggaaaaauggaagaaucggcuuaacgcucugggaaaaucugaguuucaaaucuacaagaaauccggcauccaggaaguggaccgcacccuggccaaggaggggauuaaaagaggagagaccgaucaucacgcggucagccggggcucugccaagcucagaugguucguggaacgcaaucuggugacaccggaggggaagguugucgaccuuggaugcggccggggcggguggagcuauuacuguggaggccugaaaaacgugaaggaagugaaagggcucaccaagggaggcccugggcaugaggaacccauccccauguccacauauggauggaaucuggucagacugcagucuggcguugauguguucuuuacgccucccgagaaaugcgacacccuccuuugugauauuggcgagagcuccccuaacccgacaguggaagcugggcgcacccugcggguccugaaucucguggagaacuggcugaauaacaauacacaauucugcaucaagguucuuaaccccuacaugccuagcgugauugaaaagauggaggcccugcagagaaaauacggaggcgcucucguccgcaauccccugucccggaacucuacccacgaaauguauugggugagcaacgccuccgggaauaucguuucuagcgugaacaugaucuccagaaugcugauuaaucgcuuuacgaugcggcacaagaaagcgaccuacgagccugacgucgaucucggaucuggcacaagaaacaucgggauugagagcgaaacccccaaucuugacaucauuggaaagcgcaucgagaaaaucaagcaggaacaugagacauccuggcacuaugaucaggaccauccguacaagaccugggccuaucacggcagcuacgaaacaaaacaaaccggcucugcuuccagcauggugaacggggugguccggcugcugacgaagccuugggacguuauucccauggugacacagauggccaugaccgauaccacaccuuucggacagcagagaguguuuaaagagaaggucgacacgcgcacccaagagcccaaagaaggcacaaagaagcucaugaaaaucaccgcugaguggcuguggaaggaacuugggaaaaagaaaacaccuagaauguguacccgggaggaguucacacgcaaggugagaucuaaugccgcucugggagccauuuuuaccgaugaaaacaaauggaaguccgcgcgggaggccguugaagacagcggcuucugggagcucguggauaaggaaagaaaucugcaccuggaggggaaaugcgagacgugugucuauaacaugaugggaaagcgggagaaaaagcucggcgaguuuggcaaagcuaaggggucucgcgccaucugguacauguggcugggagcuagauuccuugaauuugaggcccugggcuuccucaaugaagaccauugguuuucccgggagaacagccuguccgggguggagggagaaggccuucacaagcugggguacauucuccgcgauguuagcaaaaaggagggcggagccauguaugcggacgauaccgcuggcugggacacaagaaucacccuggaagaucugaaaaaugaggaaauggugacaaaccauauggagggggagcacaagaaacucgccgaagccauuuucaagcugaccuaccagaauaaggucgugcggguucagcgccccacgccgagaggaacagugauggacaucaucucucggcgcgaccagagaggcagcgggcaagucgugaccuauggacuuaacacauucaccaacauggaggcucagcugauucggcagauggaaggcgagggggucuuuaaauccauccaacagcucacggugaaggaggaaauugccguuaaaaauuggcugauccgcgugggcagagagcggcuuucucgcauggcuauuagcggagaugacugcgucgugaagccucuggaugacagauucgccuccgcgcucaccgcccugaacgauaugggcaaagugcggaaggacauccagcagugggaacccucuagaggguggaaugauuggacacaaguucccuuuugcagccaucacuuccacgagcugaucaugaaggacggacgcgugcucgucgugccuugucggaaccaggaugaacugauuggcagagcucgcaucucccagggggccggauggucucuucgggagaccgcuugccugggcaaaagcuacgcccagauguggucccucauguauuuucauagacgcgaccugcggcuugcggccaaugcuauuuguagcgccguuccgucucacugggugcccacauccagaaccacauggagcauccaugcuacccacgaguggaugacgacagaagauaugcugaccgucuggaaccgcguguggauucaagagaauccuuggauggaagacaagacccccgucgagucuugggaagagaucccuuaccucgggaaacgggaggaucaguggugcggcucccugaucggacugacaagcagagccaccugggcuaagaacauucagacagccaucaaucaggugcgcucccucauuggcaacgaagaguauacggacuacaugcccucuaugaaacgguucagacgggaagaggaagaggcggggguucugugguga

SEQ ID NO: 20252 - RNA, 9876 nt, Artificial Sequence
  derived and/or modified CDS sequence (opt5) from DENV-2__JN851126__SS-prME
accgccggaaucauuaucaugaugauucccaccgugauggcuuuccaccugacgaccagaaacggggaaccucauaugaucgucagccggcaggaaaagggaaaaagccuccuguuuaagacggagaauggcguuaacaugugcacccuuauggccauggaccugggggaacucugugaggauacaauuaccuacaauugcccgcugcuuaaacaaaacgaacccgaggacaucgauuguuggugcaauucuacaagcaccugggugacguauggaaccuguacagcgaccggcgagcaccgcagagaaaagcgguccguggcucuggucccucauguggggaugggacucgagacacgcaccgaaacguggaugucuagcgagggcgccuggaaacacgcccagagaaucgagacauggguucugcggcaucccggcuucaccauuauggcugccauccuggcuuacacaauugggaccaccuauuuucagcgcgugcucaucuucauucugcuuacagccgucgcgccuuccaugacgaugagaugcaucggaauuucuaaccgggacuuuguggaaggcguuagcgggggauccuggguggauaucguccuggagcacggcagcugugugaccacaauggccaagaauaagcccacccucgacuucgaacugaucaaaacagaggcuaagcacccugccacccuucgcaaauacugcauugaagcuaagcugacgaacacaaccaccgccucuagauguccgacacagggggagcccucccucaaugaggaacaagauaaacgguuugugugcaagcauagcauggucgaccgcggauggggcaacggcugugggcuguucggaaagggcgggaucguuaccugcgcgauguuuacaugcaaaaagaauauggagggaaaaauugugcagccugaaaaccuggaguauacgaucgugauuacaccccacucuggcgaagagaaugccgucgggaacgauacaggaaagcauggcaaagagaucaaggugaccccucaguccagcaucacagaagcugagcucaccggcuacgggacgguuaccauggaauguucucccagaacaggacuggacuucaaugagauggugcuucugcagauggaaaacaaagccuggcucguccaccggcaaugguuucuggaucuuccgcugccuuggcuccccggcgcugacacccagggguccaacuggauucagaaggagacacuggugaccuucaagaauccucacgccaaaaagcaggauguugugguccugggaagccaagagggcgccaugcauacggcucucacaggggcgaccgaaauccagauguccucuggcaaccugcuuuuuacaggacaccugaaaugccgccucagaauggacaagcugcagcuuaaaggcaugagcuauuccauguguaccgggaaguucaagguggucaaagagauugccgaaacccaacauggaacaaucgugauucggguucaguacgagggcgacgggagccccugcaagauccccuucgagaucauggaucuggagaagcggcacgugcucggacgccugauuacggucaauccuaucgugaccgagaaggacucuccgguuaacauugaagcugagcccccuuuuggcgauuccuacaucauuaucgggguggaacccggccagcugaaacucagcugguucaagaagggaucuagcauuggccagauguuugagacaaccaugagaggggccaaaagaauggccauccugggagacacagcuugggauuucggcucccuugggggagucuuuaccucuaucggcaaggcccugcaucaaguguucggggcgauuuauggcgcugccuuuagcggaguguccuggacgaugaaaauccucauuggcguugucaucacauggauugggaugaauagccgcucuaccucccugagcgugucucuggugcuugucggagugguuacccucuaccugggcgugaugguccaggccgacuccgggugugugguuagcuggaagaacaaagagcugaagugcggauccggcaucuucaucacagauaaugugcacaccuggacagaacaguauaaguuucagccugagucucccagcaaacucgcuuccgccauucaaaaggcucacgaagaggggaucuguggcauucggucugucacgagacuggaaaaccuuauguggaaacagaucaccccggagcugaaucauauucucagcgagaacgaaaucaagcugacaaucaugaccggagacauuaaaggcaucaugcaggccgggaagcgcucccugcggccucagcccacagagcuuaaauacagcuggaaggcguggggaaaggccaaaaugcucucuaccgaacugcacaaucauacguuccugauugauggcccugagaccgcugaaugccccaacacaaauagagccuggaacucccucgagguggaggacuauggguuuggaguuuucaccacaaauaucuggcugaaacuuaaagaacgccaagauguguuuugugacagcaagcugaugucugcugccauuaaagacaaccgggcgguccacgccgauaugggcuacuggaucgaguccgcucucaacgacaccuggaagaucgaaaaggccagcuucauugaggugaaaucuugccacuggccuaagagccauacacugugguccaauggcgugcuggagagcgaaaugaucauucccaaaaacuucgcugggccggucucucagcacaauuauagaccuggauaccauacccagacggccggccccuggcaccuugggcgccucgagauggauuuugacuucugugaaggaacaaccguuguggugaccgaggauugcggcaaccgggggcccucccugagaacaaccacggccagcggaaagcugaucacagaauggugcugucgguccugcacccucccuccgcugcgcuacagaggcgaggacggcuguugguaugggauggagauucggccccuuaaagaaaaggaggaaaaucuggucaacucucucgugacagcuggacauggccagaucgauaauuuuagccuggggguucugggaauggcgcuuuuccucgaggaaaugcugagaacccgcgugggcacaaagcacaccauucugcucgucgccguguccuuuguuacgcugaucaccgggaacaugucuuuccgggaccuuggaagaguggucgugaugguuggcgcuacaaugaccgaugacaucggcaugggggugacauaccuggcccuccuggccgcuuuuaaaguccgcccuaccuucgccgcgggacugcuucugagaaagcucacgagcaaagagcugaugaugacaaccauuggcaucgugcuccugucccaaucuacaauucccgagaccauccuugaacugaccgaugcucucgcccuggggaugauggugcugaagauuguccggaauauggagaaauaucagcuugccguuacaaucauggcuauccugugcgugccuaacgccgugauucuccagaaugcguggaaggucagcuguacggcucuggccgugguuuccgugagcccccuccugcuuaccucuucccaacagaaggccgacuggaucccucuggcucucacaauuaaaggacugaaccccaccgccaucuuucugacaacccuuagccgcacgucuaagaaaagauccuggccgcugaaugaagcuauuauggccgucggcauggugagcauccucgcgucuucccugcucaagaacgauaucccuaugacagggccccugguugccggaggccuucugaccgugugcuacguccugaccggccggagcgcugaccucgagcuggaacgcgccgcugacgugagaugggaggagcaggccgaaauuuccgggagcucuccuauccuuagcauuacaaucuccgaggauggaucuaugagcauuaaaaaugaagaggaggaacagacccugacaauccucauucggacgggccugcucgucaucuccgggcuguuccccgugucuaucccgauuaccgccgcugcgugguaucuuugggagguuaagaaacaacgcgccggagugcugugggacgucccuucucccccucccgugggcaaggcugaacuggaggauggggccuacagaaucaagcagaaaggcauucucggcuauucccagaucggcgccgggguuuacaaggaaggaacauuucacaccauguggcaugugacacggggcgcuguccugaugcacaaagggaagcgcauugagcccuccugggccgacgugaaaaaggaucuuaucagcuacggaggcggguggaagcuggagggagaauggaaagagggcgaagaggugcagguucucgcgcuggaaccuggcaagaacccgagagcuguccaaaccaaacccggacucuucaagacgaacaccggaacaaucggcgccgugucccuggacuuuagcccugggaccucuggaucccccauuguggauaaaaagggcaaggucguggggcuuuauggaaauggcguugugacacggagcggcaccuacgucucugccaucgcucagacagagaaauccauugaggacaacccugaaaucgaggaugacauuuucagaaagaaacgccugacgaucauggaucugcaucccggggccggaaagaccaaacgguaucucccugcgaucgugagagaagcuauuaagcgcggccugcggacacuuauccuggccccgaccagaguuguggccgcugagauggaagaggcccuccgcgggcugcccauucgguaccagaccccugcuaucagagccgagcacacaggacgcgaaauugucgaccucaugugucaugcgacguucaccaugcggcugcuuagccccaucagagugccuaauuauaaccugauuaucauggaugaggcccacuuuacagaccccgcuuccaucgccgcucggggcuacauuucuacccgcguugaaaugggggaggccgccggcaucuucaugacagcuaccccgccuggaagcagagaccccuuuccccaguccaaugcgccuauuauggaugaggaaaaggagauccccgaacggagcuggaacucuggccacgagugggugacggacuucaaagggaagacagucugguuugugccuuccauuaaagccggaaaugauaucgcugccugccugcgcaagaacggcaaaaaggugauccaacucagcagaaagaccuucgacucugaauauauuaaaacccggacaaaugauugggacuuugucguuaccacagauaucagcgagaugggggccaacuucaaggcugagagagugauugacccgcgccggugugugaaacccgucauccugaccgauggagaagagagagugauucuugccggcccuaugcccguuacgcauuccucugcggcucagcgccgggggagagugggccgcaauccuaagaacgaaaaugaccaguacaucuacaugggagagccccuggaaaacgaugaggacugcgcccacuggaaagaggccaagaugcuccuggacaauaucaacacaccggaaggcauuaucccuagcauguuugagcccgaacgggagaaagucgaugcuauugacggggaauauagacugcgcggagaggccagaaagaccuucguggaucucaugcggcgcggcgaccuuccuguuuggcuggcguacagaguggccgcugaggggaucaacuaugccgaucggcgcugguguuuugacggagucaagaauaaccaaauucuggaagagaauguggaagucgagaucuggacaaaagagggcgaaagaaagaaacucaagccccgguggcuggaugcuagaauuuacuccgacccucuugcccugaaagaguucaaggaguucgcugccgggcgcaagucucucacccugaaccugaucacggagaugggccggcuccccaccuuuaugacacagaaagcgagaaaugcccuugauaaccuggcugugcugcauaccgccgaagcuggaggccgcgccuauaaucacgcccucagcgagcugccggagacacuugaaacccugcuccugcugacacuccuugcuaccguuacaggcgggaucuuccuguuucugauguccgggaaggggauuggaaaaaugacacucggcaugugcugcaucauuaccgcgagcauccugcuuugguacgcccagauucagccucacuggaucgcugccucuaucauucuggaguucuuucucaucgugcugcugauucccgaacccgagaagcaacggaccccucaggacaaccagcucacauauguggucaucgccauucuuaccguuguggcugccacaauggcgaaugaaaugggcuuccuggagaaaacgaagaaggauuuugggcugggauccaucaccacacagcaaccggagagcaacauccucgacauugaucugagacccgccuccgcuuggacccuuuacgccguggcuacaaccuucaucacgccuaugcugcggcauucuauugaaaauagcuccgucaacgugucucucaccgccaucgcgaaucaggccacaguucugaugggccuggggaaaggauggccccucagcaagauggacauuggcgugccucuucuggcuaucggguguuacucccaggucaaccccauuacccugacagccgcucuccugcuucugguggcccacuaugcuaucaucggaccuggccuccaggccaaagcgacccgcgaggcccaaaagagagcugccgcuggcauuaugaaaaauccgacggucgacgggaucacagugauugaucuggaccccaucccuuacgaucccaaguuugaaaagcagcugggacagguuaugcuccuugugcugugcgucacccaggugcugaugaugcggacaaccugggcccucugugaggcccugacccuugcgacaggcccuauuagcacgcugugggaagggaaccccggacgcuucuggaauaccacaaucgcuguuucuauggccaacaucuuuagaggcuccuaucucgcuggggccggacugcuguucagcauuaugaaaaacaccgccaauacacggcgcggcaccggcaacacgggggagacacucggagagaaguggaaaaauagacuuaacgcucugggcaagucugaauuucaaaccuacaaaaaguccgggauccaggagguggaccggacccuggccaaagaaggaauuaagcgcggcgagacagaucaucacgcggucagcagagggucugccaagcuccggugguucguggagagaaaucuggugaccccggaaggaaaaguugucgaccuuggcugcggccgcgggggauggagcuauuacuguggcgggcugaagaacgugaaagaggugaagggacucacaaaaggcgggccuggacaugaagaacccauccccauguccacguauggcuggaaucugguccggcugcagucuggcguugauguguucuuuaccccucccgaaaagugcgacacacuccuuugugauauuggggagagcuccccuaacccgaccguggaggcuggaagaacacugcgcguccugaaucucguggaaaacuggcugaauaacaauacccaauucugcaucaagguucuuaaccccuacaugccuagcgugaucgagaaaauggaaacgcugcagcggaagcacggcggggcccucgucagaaauccccugucccgcaacucuacccacgagauguacugggugagcaacgcuuccggaaauauuguuucuagcgugaacaugaucucccggaugcugauuaauagauuuacaaugcgccauaaaaaggccaccuaugaaccugacgucgaucucggcucugggacacggaacaucggaauugagagcgagacccccaaucuugacaucaucggcaaaagaauugaaaagaucaagcaggagcacgaaacauccuggcauuacgaucaggaccacccguauaaaaccugggcguaccacggcagcuaugagacgaagcaaacagggucugccuccagcauggugaacggagugguccgccugcugaccaaaccuugggacguuauucccauggugacccagauggcuaugacagauacgaccccuuucggccagcagcggguguuuaaggaaaaagucgacacaagaacccaagagcccaaggaggggacaaagaaacucaugaagaucaccgccgaauggcuguggaaagagcuuggaaagaaaaagacaccucgcauguguaccagagaagaguucacgcggaaagugcgcucuaaugcugcccugggcgcuauuuuuaccgaugagaacaaguggaaguccgccagagaagcgguugaggacagccgguucugggaacucguggauaaagagagaaaucugcaucuggaagggaagugcgagacaugugucuacaacaugaugggaaaacgggagaagaaacucggcgaauuuggcaaggccaaggggucucgcgcuaucugguauauguggcugggagccagauuccuugaguuugaagcucugggcuuccucaaugaggaccacugguuuucccgggaaaacagccuguccgggguggagggagagggccuucauaaacugggguacauucuccgcgauguuagcaagaaagaaggcggagccauguacgccgacgauaccgcgggcugggacacaagaaucacccuggaggaucugaagaaugaagagauggugacgaaccacauggaaggggagcauaaaaagcucgcugaggccaucuuccggcugacauaucagaauaaggucgugcgcguucagagacccaccccgcggggaacagugauggacauuaucucucgcagagaccagcggggcagcgggcaagucgugaccuacggacuuaacacguucaccaacauggaagcccagcugauucgccagauggagggcgaaggggucuuuaaauccauccaacaccucacagugaccgaggagauugcuguuaagaauuggcuggugagagucggccgggaacgccuuucuagaauggccaucagcggagaugacugcguggugaaaccucuggaugaccgguucgcuuccgcccucacagcgcugaacgauaugggcaagguuagaaaagacauccagcagugggagcccucucgcggguggaaugauuggacccaggugcccuuuugcagccaccauuuccacgaacugauuaugaaggacggacggguccucgugguuccuuguagaaaccaagaugagcugaucggccgcgcccggauuucccagggggcuggauggucucuuagagaaacagccugccugggcaagagcuaugcucagauguggucccucauguacuuucaucgccgggaccugagacuugccgcgaaugccaucuguagcgcugugccgucucacuggguccccaccucccgcacgacauggagcauucacgccacccaugaguggaugaccacagaggauaugcugaccguguggaaccgggucuggauccaggaaaauccuuggauggaggacaaaacacccguggaaucuugggaggaaaucccuuaucucgggaagagagaggaucaauggugcggcucccugauuggacugacgagccgcgcuaccugggccaaaaacauccagacagcuauuaaucagguucggucccucaucggcaacgaggaauacaccgacuauaugcccucuaugaagagauuccggagagaggaagaggaagccggggugcugugguga

SEQ ID NO: 20253 - RNA, 9876 nt, Artificial Sequence
  derived and/or modified CDS sequence (opt5) from DENV-2__JN851121__SS-prME
accgccggaaucauuaucaugaugauucccaccgugauggcuuuccaccugacgaccagaaacggggagccucauaugaucgugagccggcaggaaaagggaaaaagccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgccaugguccaggcugacuccgggugugugguuagcuggaaaaacaaggagcugaaaugcggauccggcauuuucaucacagauaaugugcacaccuggacagaacaguauaaguuucagccugagucucccagcaagcucgccuccgcuauccaaaaagcccacgaagaggggauuuguggcaucagaucugucacgcgccuggaaaaccuuauguggaagcagauuaccccggagcugaaucauauccucacagagaacgaagugaaacugaccauuaugacaggagacaucaagggcaucaugcaggcggggaaacggagccugagaccucagcccaccgagcuuaaguacuccuggaaagccuggggaaaggcuaagaugcucagcacggaacugcacaaucauaccuuccugauugauggcccugagacagccgaaugccccaacaccaaucgcgcuuggaacucucucgagguugaggacuauggguuuggaguguucacaaccaauaucuggcugaaacuuaaggaacggcaagaugucuuuugugacuccaaacugaugagcgccgcgauuaaggacaacagagccgugcacgcugauaugggcuacuggaucgagucugcccucaacgacacauggaaaauugaaaaggcuuccuucaucgaggucaagagcugccacuggccuaaaucucauacccuguggagcaauggcguccuggaguccgaaaugaucauucccaagaacuucgccgggccgguuagccagcacaauuaucgcccuggauaccauacgcagacagccggccccuggcaccuugggcggcucgagauggauuuugacuucugugaaggaaccaccgugguggucacagaggauugcggcaacagagggcccucucugcggaccacgacagcuuccggaaaacugaucaccgaauggugcugucgcagcugcacacucccuccgcugagauaccggggcgaggacggcuguugguaugggauggagauuagaccccuuaaggaaaaagaggaaaaucuggugaacucccucguuaccgcgggacauggccagaucgauaauuuuucucugggggugcugggaauggcccuuuuccucgaggaaaugcugcgcacacgggucggcaccaagcacgcuauucugcucguggccguuagcuuugugacgcugaucaccgggaacauguccuucagagaccuuggacgcgucauggugaugguuggcgccacaaugaccgaugacauuggcaugggggugacauaccuggcucuccuggccgcguuuaaggucagaccuaccuucgcugccggacugcuucugcggaaacucacgucuaaggagcugaugaugacaaccaucggcaucgugcuccugagccaauccacaauucccgagucuauccuugaacugaccgaugcccucgcucuggggaugauggugcugaaaauuguccgcaauauggagaaguaucagcuugccguuaccaucauggcgauucugugcgugccuaacgcugugauccuccagaaugccuggaaagucagcuguacaacgcuggccgugguuuccgugagcccccuccugcuuaccucuucccaacagaaggcugacuggaucccucuggcccucacaauuaagggacugaaccccaccgcuaucuuucugacaacccuuagcagaacgucuaaaaagcgguccuggccgcugaaugaagccauuauggcggucggcauggugagcauccucgccucuucccugcucaaaaacgauauuccuaugacagggccccugguugcuggaggccuucugaccgugugcuacguccugaccggccgcagcgccgaccucgagcuggaaagagcugccgacgugcggugggaggagcaggccgaaaucuccgggagcucuccuauccuuagcauuacaaucuccgaggauggaucuaugagcauuaagaaugaagaggaggaacagacccugacaauccucauucgcacgggccugcucgucaucuccgggcuguuccccgugucuauuccgaucaccgcugcggccugguaucuuugggagguuaaaaagcaaagagcuggagugcugugggacgucccuucucccccucccgugggcaaagccgaacuggaggauggggccuaccggaucaagcagaagggcauucucggcuauucccagaucggcgcugggguuuacaaagaaggaacauuucacaccauguggcaugugacacgcggcgccguccugaugcacaaggggaaaagaauugagcccuccugggcggacgugaagaaagaucuuaucagcuacggaggcggguggaagcuggagggagaauggaaggagggcgaagaggugcagguucucgcucuggaaccuggcaaaaacccgcgggccguccaaaccaagcccggacucuucaaaacgaacaccggaacaauuggcgccgugucccuggacuuuagcccugggaccucuggaucccccaucguggauaagaaaggcaaggucguggggcuuuauggaaauggcguugugacaagaagcggcaccuacgucucugcuaucgcccagacagagaaguccauugaggacaacccugaaaucgaggaugacauuuuccgcaaaaagcggcugacgaucauggaucugcaucccggggcgggaaaaaccaagagauaucucccugcuauugugcgcgaagccaucaaacggggccugagaacacuuauccuggccccgacccgcguuguggcugccgagauggaagaggcucuccgggggcugcccauuagauaccagaccccugccauccgcgcggagcacacaggacgggaaauugucgaccucaugugucaugccacguucaccaugagacugcuuagccccauccgggugccuaauuauaaccugauuaucauggaugaggcucacuuuacagaccccgccuccauugcugcccgcggcuacaucucuaccagaguugaaaugggggaggccgcuggcaucuucaugacagcgaccccgccuggaagccgggaccccuuuccccaguccaaugccccuauuauggaugaggaacgcgagauccccgaaagaagcuggaacucuggccacgagugggugacggacuucaaggggaagacagucugguuugugccuuccauuaaagcuggaaaugauaucgccgccugccugcggaagaacggcaaaaaggugauucaacucagcagaaaaaccuucgacucugaauauaucaagacccgcacaaaugauugggacuuugucguuaccacagauaucagcgagaugggggcuaacuucaaggccgagcgggugauugacccgagacgcuguaugaaacccgugauccugaccgauggagaagaacgggucauucuugcgggcccuaugcccgugacgcauuccucugcugcccagagacgcgggcggguuggcagaaauccuaagaacgaaaaugaccaguacaucuacaugggagagccccuggaaaacgaugaggacugcgcccacuggaaagaggcuaagaugcuccuggacaauauuaacacaccggaaggcaucaucccuagcauguuugagcccgaacgcgagaaaguggaugccauugacggggaauauagacugcggggagaggcgcgcaagaccuucgucgaucucaugagacggggcgaccuuccuguguggcuggccuaccgcguugcugccgaggggaucaacuaugcugauagacggugguguuuugacggagugaaaaauaaccaaauucuggaagagaaugucgaaguggagaucuggacaaaggagggcgaaagaaagaaacucaagccccgcuggcuggaugcccggauuuacuccgacccucuugcucugaaagaguucaaggaguucgccgcggggagaaaaucucucacccugaaccugaucacggagaugggccgccuccccaccuuuaugacacagaaggccaagaaugcucuugauaaccuggccguccugcauaccgcugaagccggaggccgggccuauaaucacgcucucagcgagcugccggagacacuugaaacccugcuccugcugacacuccuugcgaccgugacaggcgggauuuuccuguuucugauguccgggaaagggaucggaaagaugacacucggcaugugcugcaucauuaccgccagcauccugcuuugguacgcucagauucagccucacuggaucgccgccucuauuauccuggaguucuuucucaucguucugcugauucccgaacccgagaaacaaagaaccccucaggacaaccagcucacauauguggugaucgcuauucuuaccgucguugccgcgacaauggccaaugaaaugggcuuccuggagaagacgaaaaaggauuuugggcugggauccaucaccaaccagcaaccggagagcaauauucucgacaucgaucugcggcccgcuuccgccuggacacuuuacgcuguggccaccacauucaucaccccuaugcugcgccauucuauugaaaacagcuccgugaaugucucucucacggcgaucgccaaccaggcuaccgugcugaugggccuggggaagggauggccccucagcaaaauggacauuggcguuccucuucuggccaucggguguuacucccaggugaaucccauuacacugaccgcugcccuccugcuucuggucgcucacuaugccaucauuggaccuggccuccaggcgaaggccacaagagaggcucaaaaacgggccgcugccggcaucaugaagaacccgaccguggacgggaugacggucaucgaucuggaccccauuccuuacgaucccaaauuugaaaagcagcugggacaggugaugcuccuuguucugugcgugacacagguccugaugaugcgcaccacaugggcccucugugaggcgcugacccuugcuaccggcccuaucagcacacugugggaagggaaucccggaagauucuggaacacgaccauugccgugucuauggcuaacaucuuucggggcuccuaucucgccggggccggacugcuguucagcauuaugaagaauacagcuaacacccgcagaggcacaggcaauaccggggagacgcucggagagaaauggaagaaccggcuuaaugcccugggcaaaucugaauuucaaaucuacaagaaauccgggauccaggagguugaccgcacacuggcgaaggaaggaauuaaaagaggcgagaccgaucaucacgccgugagccgggggucugcuaagcucagaugguucgucgagcgcaaccuggugaccccggaaggaaaggugguugaccuuggcugcggcagagggggauggagcuauuacuguggcgggcugaaaaaugucaaggaggugaaaggacucacaaagggcgggccuggacaugaagaacccauccccauguccaccuauggcuggaaccuggugagacugcagucuggcgucgauguuuucuuuacaccucccgaaaaaugcgacacgcuccuuugugauauuggggagagcuccccuaauccgaccguggaggccggacgcacacugcgggugcugaaccucgucgaaaauuggcugaacaauaacacccaauucugcaucaaggugcuuaaucccuacaugccuagcguuauugagaagauggaagcucugcagagaaaauacggcggggcccucgugcgcaacccccugucccggaacucuacacacgagauguauugggucagcaaugcguccggaaacaucgugucuagcguuaauaugaucuccagaaugcugauuaaccgcuuuaccaugcggcacaagaaagccacguacgaaccugacguggaucucggcucugggaccagaaauaucggaauugagagcgagacacccaaccuugacaucauuggcaagcgcaucgagaaaaucaagcaggagcaugaaaccuccuggcacuaugaucaggaccauccguacaagacaugggcuuaucacggcagcuacgagaccaaacaaacagggucugccuccagcauggucaauggaguggugcggcugcugaccaagccuugggacgucauucccaugguuacgcagauggcuaugacagauaccaccccuuucggccagcagagaguguuuaaagaaaagguggacacacgcacgcaagagcccaaagaggggaccaagaagcucaugaaaaucacagccgaauggcuguggaaggagcuuggcaaaaagaaaaccccuagaauguguacacgggaagaguucacccgcaaggucagaucuaacgcugcccugggcgcgauuuuuacagaugagaauaaauggaaguccgcccgggaagcuguggaggacagcggguucugggaacucguugauaaggagagaaaccugcaccuggaaggaaaaugcgagaccuguguguauaauaugaugggcaagcgggagaaaaagcucggcgaauuugggaaagccaagggaucucgcgcuaucugguacauguggcugggcgccagauuccuugaguuugaagcccugggguuccucaacgaggaccauugguuuucccgggaaaauagccuguccggagucgagggcgaggggcuucacaagcugggcuacauucuccgcgaugugagcaaaaaggaaggaggcgcgauguaugcugacgauacggccgggugggacaccagaaucacacuggaggaucugaaaaacgaagagaugguuaccaaucauauggaaggagagcacaagaaacucgccgaggcuauuuucaagcugacauaccagaacaaggugguccgggugcagcgccccaccccgagaggcacgguuauggacaucaucucucggcgcgaccagagagggagcggacaaguggucacauauggccuuaacaccuucacaaauauggaagcccagcugauucggcagauggagggggaaggcguguuuaaauccauccaacagcucaccgucaaggaggagauugcugugaaaaacuggcugauccgcguuggaagagaacggcuuucucgcauggccauuagcggcgaugacugcguggucaagccucuggaugacagauucgcguccgcccucacggcucugaaugauauggggaaagugcggaaggacauccagcagugggagcccucuagaggauggaacgauuggacccaagugcccuuuugcagccaucacuuccacgaacugaucaugaaggacggccgcguucucguggucccuugucggaaucaggaugagcugauugggagagcccgcaucucccagggagcuggcuggucucuucgggaaacagccugccuggggaaaagcuacgcgcagauguggucccucauguauuuucauagacgcgaccugcggcuugccgcuaacgccauuuguagcgcugugccgucucacuggguucccaccuccagaacaaccuggagcauccaugccacacacgaguggaugaccacggaggauaugcugacaguguggaaucgcgucuggauucaagaaaacccuuggauggaggacaagacccccguggaaucuugggaggaaaucccuuaccucggcaaacgggaggaucaguggugcggaucccugaucggccugaccagcagagcuacaugggccaagaauauucagaccgcgaucaaccagguccgcucccucauugggaaugaggaauauacagacuacaugcccucuaugaaacgguucagacgggaggaagaggaagccggagugcugugguga

SEQ ID NO: 20254 - RNA, 9876 nt, Artificial Sequence
  derived and/or modified CDS sequence (opt5) from DENV-2__JN851115__SS-prME
accgccggaaucauuaucaugaugauucccaccgugauggcuuuccaccugacgaccagaaauggggaaccucauaugaucgucagccggcaggaaaagggaaaaucccugcuguuuaagacggaaaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaauggcugcuugaucugccgcucccuuggcugcccggcgcugacacccagggguccaacuggauccagaaagagacacugguuaccuuuaagaauccucacgccaagaaacaggauguggucgugcucggaagccaagagggcgccaugcauacggcucugacaggggcgaccgaaauucagauguccucuggcaaccuucuguucacaggacaccucaagugcagacugcggauggacaaacuucagcugaagggcaugagcuauuccauguguaccgggaaauuuaaggucgugaaggagaucgccgaaacccaacauggaacaauuguuaucagagugcaguacgagggcgacgggagccccugcaaaauucccuucgagaucauggaucucgaaaagcgccacguccugggacggcugaucacggugaauccuauuguuaccgagaaagacucuccggugaacaucgaagcugagcccccuuucggcgauuccuacauuaucauuggggucgaacccggccagcucaagcugagcugguuuaaaaagggaucuagcaucggccagauguucgagacaaccaugagaggggccaagcgcauggccauucuuggagacacagcuugggauuuuggcucccucgggggaguguucaccucuaucggcaaagcccuccaucaaguguuuggggcgaucuauggcgcugccuucagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuuuaucacagauaauguccacaccuggacagaacaguauaaguuccagccugagucucccagcaagcuggcuuccgccauccaaaaagcucacgaagaggggauuuguggcaucagaucugugacgcgccuugaaaaccugauguggaagcagauuaccccggagcucaaucauauccugacagagaacgaaguuaaacugaccauuaugacaggagacaucaagggcaucaugcaggccgggaaacggagccuuagaccucagcccaccgagcucaaguacuccuggaaagcguggggaaaggccaagaugcugagcacggaacugcacaaucauaccuuucucauugauggcccugagacagcugaaugccccaacaccaaucgcgccuggaacucucuggagguggaggacuauggguucggagucuuuacaaccaauaucuggcuuaaacugaaggaacggcaagauguguucugugacuccaaacucaugagcgcugccauuaaggacaacagagcggugcacgccgauaugggcuacuggaucgagucugcucugaacgacacauggaaaauugaaaaggccuccuuuaucgaggucaagagcugccacuggccuaaaucucauacccuguggagcaauggcguucuugaguccgaaaugaucauucccaagaacuucgcugggccggugagccagcacaauuaucgcccuggauaccauacgcagacagccggccccuggcaccucgggcggcuggagauggauuucgacuuuugugaaggaaccaccguggucgugacagaggauugcggcaacagagggcccucucugcggaccacgacagccuccggaaaacucaucaccgaauggugcugucgcagcugcacacugccuccgcuuagauaccggggcgaggacggcuguugguaugggauggagauuagaccccugaaggaaaaagaggaaaaucucguuaacucccuggugaccgcuggacauggccagaucgauaauuucucucuggggguccuuggaauggcgcucuuucuggaggaaaugcugcgcacacgggugggcaccaagcacgccauucuccugguugcugugagcuucgucacgcuuaucaccgggaacauguccuuuagagaccugggacgcgugaugguuauggugggcgccacaaugaccgaugacauuggcaugggggucacauaccucgcccugcuggcugccuucaaggugagaccuaccuuugcggcuggacuucugcuccggaaacugacgucuaaggagcucaugaugacaaccaucggcaucgugcugcuuagccaauccacaauucccgagucuauccuggaacucaccgaugcccuggcccuggggaugaugguccuuaaaauuguucgcaauauggagaaguaucagcuggcugugaccaucauggccauucucugcgugccuaacgcggucauccugcagagcgcuuggaaaguguccuguacaacgcucgccguugugagcgucucuccccugcuucugaccuccagccaacagaaggccgacuggaucccucucgcucugacaauuaagggacugaaucccaccgccaucuuccuuacaacccugucuagaacguccaaaaagcggagcuggccgcucaacgaagcuauuauggccgugggcaugguuucuauccuggcguccagccuccugaaaaaugauauuccuaugacagggccccuuguggccggaggccugcugaccgucugcuacgugcucaccggccgcuccgcugaccuggagcuugaaagagccgcugacguccggugggaggagcaggccgaaaucagcgggucuagcccuauccuguccauuacaaucucugaggauggaagcauguccauuaagaacgaagaggaggaacagacccucacaauccugauucgcacgggccuccuggugaucucugggcuuuuucccguuagcauuccgaucaccgccgcugcgugguaucugugggaggugaaaaagcaaagagccggaguccugugggacgugccuucucccccucccguuggcaaagcugaacucgaggauggggccuaccggaucaagcagaagggcauucugggcuauagccagaucggcgccgggguguacaaagaaggaacauuccacaccauguggcaugucacacgcggcgcugugcuuaugcacaaggggaaaagaauugagcccagcugggccgacgugaagaaagaucugaucuccuacggaggcggguggaagcucgagggagaauggaaggagggcgaagagguucagguccuggcgcucgaaccuggcaaaaauccgcgggcugugcaaaccaagcccgggcuguuuaaaacgaacaccggaacaauuggcgccgugagccuugacuucucuccugggaccuccggaagccccaucgucgauaagaaaggcaaggugguugggcuguauggaaacggcguggucacaagaucuggcaccuacguguccgccaucgcucagacagaaaagagcauugaggacaauccugaaaucgaggaugacauuuuucgcaaaaagcggcugacgaucauggaucuccaucccggggccggaaaaaccaagagauaucugccugcgauuguucgcgaagcuaucaaacggggccuuagaacacugauccucgccccgacccgcguggucgccgcugagauggaagaggcccugcgggggcuccccauuagauaccagaccccugcuauccgcgccgagcacacaggacgggaaauuguggaccugaugugucaugcgacguucaccaugagacuucugucccccauccggguuccuaacuauaaucugauuaucauggaugaggcccacuucacagaccccgcuucuauugccgcucgcggcuacaucagcaccagaguggaaaugggggaggccgccggcaucuuuaugacagcuaccccgccuggaucccgggaccccuucccccagagcaacgcgccuauuauggaugaggaacgcgagauccccgaaagaucuuggaacuccggccacgagugggucacggacuuuaaggggaagacagugugguucgugccuagcauuaaagccggaaacgauaucgcugccugccuccggaagaauggcaaaaaggucauucaacugucuagaaaaaccuuugacagcgaauauaucaagacccgcacaaacgauugggacuucguugugaccacagauaucuccgagaugggggccaauuuuaaggcugagcgggugauugacccgagacgcuguaugaaacccgucauccuuaccgauggagaggaacgggugauucuggccggcccuaugcccguuacgcauucuagcgcggcucagagacgcgggcgggugggcagaaacccuaagaaugaaaacgaccaguacaucuacaugggagagccccucgaaaaugaugaggacugcgcccacuggaaagaggccaagaugcugcuggacaacauuaauacaccggaaggcaucaucccuuccauguucgagcccgaacgcgagaaagucgaugcuauugacggggaauauagacuccggggagaggcccgcaagaccuuuguggaucuuaugagacggggcgaccugccuguuuggcuggcguaccgcguggccgcugaggggaucaacuaugccgauagacggugguguuucgacggagucaaaaacaaucaaauucucgaagagaacguggaagucgagaucuggacaaaggagggcgaaagaaagaaacugaagccccgcuggcuugaugcucggauuuacucugacccucuggcccucaaagaguuuaaggaguucgcugccgggagaaaaagccugacccugaaucucaucacggagaugggccgccuucccaccuucaugacacagaaggcgaagaacgcccuggauaaucuggcugugcuccauaccgccgaagcuggaggccgggccuauaaccacgcccuguccgagcuuccggagacacuggaaacccuccugcugcucacacuucuggcuaccguuacagggggaauuuuucuguuccucaugagcggcaaagggaucggaaagaugacacugggcaugugcugcaucauuaccgcgucuauccuucugugguacgcccagauucagccucacuggaucgcugccuccauuauccucgaguuuuuccugaucgugcugcucauucccgaacccgagaaacaaagaaccccucaggacaaucagcuuacauauguggucaucgccauucugaccguuguggcugccacaauggcgaacgaaaugggcuuucuggagaagacgaaaaaggauuucgggcucggaagcaucaccacacagcaaccggaguccaauauucuggacaucgaucuucggcccgccucugcuuggacccuguacgccguggcuacaaccuuuaucacgccuaugcuccgccauagcauugaaaacuccucugucaaugugagccugaccgccaucgcgaaccaggccacaguucugaugggccucgggaagggauggccccuuuccaaaauggacauuggcgugccucugcuggcuaucggguguuacagccaggucaaucccauuacccucacagccgcucugcuucugcucguggcccacuaugcuaucauuggaccuggccugcaggccaaggcgaccagagaggcccaaaaacgggcugccgcuggcaucaugaagaacccgacggucgacgggaugacagugaucgaucuggaccccauuccuuacgaucccaaauucgaaaagcagcucggacagguuaugcuucuggugcugugcgucacccaggugcucaugaugcgcacaaccugggcccugugugaggcccuuacccuggcgacaggcccuaucucuacgcucugggaagggaaucccggaagauuuuggaacaccacaauugcuguuuccauggccaauaucuuccggggcagcuaucuggcuggggccggacugcucuuuucuauuaugaagaacaccgccaacacacgcagaggcaccggcaauacgggggagacacuuggagagaaauggaagaaccggcugaaugcucugggcaaauccgaguuccaaaucuacaagaaaagcgggauccaggagguggaccgcacccucgccaaggaaggaauuaaaagaggcgagaccgaucaucacgcggucucucgggggagcgccaagcugagaugguuuguggagcgcaaccuugugacaccggaaggaaagguugucgaccugggcugcggcagagggggaugguccuauuacuguggcgggcucaaaaaugugaaggaggugaaaggacugaccaagggcgggccuggacaugaagaacccauccccaugucuacauauggcuggaaccuggucagacuccagagcggcguugauguguucuucacgccucccgaaaaaugcgacacccuucugugugauauuggggaguccagcccuaauccgacaguggaggcuggacgcacccugcggguccucaaccugguggaaaauuggcuuaacaauaacacacaauuuugcaucaagguucugaaucccuacaugccuuccgugauugagaagauggaagcccuccagagaaaauacggcggggcucugguccgcaacccccugucucggaauagcacccacgagauguauuggguguccaacgccucuggaaacaucguuagcuccgugaauaugaucucuagaaugcucauuaaccgcuucacgaugcggcacaagaaagcgaccuacgaaccugacgucgaucuuggcagcgggacaagaaauaucggaauugaguccgagacccccaaccuggacaucauuggcaagcgcaucgagaagaucaagcaggagcaugaaacaagcuggcacuaugaucaggaccauccguacaagaccugggccuaucacggcucuuacgagacaaaacaaaccggguccgcuagcucuauggugaauggagugguccggcugcucacgaagccuugggacguuauucccauggugacacagauggccaugaccgauaccacaccuuuuggccagcagagaguguucaaagaaaaggucgacacgcgcacccaagagcccaaagaggggacaaagaagcugaugaaaaucaccgcugaauggcuuuggaaggagcugggcaaaaagaaaacaccuagaauguguacccgggaagaguuuacacgcaaggugagauccaacgccgcucucggcgccauuuucaccgaugagaauaaauggaaguccgcgcgggaagccguugaggacucuggguuuugggaacugguggauaaggagagaaaccugcaccucgaaggaaaaugcgagacgugugucuauaauaugaugggcaagcgggagaaaaagcugggcgaguucgggaaagcuaagggaucccgcgccaucugguacauguggcuuggcgcuagauuucuggaguucgaagcccucggguuucugaacgaggaccauugguucagccgggaaaauucccuuagcggaguggagggcgaggggcugcacaagcucggcuacauucugcgcgauguuucuaaaaaggaaggaggcgccauguaugcggacgauaccgcugggugggacacaagaaucacccuggaggaucucaaaaacgaagagauggugacaaaucauauggaaggagagcacaagaaacuggccgaggccauuuuuaaacuuaccuaccagaacaaggucgugcggguucagcgccccacgccgagaggcacagugauggacaucaucagccggcgcgaccagagaggguccggacaagucgugaccuauggccugaauacauucaccaacauggaagcucagcucauucggcagauggagggggaaggcgucuucaaaucuauccaacagcugacggugaaggaggagauugccguuaaaaacuggcuuauccgcgugggaagagaacggcugagccgcauggcuauuuccggcgaugacugcgucgugaagccucucgaugacagauuugccucugcgcugaccgcccugaaugauauggggaaagugcggaaggacauccagcagugggagcccagcagaggauggaacgauuggacacaaguucccuucugcucccaucacuuucacgaacucaucaugaaggacggccgcgugcuggucgugccuugucggaaucaggaugagcuuauugggagagcucgcaucucucagggagccggcuggagccugcgggaaaccgcuugccucgggaaauccuacgcccagauguggagccugauguauuuccauagacgcgaccuucggcuggcggccaacgcuauuuguucugccguuccgucccacugggugcccacaagcagaaccacauggucuauccaugcuacccacgaguggaugacgacagaggauaugcucaccgucuggaaucgcguguggauucaagaaaacccuuggauggaggacaagacccccgucgaauccugggaggaaaucccuuaccugggcaaacgggaggaucaguggugcggaagccugaucggccucacauccagagccaccugggcuaagaauauucagacagccaucaaccaggugcgcucucugauuggguaugaggaauacacggacuacaugcccagcaugaaacgguuuagacgggaggaagaggaagcgggaguucuuugguga

SEQ ID NO: 20255 - RNA, 9876 nt, Artificial Sequence
  derived and/or modified CDS sequence (opt5) from DENV-2__JN851127__SS-prME
accgccggcaucauuaucaugaugauucccacagugauggcuuuccaccugacgaccagaaauggggaaccucauaugaucgucagccggcaggaaaaggggaaaucccuccuguuuaagacagagaauggcguuaacaugugcacccuuauggccauggaccugggggaacucugugaggauacaauuaccuacaauugcccgcugcuuaaacaaaacgaacccgaggacaucgauuguuggugcaauucuacauccaccugggugacguauggaaccuguacagcgaccggcgagcacagaagagaaaagcgguccguggcucuggucccucauguggggaugggacucgagacacgcaccgaaacguggaugucuagcgagggcgccuggaaacacgcccagagaaucgagacauggguucugcggcaucccggcuucaccauuauggcugccauccuggcuuacacaauugggaccaccuauuuucagcgcgugcucaucuucauucugcuuacagccgucgcgccuuccaugacgaugagaugcaucggaauuucuaaccgggacuuuguggaaggcguuagcgggggauccuggguggauaucguccuggagcacggcagcugugugaccacaauggccaagaauaagcccacccucgacuucgaacugaucaaaacagaggcuaagcacccugccacccuucgcaaauacugcauugaagcuaagcugacgaacacaaccaccgccucuagauguccgacacagggggagcccucccucagcgaggaacaagauaaacgguuugugugcaagcauucuauggucgaccgcggauggggcaauggcugugggcuguucggaaagggcgggaucguuaccugcgcgauguuuacaugcaaaaagaacauggagggaaaaauugugcagccugaaaaucuggaguauacgaucgugauuacaccccacuccggcgaagagaacgccgucgggaaugauacaggaaagcauggcaaagagaucaaggugaccccucagagcucuaucacagaagcugagcucaccggcuacgggacgguuaccauggaauguucccccagaacaggacuggacuucaacgagauggugcuucugcagauggaaaauaaagccuggcucguccaccggcaaugguuucuggaucuuccgcugccuuggcuccccggcgcugacacccaggggagcaacuggauucagaaggagacacuggugaccuucaagaacccucacgccaaaaagcaggauguugugguccugggaucccaagagggcgccaugcauacggcucucacaggggcgaccgaaauccagaugucuagcggcaaucugcuuuuuacaggacaccugaaaugccgccucagaauggacaagcugcagcuuaaaggcauguccuauagcauguguaccgggaaguucaagguggucaaagagauugccgaaacccaacauggaacaaucgugauucggguucaguacgagggcgacgggucucccugcaagauccccuucgagaucauggaucuggagaagcggcacgugcucggacgccugauuacggucaacccuaucgugaccgagaaggacuccccgguuaauauugaagcugagcccccuuuuggcgauagcuacaucauuaucgggguggaacccggccagcugaaacucucuugguucaagaagggaagcuccauuggccagauguuugagacaaccaugagaggggccaaaagaauggccauccugggagacacagcuugggauuucggcucucuugggggagucuuuaccagcaucggcaaggcccugcaucaaguguucggggcgauuuauggcgcugccuuuuccggagugagcuggacgaugaaaauccucauuggcguugucaucacauggauugggaugaacucucgcuccaccagccugucugugucccuggugcuugucggagugguuacccucuaccugggcgugaugguccaggccgacagcgggugugugguuuccuggaagaauaaagagcugaagugcggaucuggcaucuucaucacagauaacgugcacaccuggacagaacaguauaaguuucagccugagagccccuccaaacucgcuucugccauucaaaaggcucacgaagaggggaucuguggcauucggagcgucacgagacuggaaaaucuuauguggaaacagaucaccccggagcugaaccauauucucuccgagaaugaaaucaagcugacaaucaugaccggagacauuaaaggcaucaugcaggccgggaagcgcagccugcggccucagcccauugagcuuaaauacucuuggaaggcguggggaaaggccaaaaugcucuccacagaacugcacaaccauaccuuccugaucgauggcccugagacggcugaaugccccaauaccaacagagccuggaauagccucgagguggaggacuauggguuuggaguuuucacaaccaacauuuggcugaaacuuaaagaacgccaagauguguuuugugacucuaagcugauguccgcugucaucaaagacaaucgggccgugcacgcggauaugggcuacuggaucgagagcgcccucaacgacacauggaagauugaaaaggcuucuuucaucgaggugaaaagcugccacuggccuaagucccauacccuguggagcaacggcguccuggagucugaaaugauuauccccaaaaauuucgccgggccgguuucccagcacaacuauagaccuggauaccauacacagaccgcuggccccuggcaccuugggcgccucgagauggauuuugacuucugugaaggaacgacagugguggucaccgaggauugcggcaaucgggggcccagccugagaaccacaaccgccuccggaaagcugauuacggaauggugcugucggucuugcacacucccuccgcugcgcuacagaggcgaggacggcuguugguaugggauggagauccggccccuuaaagaaaaggaggaaaaccuggugaauagccucguuaccgccggacauggccagauugauaacuuuucccugggggugcugggaauggcucuuuuccucgaggaaaugcugagaacacgcgucggcaccaagcacgcgauccugcucguggccguuucuuuugugacacugaucaccgggaauaugagcuuccgggaccuuggaagagucauggugaugguuggcgcuacgaugaccgaugacauuggcaugggggugacauaccuggcccuccuggccgcuuuuaaaguccgcccuaccuucgccgcgggacugcuucugagaaagcucacauccaaagagcugaugaugaccacgaucggcauugugcuccugucucaaagcacaauccccgagaccauucuugaacugacagaugcucucgcccuggggaugauggugcugaagaucguccggaacauggagaaauaucagcuugccguuaccaucauggcuauucugugcgugccuaaugccgugauccuccagaacgcguggaaggucuccuguaccacacuggcugugguuagcgugucuccccuccugcuuacguccagccgccaaaaggccgacuggauuccucuggcccucaccaucaaaggacugaaucccacagcuauuuuucugaccacacuuucuagaaccuccaagaaacggagcuggccgcugaacgaagccaucauggcugucggcauggugucuauccucgccuccagccugcucaagaaugauauuccuaugacggggccccugguugcgggaggccuucugacagugugcuacguccugaccggccgcuccgccgaccucgagcuggaaagagcugccgacgugcggugggaggagcaggcugaaaucagcgggucuagcccuauucuuuccaucaccauuucugaggauggaagcauguccaucaaaaacgaagaggaggaacagacacugaccauucucauccgcacaggccugcucgucaucucugggcuguuccccgugagcauuccgaucacggccgccgcuugguaucuuugggagguuaagaaacagagagcgggagugcugugggacgucccuucucccccucccgugggcaaggccgaacuggaggauggggcuuaccggauuaagcaaaaaggaauccucggcuauagccagauuggcgccgggguuuacaaggaaggaaccuuucacacaauguggcaugugacccgcggcgccguccugaugcacaaagggaagagaaucgagcccagcugggcugacgugaaaaaggaucuuaucuccuacggaggcggguggaagcuggagggagaauggaaagagggcgaagaggugcagguucucgcccuggaaccuggcaagaauccgcgggcgguccagacaaaacccggacucuucaagaccaacacgggaaccauuggcgcugugagccuggacuuuucuccugggacauccggaagccccaucguggauaaaaagggcaaggucguggggcuuuauggaaacggcguugugaccagaucuggcacauacgucuccgccauugcccaaaccgagaaaagcaucgaggacaauccugaaauugaggaugacaucuuccgcaagaaacggcugacaaucauggaucugcaucccggggcuggaaagacgaaaagauaucucccugccauugugcgcgaagcgaucaagcggggccugagaacccuuauucuggcuccgacacgcguuguggccgccgagauggaagaggcucuccgggggcugcccaucagauaccagaccccugccauucgcgcugagcacaccggacgggaaaucgucgaccucaugugucaugccacauucacgaugagacugcuuucccccauucgggugccuaacuauaaucugaucaucauggaugaggcgcacuuuaccgaccccgccucuauugcugcccgcggcuacaucagcacaagaguugaaaugggggaggcugccggcauuuucaugaccgccacaccgccuggaucccgggaccccuuuccccagagcaacgcuccuaucauggaugaggaacgcgagauucccgaaagaucuuggaacuccggccacgagugggugaccgacuucaaggggaaaacggucugguuugugccuagcaucaaggcgggaaacgauaucgccgcuugccugcggaaaaauggcaagaaagugauucagcucucuagaaagacauucgacagcgaauauaucaagacccgcaccaacgauugggacuuugucguuacaaccgauauuuccgagaugggggccaauuucaaagccgagcgggugaucgacccgagacgcuguaugaagcccgugauucugacagauggagaagaacgggucauccuugcuggcccuaugcccgugacccauucuagcgccgcgcaaagacgcgggcggguuggcagaaacccuaaaaaugaaaacgaccaguacaucuacaugggagagccccuggaaaaugaugaggacugcgcucacuggaaggaggccaaaaugcuccuggacaacauuaauacgccggaaggcaucauuccuuccauguuugagcccgaacgcgagaagguggaugccaucgacggggaauauagacugcggggagaggcucgcaaaacauucgucgaucucaugagacggggcgaccuuccuguguggcuggccuaccgcguugcggccgaggggauuaacuaugcugauagacggugguguuuugacggagugaagaacaaucagauccuggaagagaacgucgaaguggagauuuggaccaaggagggcgaacgcaaaaagcucaaaccccgcuggcuggaugcccggaucuacucugacccucuugcucugaaggaguucaaagaguucgccgcugggagaaagagccucacacugaaucugaucaccgagaugggccgccuccccacguuuaugacccaaaaggcccggaacgcgcuugauaaucuggccguccugcauacagcugaagccggaggcagagcuuauaaccacgcccucuccgagcugccggagacccuugaaacacugcuccugcugacccuccuugccacagugaccgggggaauuuuccuguuucugaugagcggcaaagggaucggaaagaugacgcucggcaugugcugcauuaucacagcuucuauucugcuuugguacgcgcagauccagccucacuggaucgccgcuuccauuauccuggaguucuuucucauuguucugcugauccccgaacccgagaaacagcggaccccucaagacaaucagcucaccuauguggugauugccauccuuacagucguugccgcuaccauggccaacgaaaugggcuuccuggagaagaccaaaaaggauuuugggcugggaagcaucacgacccagcagccggaguccaauauucucgacaucgaucugcgccccgcgucugccuggacacuuuacgcuguggccaccacauucauuaccccuaugcugagacauagcaucgaaaacuccucugugaaugucagccucacggcuauugccaaccaagcgaccgugcugaugggccuggggaagggauggccccucuccaaaauggacaucggcguuccucuucuggccauuggguguuacagccaggugaaucccaucacacugaccgcugcccuccugcuucuggucgcucacuaugccaucauuggaccuggccuccaggcuaaggccacacgggaggcgcagaaacgcgccgcugccggcaucaugaagaacccgaccguggacgggauuacggucaucgaucuggaccccauuccuuacgaucccaaauuugaaaagcaacugggacaggugaugcuccuuguucugugcgugacacagguccugaugaugagaaccacaugggcucucugugaggcccugacccuugccaccggcccuaucucuacacugugggaagggaaucccggacgguucuggaacacgaccaucgcgguguccauggcuaauauuuuucgcggcagcuaucucgccggggcuggacugcuguucucuaucaugaagaacacagccaacaccagacggggcacaggcaauaccggggagacgcucggagagaaauggaagaaccgccuuaaugcccugggcaaauccgaauuucagauuuacaagaaaagcgggauccaagagguugacagaacacuggcuaaggaaggaauuaaacggggcgagaccgaucaucacgccgugucuagagggagcgcgaagcuccgcugguucaucgagcggaaccuggucaccccggaaggaaaggugguggaccuuggcugcggcagagggggaugguccuauuacuguggcgggcugaaaaauguuaaggaggucaaaggacucacaaagggcgggccuggacaugaagaacccauccccaugucuaccuauggcuggaaccuggugcgccugcagagcggcguggaugucuucuuuacaccucccgaaaaaugcgacacgcuccuuugugauauuggggaguccagcccuaauccgaccguugaggccggacggacacugagagugcugaaccucguggaaaauuggcugaacaauaacacccaguucugcaucaagguccuuaaucccuacaugccuuccgugauugagaagauggaagcucugcaacgcaaauacggcggggcccucguucggaacccccugucuagaaauagcacacacgagauguauuggguguccaacgcuucuggaaacaucgucagcuccgugaauaugauuucucgcaugcugaucaaccgguuuaccaugagacacaagaaagccacguacgaaccugacguugaucucggcagcgggacccgcaauaucggaauugaguccgagacacccaaccuugacaucauuggcaagcggaucgagaaaauuaagcaggagcaugaaaccagcuggcacuaugaucaggaccauccguacaagacaugggcguaucacggcucuuacgagaccaaacagacaggguccgccagcucuauggugaauggagucgugagacugcugaccaagccuugggacgugauccccauggucacgcaaauggcuaugacagauaccaccccuuucggccagcagcgcguuuuuaaagaaaagguggacacaagaacgcaggagcccaaagaggggaccaagaagcucaugaaaauuacagccgaauggcuguggaaggagcuuggaaaacggaagaccccucgcauguguacaagagaagaguucacccggaaagugagauccaacgcugcccugggcgcuaucuuuacagaugagaauaaguggaaaagcgcccgggaagcggucgaggacucuggguucugggaacucguggauaaggagcgcaaccugcaccuggaaggaaagugcgagaccuguguuuauaauaugaugggcaaaagagagaagaaacucggcgaauuugggaaggccaaaggaucccgggcuaucugguacauguggcugggcgcccgcuuccuugaguuugaagcucugggguuccucaacgaggaccauugguuuagcagagaaaauucccugagcggaguggagggcgaggggcuucacaagcugggcuacauucuccgggaugucucuaagaaagaaggaggcgccauguaugccgacgauacggcggggugggacacccgcaucacacuggaggaucugaagaacgaagagauggugaccaaucauauggaaggaguucacaaaaagcucgcugaggccauuuucagacugacauaccaaaacaaagugguccgggugcagcgccccaccccgagaggcacgguuauggacaucauuagccggcgcgaccagagaggguccggacagguggucacauauggccuuaauaccuucacaaacauggaggcccaacugauccggcagauggaaggggagggcguguuuaagucuauccagcaucucaccgucacggaagagauugcugugaagaacuggcugguucgcgugggaagagagcggcuuagcagaauggccaucuccggcgaugacugcgucgugaaaccucuggaugaccgcuucgcuucugcccucaccgcgcugaaugauauggggaaggugcggaaagacauucaacagugggaacccagcagaggauggaacgauuggacacagguucccuuuugcucccaccacuuccaugagcugaucaugaaggacggccgcgugcucgucgugccuugucggaaucaggaugaacugauugggagagcccgcaucucucaaggagcuggcuggagccuucgggagaccgccugccuggggaaauccuacgcucagauguggagccucauguauuuucacagacgcgaccugcggcuugccgcgaacgccaucuguucugcuguuccgucccauugggugcccacaagcagaaccacauggucuauucacgccacccacgaauggaugacgacagaggauaugcugaccgucuggaaucgcguguggauccaggagaacccuuggauggaagacaagacccccauugaguccugggaagagaucccuuaccucggcaagcgggaagaucaguggugcggaagccugauuggccugacauccagagcuaccugggccaaaaauauccaaacagcuauuaaccagguccggucucucaucgggaaugaggaguauacggacuacaugcccagcaugaagagauuccgccgggaagaggaagaggccggagugcugugguga

SEQ ID NO: 20256 - RNA, 9876 nt, Artificial Sequence
  derived and/or modified CDS sequence (opt5) from DENV-2__JN851120__SS-prME
accgccggaaucauuaucaugaugauucccaccgugauggcuuuccaccugacgaccagaaacggggagccucauaugaucgucagccggcaggaaaagggaaaaagccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaguugggaccaccuauuuucagagagugcucaucuucauucugcuuacagccgucacgccuuccauggcgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcguggaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaaggugguccagccugaaaaccuggaguauacgaucgugauuacaccccacucuggcgaagagaaugccguugggaacgauacaggaaaacauggcaaggagaucaaagugaccccucaguccagcauuacagaagcugagcucaccggcuacgggacggucaccauggaauguucuccccggacaggacuggacuucaaugagauggugcuucugcagauggaaaacaaggccuggcucguucaccgccaaugguuucuggaucuuccgcugccuuggcuccccggcgcugacacccagggguccaacuggauccagaaagagacacuggugaccuucaagaauccucacgccaagaaacaggaugucgugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaaggugguuaaggagauugccgaaacccaacauggaacaaucgugauuagaguccaguacgagggcgacgggagccccugcaaaauccccuucgagauuauggaucuggaaaagcgccacgugcucggacggcugaucacgguuaauccuaucgugaccgagaaagacucuccggucaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggaguguuuaccucuauuggcaaagcccugcaucaaguuuucggggcgaucuauggcgcugccuuuagcggagucuccuggacgaugaagauccucauuggcguggugaucacauggauugggaugaauagccggucuaccucccugagcgucucucuggugcuuguuggaguggucacccucuaccugggcgugaugguucaggccgacuccggguguguggucagcuggaaaaacaaggagcugaaaugcggauccggcaucuucauuacagauaaugugcacaccuggacagaacaguauaaguuucagccugagucucccagcaagcucgcuuccgccauccaaaaagcucacgaagaggggaucuguggcauuagaucuguuacgcgccuggaaaaccuuauguggaagcagaucaccccggagcugaaucauauucucacagagaacgaagugaaacugaccaucaugacaggagacauuaagggcaucaugcaggccgggaaacggagccugagaccucagcccaccgagcuuaaguacuccuggaaagcguggggaaaggccaagaugcucagcacggaacugcacaaucauaccuuccugaucgauggcccugagacagcugaaugccccaacaccaaucgcgccuggaacucucucgaggucgaggacuauggguuuggaguguucacaaccaauauuuggcugaaacuuaaggaacggcaagauguguuuugugacuccaaacugaugagcgcugccaucaaggacaacagagcgguccacgccgauaugggcuacuggauugagucugcucucaacgacacauggaaaaucgaaaaggccuccuucauugagguuaagagcugccacuggccuaaaucucauacccuguggagcaauggcgugcuggaguccgaaaugaucauccccaagaacuucgcugggccggugagccagcacaauuaucgcccuggauaccauacgcagacagccggccccuggcaccuugggcggcucgagauggauuuugacuucugugaaggaaccaccgucgugguuacagaggauugcggcaacagagggcccucucugcggaccacgacagccuccggaaaacugauuaccgaauggugcugucgcagcugcacacucccuccgcugagauaccggggcgaggacggcuguugguaugggauggagaucagaccccuuaaggaaaaagaggaaaaucuggugaacucccucgucaccgcuggacauggccagauugauaauuuuucucugggggugcugggaauggcgcuuuuccucgaggaaaugcugcgcacacggguuggcaccaagcacgccauccugcucguggcugucagcuuugugacgcugauuaccgggaacauguccuucagagaccuuggacgcguuauggugauggucggcgccacaaugaccgaugacaucggcaugggggugacauaccuggcccuccuggcugccuuuaaggugagaccuaccuucgcggcuggacugcuucugcggaaacucacgucuaaggagcugaugaugacaaccauuggcaucguccuccugagccaauccacaauccccgagucuauucuugaacugaccgaugcccucgcccuggggaugaugguucugaaaaucgugcgcaauauggagaaguaucagcuugcugugaccauuauggccauccugugcgucccuaacgcggugauucuccagaaugcuuggaaaguuagcuguacaacgcuggccguggucuccgugagcccccuccugcuuaccucuucccaacagaaggccgacuggaucccucuggcucucacaaucaagggacugaaccccaccgccauuuuucugacaacccuuagcagaacgucuaaaaagcgguccuggccgcugaaugaagcuaucauggccguuggcauggugagcauucucgcgucuucccugcucaaaaacgauaucccuaugacagggccccuggucgccggaggccuucugaccgugugcuacguccugaccggccgcagcgcugaccucgagcuggaaagagccgcugacgugcggugggaggagcaggccgaaauuuccgggagcucuccuauccuuagcaucacaauuuccgaggauggaucuaugagcaucaagaaugaagaggaggaacagacccugacaauucucauccgcacgggccugcucguuauuuccgggcuguuccccgugucuaucccgauuaccgccgcugcgugguaucuuugggaggucaaaaagcaaagagccggagugcugugggacguuccuucucccccucccgugggcaaagcugaacuggaggauggggccuaccggaucaagcagaagggaauccucggcuauucccagauuggcgccggggucuacaaagaaggaacauuucacaccauguggcaugugacacgcggcgcugugcugaugcacaaggggaaaagaaucgagcccuccugggccgacguuaagaaagaucuuauuagcuacggaggcggguggaagcuggagggagaauggaaggagggcgaagagguccaggugcucgcgcuggaaccuggcaaaaacccgcgggcugugcaaaccaagcccggacucuucaaaacgaacaccggaacaaucggcgccgucucccuggacuuuagcccugggaccucuggaucccccauuguggauaagaaaggcaagguuguggggcuuuauggaaauggcgucgugacaagaagcggcaccuacguuucugccaucgcucagacagagaaguccaucgaggacaacccugaaauugaggaugacaucuuccgcaaaaagcggcugacgauuauggaucugcaucccggggccggaaaaaccaagagauaucucccugcgaucgugcgcgaagcuauuaaacggggccugagaacacuuauccuggccccgacccgcgucguggccgcugagauggaagaggcccuccgggggcugcccaucagauaccagaccccugcuauucgcgccgagcacacaggacgggaaaucguugaccucaugugucaugcgacguucaccaugagacugcuuagccccauucgggugccuaauuauaaccugaucauuauggaugaggcccacuuuacagaccccgcuuccaucgccgcucgcggcuacauuucuaccagagucgaaaugggggaggccgccggcaucuucaugacagcuaccccgccuggaagccgggaccccuuuccccaguccaaugcgccuaucauggaugaggaacgcgagauucccgaaagaagcuggaacucuggccacgagugggugacggacuucaaggggaagacagugugguuugucccuuccaucaaagccggaaaugauauugcugccugccugcggaagaacggcaaaaagguuauccaacucagcagaaaaaccuucgacucugaauauauuaagacccgcacaaaugauugggacuuuguggugaccacagauaucagcgagaugggggccaacuucaaggcugagcgggucaucgacccgagacgcuguaugaaacccgugauucugaccgauggagaagaacggguuauccuugccggcccuaugcccgugacgcauuccucugcggcucagagacgcgggcgggucggcagaaauccuaagaacgaaaaugaccaguacauuuacaugggagagccccuggaaaacgaugaggacugcgcccacuggaaagaggccaagaugcuccuggacaauaucaacacaccggaaggcauuaucccuagcauguuugagcccgaacgcgagaaaguggaugcuaucgacggggaauauagacugcggggagaggcccgcaagaccuucguugaucucaugagacggggcgaccuuccuguguggcuggcguaccgcgucgccgcugaggggauuaacuaugccgauagacggugguguuuugacggagugaaaaauaaccaaauccuggaagagaaugucgaaguggagauuuggacaaaggagggcgaaagaaagaaacucaagccccgcuggcuggaugcucggaucuacuccgacccucuugcccugaaagaguucaaggaguucgcugccgggagaaaaucucucacccugaaccugauuacggagaugggccgccuccccaccuuuaugacacagaaggcgaagaaugcccuugauaaccuggcuguucugcauaccgccgaagcuggaggccgggccuauaaucacgcccucagcgagcugccggagacacuugaaacccugcuccugcugacacuccuugcuaccgugacaggcgggaucuuccuguuucugauguccgggaaagggauuggaaagaugacacucggcaugugcugcaucaucaccgcgagcauucugcuuugguacgcccagauccagccucacuggauugcugccucuaucauucuggaguucuuucucaucgugcugcugauccccgaacccgagaaacaaagaaccccucaggacaaccagcucacauaugucguuauugccauccuuaccgugguggcugccacaauggcgaaugaaaugggcuuccuggagaagacgaaaaaggauuuugggcugggauccauuaccacacagcaaccggagagcaacauccucgacauugaucugcggcccgccuccgcuuggacccuuuacgccgucgcuacaaccuucaucacgccuaugcugcgccauucuaucgaaaauagcuccgugaacguuucucucaccgccauugcgaaucaggccacagugcugaugggccuggggaagggauggccccucagcaaaauggacaucggcgucccucuucuggcuauuggguguuacucccaggugaaccccaucacccugacagccgcucuccugcuucuggucgcccacuaugcuauuaucggaccuggccuccaggccaaggcgaccagagaggcccaaaaacgggcugccgcuggcauuaugaagaauccgacgguggacgggaugacaguuaucgaucuggaccccaucccuuacgaucccaaauuugaaaagcagcugggacaggugaugcuccuuguccugugcgugacccagguucugaugaugcgcacaaccugggcccucugugaggcccugacccuugcgacaggcccuauuagcacgcugugggaagggaaccccggaagauucuggaauaccacaaucgcugugucuauggccaacauuuuucggggcuccuaucucgcuggggccggacugcuguucagcaucaugaagaacaccgccaauacacgcagaggcaccggcaacacgggggagacacucggagagaaauggaagaaucggcuuaacgcucugggcaaaucugaauuucaaauuuacaagaaauccgggauccaggaggucgaccgcacccuggccaaggaaggaaucaaaagaggcgagaccgaucaucacgcggugagccgggggucugccaagcucagaugguucguggagcgcaaucugguuacaccggaaggaaaggucguggaccuuggcugcggcagagggggauggagcuauuacuguggcgggcugaaaaacgugaaggaggucaaaggacucaccaagggcgggccuggacaugaagaacccauucccauguccacauauggcuggaaucugguuagacugcagucuggcguggauguguucuuuacgccucccgaaaaaugcgacacccuccuuugugauaucggggagagcuccccuaacccgacagucgaggcuggacgcacccugcgggugcugaaucucguugaaaacuggcugaauaacaauacacaauucugcauuaaggugcuuaaccccuacaugccuagcgucaucgagaagauggaagcccugcagagaaaauacggcggggcucucgugcgcaauccccugucccggaacucuacccacgagauguauuggguuagcaacgccuccggaaauauugugucuagcgucaacaugaucuccagaaugcugaucaaucgcuuuacgaugcggcacaagaaagcgaccuacgaaccugacguggaucucggcucugggacaagaaacauuggaaucgagagcgagacccccaaucuugacauuaucggcaagcgcauugagaaaaucaagcaggagcaugaaacauccuggcacuaugaucaggaccauccguacaagaccugggccuaucacggcagcuacgagacaaaacaaaccgggucugcuuccagcauggugaacggagucguucggcugcugacgaagccuugggacgugauccccauggugacacagauggccaugaccgauaccacaccuuucggccagcagagagucuuuaaagaaaagguggacacgcgcacccaagagcccaaagaggggacaaagaagcucaugaaaauuaccgcugaauggcuguggaaggagcuuggcaaaaagaaaacaccuagaauguguacccgggaagaguucacacgcaagguuagaucuaaugccgcucugggcgccaucuuuaccgaugagaacaaauggaaguccgcgcgggaagccguggaggacagcggguucugggaacucgucgauaaggagagaaaucugcaccuggaaggaaaaugcgagacguguguguauaacaugaugggcaagcgggagaaaaagcucggcgaauuugggaaagcuaagggaucucgcgccauuugguacauguggcugggcgcuagauuccuugaguuugaagcccugggguuccucaaugaggaccauugguuuucccgggaaaacagccuguccggaguugagggcgaggggcuucacaagcugggcuacauccuccgcgaugugagcaaaaaggaaggaggcgccauguaugcggacgauaccgcugggugggacacaagaauuacccuggaggaucugaaaaaugaagagauggucacaaaccauauggaaggagagcacaagaaacucgccgaggccaucuucaagcugaccuaccagaauaaggugguucgggugcagcgccccacgccgagaggcacagucauggacauuaucucucggcgcgaccagagagggagcggacaaguggucaccuauggccuuaacacauucaccaacauggaagcucagcugauccggcagauggagggggaaggcguguuuaaauccauucaacagcucacgguuaaggaggagaucgccgugaaaaauuggcugauucgcgucggaagagaacggcuuucucgcauggcuaucagcggcgaugacugcguggugaagccucuggaugacagauucgccuccgcgcucaccgcccugaacgauauggggaaaguucggaaggacauucagcagugggagcccucuagaggauggaaugauuggacacaagugcccuuuugcagccaucacuuccacgaacugaucaugaaggacggccgcguccucgugguuccuugucggaaccaggaugagcugaucgggagagcucgcauuucccagggagccggcuggucucuucgggaaaccgcuugccuggggaaaagcuacgcccagauguggucccucauguauuuucauagacgcgaccugcggcuugcggccaaugcuaucuguagcgccgugccgucucacuggguccccacauccagaaccacauggagcauucaugcuacccacgaguggaugacgacagaggauaugcugaccguguggaaccgcgucuggauccaagaaaauccuuggauggaggacaagacccccguggaaucuugggaggaaauuccuuaccucggcaaacgggaggaucaguggugcggaucccugaucggccugacaagcagagccaccugggcuaagaacauccagacagccauuaaucagguucgcucccucaucgggaacgaggaauauacggacuacaugcccucuaugaaacgguucagaauugaggaagaggaagcgggagugcugugguga

SEQ ID NO: 20257 - RNA, 9876 nt, Artificial Sequence
  derived and/or modified CDS sequence (opt5) from DENV-2__JN851131__SS-prME
accgccggagugaucauuaugaugauccccacagucauggcuuuccaccugacgaccagaaacggggagccucauaugauuguuagccggcaggaaaagggaaaaucccuccuguuuaagacagagaauggagugaacaugugcacccuuauggccaucgaccugggggaacucugugaggauacaauuaccuacaauugcccgcugcuuagacaaaacgaacccgaggacaucgauuguuggugcaauucuacaagcaccugggugacguauggaaccuguacagcgaccggcgagcaccggcgggaaaaacgcuccgucgcucuggugccucauguugggaugggacucgagacaagaaccgaaacguggaugucuagcgagggcgccuggaagcacgcccagcggaucgagacaugggugcugcgccaucccggcuucaccauuauggcugccauccuggcuuacacaauugggaccaccuauuuucagagaguccucaucuucauucugcuuacagccguggcgccuuccaugacgaugcggugcaucggaauuucuaaccgcgacuuuguugaaggcgugagcgggggauccugggucgauaucgugcuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaggaggaacaagauaaacgcuuugucugcaagcauagcaugguugacagaggauggggcaauggcugugggcuguucggaaagggcgggaucgugaccugcgcgauguuuacaugcaaaaagaacauggagggaaaagugguccagccugaaaaucuggaguauacgauugugaucacaccccacucuggcgaagagaacgccguugggaaugauacaggaaagcauggcaaagagauuaaggugaccccucaguccagcaucacagaagcugagcucaccggcuacgggacggucaccauggaauguucuccccggacaggacuggacuucaacgagauggugcuucugcagauggaagauaaagccuggcucguucaccgccaaugguuucuggaccuuccgcugccuuggcuccccggcgcugauacccagggguccaauuggauccagaaggagacacuggugaccuucaagaacccucacgccaaaaagcaggacgucgugguccugggaagccaagagggcgccaugcauacggcucucacaggggcgaccgaaauucagauguccucuggcaaccugcuuuuuacaggacaccugaaaugcagacuccggauggacaagcugcagcuuaaaggcaugagcuauuccauguguaccgggaaguucaaggugguuaaagagaucgccgaaacccaacauggaacaauugugaucagaguccaguacgagggcgaugggagccccugcaagauucccuucgagaucauggaccuggaaaaacgccacgugcucggacggcugaucacgguuaauccuauugugaccgagaaggauucuccggucaacaucgaagcugagcccccuuuuggcgacuccuacauuaucauugggguggaacccggccagcugaaacucagcugguucaagaagggaucuagcaucggccagauguuugagacaaccaugagaggggccaaacgcauggccauucugggagauacagcuugggacuucggcucccuugggggaguguuuaccucuaucggcaaggcccugcaucaaguuuucggggcgaucuauggcgcugccuuuagcggagucuccuggacgaugaaaauucucaucggcguggugauuacauggaucgggaugaauagccggucuaccucccugagcgucucucuggugcuuguuggaguggucacccucuaccugggcgugaugguucaggccgauuccggguguguggucagcuggaagaacaaagagcugaagugcggauccggcauuuucaucacagacaaugugcacaccuggacagaacaguauaaguuucagccugagucucccagcaaacucgcuuccgccauccaaaaggcucacgaagaggggauuuguggcaucagaucuguuacgcgccuggaaaaccuuauguggaaacagauuaccccggagcugaaucauauccucagcgagaacgaagugaagcugacaauuaugaccggagauaucaaaggcaucaugcaggccgggaagcggucccugagaccucagcccacagagcuuaaauacagcuggaagaccuggggaaaggcgaaaaugcucucuacggaacugcacaaucauaccuuccugauugacggcccugagacagccgaaugccccaacaccaaucgcgcuuggaacucccucgaggucgaggauuauggguuuggaguguucacaaccaauaucuggcugaaacuuaaagaacggcaagagguguuuugugacagcaagcugaugucugccgcuauuaaagacaacagagccguccacgcggauaugggcuacuggaucgaauccgcccucaaugacacauggaagauugagaaggcuagcuucaucgagguuaaaucuugccacuggccuaagagccauacccugugguccaacggcgugcuggaaagcgagaugaucauucccaaaaacuucgccgggccggugucucagcacaauuaucgcccuggauaccauacgcagacagcuggccccuggcaccuugggaagcucgaaauggauuuugacuucugugagggaaccaccgucgugguuacagaagauugcggcaaccgggggcccucccugagaaccacgacagccagcggaaaacugaucaccgaguggugcugucgguccugcacacucccuccgcugcgcuacagaggcgaggacggcuguugguaugggauggaaauucggcccucuaaggagaaggaagagaaucuugugaacagccuggucaccgccggacauggccagaucgauaauuuuucccucggggugcugggaauggcucuguuccuugaagagaugcucagaacacgcguuggcaccaaacacgcgauucugcugguggccgucucuuuugugacgcucaucaccgggaacaugagcuuccgggaccugggaagaguuauggugauggucggcgcuacaaugaccgaugacauuggcaugggggugacauaccuugcccugcucgccgcuuuuaaggugcgcccuaccuucgccgcgggacugcugcuuagaaaacugacguccaaggagcucaugaugacaaccaucggcaucguccugcucucucaaagcacaauucccgaaaccauccuggagcuuaccgaugcucuggcccucgggaugaugguucugaaaauugugcggaauauggaaaaguaucagcuggccgugacaaucauggcuauucuuugcgucccuaacgccgugauccugcagaaugcguggaagguuuccuguacgacccucgcuguggucagcgugucuccccugcuccugacauccagccaacagaaagccgacuggaucccucuugcccugaccauuaagggacucaaccccacagcuaucuuucugaccacgcugucucgcacauccaaaaagagaagcuggccgcuuaaugaggccauuauggcuguuggcauggugucuauccuggccuccagccuccugaaaaacgauauuccuaugaccgggccccucgucgcgggaggccugcuuaccgugugcuacguccugacaggccgguccgccgaccuggaacucgagcgcgcugccgacgugagaugggaggaacaggcugagaucagcgggucuagcccuauccuguccauuaccaucucugaagauggaagcauguccauuaagaaugaggaggaggaacagacacuuacgauccugauucggaccggccuccugguuaucucuggacucuuccccgugagcauuccgaucacagccgccgcuugguaucugugggaagucaaaaagcaacgcgcgggagugcuuugggacguuccuucucccccucccgugggcaaggccgagcuggaagauggggcuuacagaaucaaacagaagggcauucugggcuauagccagaucggcgccggggucuacaaagagggaaccuuucacacaauguggcaugugacccggggcgccgugcucaugcacaaggggaaacgcauugagcccagcugggcugacguuaagaaggaucugaucuccuacggaggcggguggaaacuugaaggagaguggaaggaaggcgaggaaguccaggugcuggcccucgagccuggcaaaaacccgagagcggugcaaacgaagcccgggcuguucaaaaccaauacaggaaccauuggcgcugucagccucgacuuuucuccugggacauccggaagccccaucguggauaagaagggcaaaguuguggggcuguauggaaacggcgucgugacccggucuggcacauacguuuccgccaucgcccagacggaaaagagcauugaagacaacccugagaucgaagaugacauuuuccgcaagaagcgccuuaccaucauggaucugcaucccggggcuggaaaaacaaagcgguaucugccugccauugugagagaggcgaucaagcgcggccuccggacccugauccuugcuccgaccagagucguggccgccgaaauggaggaggcucugcgcgggcuccccauucgguaccagaccccugcuaucagaguugaacacacgggacgcgagauuguggaccugaugugucaugcuaccuucacaaugcggcuccugucccccaucagagucccuaauuauaaccuuauuaucauggaugaagcccacuuuaccgaccccgcgucuauugccgcucggggcuacaucagcacacgcguggagaugggggaggccgcuggcaucuucaugaccgccacgccgccuggauccagagaccccuuuccccagagcaaugccccuauuauggaugaagaacgggaaauccccgagcgcucuuggaacuccggccacgaauggauuacagacuucaaagggaagaccgugugguuugucccuagcaucaaagcuggaaaugauauugcggccugccugagaaagaacggcaaaaagguuauccaacugucucggaagaccuucgacagcgaguauaucaaaacaagaaccaaugauugggacuuuguggugacaaccgauauuuccgagaugggggcuaacuucaaggccgaacgcgucaucgacccgcggagauguaugaaacccgugauucucacggauggagaggaacgcguuauccuggccggcccuaugcccgugacacauucuagcgcugcccagcggagagggcgcgucggccggaauccuaagaacgagaaugaccaguacauuuacaugggagaaccccuugagaacgaugaggacugcgcgcacuggaaagaagcuaagaugcugcucgacaauaucaacaccccggagggcaucauuccuuccauguuugaacccgagagagaaaaaguggaugccaucgacggggaguaucgccugagaggagaggcccggaagacauucguugaucugaugcgcagaggcgaccucccuguguggcuugcuuaccgggucgccgcggaagggauuaauuaugccgaucgcagaugguguuuugacggagugaagaacaaccaaauccuggaggaaaaugucgagguggagauuuggaccaaagaaggcgagcggaagaaacugaagcccagauggcucgaugcucgcaucuacucugacccucuggcccuuaaagaguucaaggaguucgcugccgggcggaagucccugacgcucaaccugauuaccgaaaugggcagacugcccacauuuaugacccagaaagcucgcaaugcccucgauaaccuugcgguucugcauacagccgaggcuggaggccgggccuauaaucacgcucuguccgagcucccggaaacccuggagacacuucugcuccugacccugcucgccacggugacagggggaaucuuccuuuuucugaugagcggcaaggggaucggaaaaaugacccugggcaugugcugcauuaucaccgccucugugcuccugugguacgcucagauucagccucacuggaucgcggccuccauuauccuugaguucuuucugaucguccuccugauucccgagcccgaaaagcaaagaacaccucaggacaaccagcugaccuauguugugaucgcuauucucacaguggucgccgccacgauggcuaaugagaugggcuuccuugagaaaaccaagaaggauuuugggcugggaagcaucgccauucagcaaccggaauccaacauccuggacaucgaucuccggcccgcgucugccuggacacuguacgcuguggccaccacauucauuaccccuaugcuucgccauagcaucgaaaauuccucuguuaacgugagccugacggcuauugccaaucaggcgaccguccucaugggccuggggaaaggauggccccuguccaagauggacaucggcgugccucuccuugccauuggguguuacagccaggucaaccccaucacacugaccgcugcccugcuccugcuuguggcucacuaugccauuaucggaccuggccugcaggcuaaagccacaagagaagcgcaaaagcgggccgcugccggcaucaugaaaaauccgaccguugacgggauuacggugaucgaucucgaccccauuccuuacgaucccaaguuugagaagcagcugggacaggucaugcugcucgugcuuugcguuacacaggugcugaugaugcgcaccacaugggcucugugugaagcccucacccuggccaccggcccuaucucuacacuuugggaggggaaccccggaagauucuggaauacgaccauugcggucuccauggcuaacaucuuucggggcagcuaucuggccggggcuggacuccuguucucuaucaugaaaaauacagccaacacccgcagaggcacaggcaacaccggggagacgcugggagaaaaguggaaaaaucggcucaacgcccuuggcaaguccgaguuucaaauuuacaaaaagagcgggauccaggaaguggaccgcacacuggcuaaagagggaauuaagagaggcgagaccgaucaucacgccgugucucgggggagcgcgaagcugagaugguucguugaacgcaaucucgucaccccggagggaaaagugguggaccugggcugcggcagaggcgggugguccuauuacuguggagggcuuaagaacgucaaagaaguuaaggggcugacaaaaggcgggccuggacaugaggaacccauccccaugucuaccuauggcuggaaucucgugagacugcagagcggcguggaugucuucuuuacaccucccgagaagugcgacacgcugcucugugauauuggggaguccagcccuaacccgaccguggaagccggacgcacacuucggguucugaaucugguggagaacuggcucaauaacaauacccaauucugcaucaagguccugaaccccuacaugccuuccgugaucgagaagauggaggcccuucagagaaaguacggcggggcccugguucgcaauccccucucucggaacagcacacacgaaauguauuggguguccaaugcuucuggaaacauugucagcuccgugaacaugaucucuagaaugcugauuaaucgcuuuaccaugcggcacaaaaaggccacguacgagccugacguggaucugggcagcgggaccagaaacaucggaauugaguccgaaaaacccaaucucgacaucaucggcaagcgcauugagaagaucaaacaggaacaugagacaagcuggcacuaugaucaggaccauccguacaagaccugggcguaucacggcucuuacgaaacaaaacaaaccggguccgccagcucuauggucaacggaguugugcggcuucugacaaagccuugggacgugauucccauggucacccagauggcuaugacggauacaaccccuuucggccagcagagaguguuuaaagagaagguugacacccgcacacaagagcccaaggaagggacgaaaaagcugaugaaaaucaccgccgaguggcucuggaaggaacugggcaaaaagaaaacaccuagaauguguacccgggaggaguucacacgcaaggugagauccaaugcugcccuuggcgcuauuuuuaccgaugaaaacaaguggaaaagcgcccgggaggcggucgaagacucuggguucugggagcuggugaauaaggaaagaaaccuccaccuggagggaaaaugcgagacauguguuuauaauaugaugggcaagcgggagaaaaagcugggcgaguuugggaaggccaaaggaucccgcgcuaucugguacauguggcucggcgccagauuccuggaauuugaggcucuuggguuccugaacgaagaucauugguuuagccgggaaaauucccucagcggaguggagggcgaagggcugcacaaacuuggcuacauucugcgcgacgucucuaaaaaggagggaggcgccauguaugccgaugacaccgcggggugggauacgagaaucacccucgaagaccugaaaaacgaggaaauggugacaaaucauauggagggagagcacaagaagcuggcugaagccaucuucaaacucaccuaccagaacaagguugugcggguccagcgccccacaccgagaggcaccgugauggauauuaucagccggcgcgaccagagaggguccggacaagucgugacguauggccugaauacauucaccaacauggaggcccagcuuauucggcagauggaaggggagggcguuuuuaaaucuauccaacaucugacagugaccgaggaaauugcugucaagaacuggcucgugcgcgugggaagagagcggcugagccgcauggccaucuccggcgacgauugcguugugaaaccucuugacgauagauucgcuucugcccugacggcgcucaaugacauggggaagguccggaaggauauccagcagugggaacccagcagaggauggaacgacuggacccaggugcccuuuugcucccaccacuuccaugagcugauuaugaaagauggccgcguucugguggucccuugucggaaucaagacgaacucaucgggagagcccgcauuucucagggagcuggcuggagccugcgggagacagccugccuugggaaguccuacgcucagauguggagccugauguauuuucacagacgcgaucuccggcuggccgcgaacgccaucuguucugcugugccgucccauuggguccccaccagcagaacaaccuggucuauucacgccacacacgaguggaugaccacggaagacaugcuuacaguguggaaucgcguuuggauccaggagaacccuuggauggaagauaaaacccccguggaguccugggaagagaucccuuaccugggcaagcgggaggaccaauggugcggaagccucauuggccugaccuccagagcuacaugggccaaaaauauccagaccgcuauuaaccagguccgcucucugaucgggaaugaagaguauacagauuacaugcccagcaugaagcgguucagacgggaagaggaagaggccggagugcucugguga

SEQ ID NO: 20258 - RNA, 9876 nt, Artificial Sequence
  derived and/or modified CDS sequence (opt5) from DENV-2__JN851122__SS-prME
accgccggaaucauuaucaugaugauucccaccgugauggcuuuccaccugacgaccagaaacggggagccucauaugaucgucagccggcaggaaaagggaaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauucccagaucggcgccgggguguacaaagaaggaacauuucacaccauguggcaugucacacgcggcgcugugcugaugcacaaggggaaaagaauugagcccuccugggccgacgugaagaaagaucuuaucagcuacggaggcggguggaagcuggagggagaauggaaggagggcgaagagguucagguccucgcgcuggaaccuggcaaaaacccgcgggcugugcaaaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuagccccauccggguuccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggucacggacuucaaggggaagacagugugguuugugccuuccauuaaaaccggaaaugauaucgccgcuugccugcggaagaacggcaaaaaggucauucaacucagcagaaaaaccuucgacucugaauauaucaagacacgcaccaaugauugggacuuuguugugacaaccgauaucagcgagaugggggccaacuucaaggccgagcgggugauugacccgagacgcuguaugaaacccgucauccugacggauggagaagaacgggugauucuugcuggcccuaugcccguuacacauuccucugccgcgcagagacgcgggcgggugggcagaaauccuaagaacgaaaaugaccaguacaucuacaugggagagccccuggaaaacgaugaggacugcgcucacuggaaagaggccaagaugcuccuggacaauauuaacaccccggaaggcaucaucccuagcauguuugagcccgaacgcgagaaagucgaugccauugacggggaauauagacugcggggagaggcucgcaagacauucguggaucucaugagacggggcgaccuuccuguuuggcuggccuaccgcguggcggccgaggggaucaacuaugcugauagacggugguguuuugacggagucaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcugggagaaaaucucucacgcugaaccugaucaccgagaugggccgccuccccacauuuaugacccagaaggccaagaaugcgcuugauaaccuggccgugcugcauacagcugaagccggaggccgggcuuauaaucacgcccucagcgagcugccggagacccuugaaacacugcuccugcugacccuccuugccacgguuacagggggaauuuuccuguuucugauguccggcaaagggaucggaaagaugacccucggcaugugcugcaucauuaccgcuagcauccugcuuugguacgcgcagauucagccucacuggaucgccgcuucuauuauccuggaguucuuucucaucgugcugcugauucccgaacccgagaaacaaagaacaccucaggacaaccagcucaccuauguggucaucgccauucuuacaguuguggccgcuacgauggccaaugaaaugggcuuccuggagaagaccaaaaaggauuuugggcugggauccaucacaacccagcaaccggagagcaacauucucgacaucgaucugcggcccgcguccgccuggacacuuuacgcuguggccaccacguucaucaccccuaugcugcgccauucuauugaaaauagcuccgucaacgugucucucacagcuaucgccaaucaggcgaccguucugaugggccuggggaagggauggccccucagcaaaauggacauuggcgugccucuucuggccaucggguguuacucccaggucaaccccauuacacugaccgcugcccuccugcuucuggugacgcacuaugcuaucauuggaccuggccuccaggccaaggcuacaagagaggcccaaaaacgggcggccgcuggcaucaugaagaauccgaccgucgacgggaugacagugaucgaucuggaccccauuccuuacgaucccaaauuugaaaagcagcugggacagguuaugcuccuugugcugugcgucacccaggugcugaugaugcgcaccacaugggcccucugugaggcucugacgcuugccaccggcccuaucagcacacugugggaagggaaccccggaagauucuggaauaccacaauugccguuucuauggcgaacaucuuucggggcuccuaucucgcuggggccggacugcuguucagcauuaugaagaacaccgcuaauacgcgcagaggcacaggcaacaucggggagacccucggagagaaauggaagaaucggcuuaacgcccugggcaaaucugaauuucaaaucuacaagaaauccgggauucaggagguggaccgcacccuggccaaggaaggaaucaaaagaggcgagacagaucaucacgcugucagccgggggucugccaagcucagaugguucguggagcgcaaucuggugaccccggaaggaaagguugucgaccuuggcugcggcagaggcggguggagcuauuacuguggagggcugaaaaacgugaaggaggugaaagggcucacaaagggcgggccuggacaugaagaacccauucccauguccacguauggcuggaaucuggucagacugcagucuggcguugauguguucuuuaccccucccgaaaaaugcgacacacuccuuugugauaucggggagagcuccccuaacccgaccguggaggcgggacgcacacugcggguccugaaucucguggaaaacuggcugaauaacaauacccaauucugcauuaagguucuuaaccccuacaugccuagcgugaucgagaagauggaagcccugcagagaaaauacggcggggcucucguccgcaauccccugucccggaacucuacgcacgagauguauugggugagcaacgccuccggaaauaucguuucuagcgugaacaugauuuccagaaugcugaucaaucgcuuuaccaugcggcacaagaaagcuacauacgaaccugacgucgaucucggcucugggaccagaaacauuggaaucgagagcgagacacccaaucuugacauuaucggcaagcgcaucgagaaaauuaagcaggagcaugaaaccuccuggcacuaugaucaggaccauccguacaagacaugggccuaucacggcagcuacgagaccaaacaaacggggucugcguccagcauggugaacggagugguccggcugcugacaaagccuugggacguuauccccauggugacccagauggccaugaccgauacaacgccuuucggccagcagagaguguuuaaagaaaaggucgacacccgcacacaagagcccaaagaggggaccaagaagcucaugaaaauuacagcugaauggcuguggaaggagcuuggcaaaaagaaaaccccuagaauguguacacgggaagaguucacccgcaaggugagaucuaaugccgcucugggcgccaucuuuacggaugagaacaaauggaaguccgcucgggaagccguugaggacagcggguucugggaacucguggauaaggagagaaaucugcaccuggaaggaaaaugcgagaccugugucuauaacaugaugggcaagcgggagaaaaagcucggcgaauuugggaaagcgaagggaucucgcgccauuugguacauguggcugggcgcuagauuccuugaguuugaagcccugggguuccucaaugaggaccauugguuuucccgggaaaacagccuguccggaguggagggcgaggggcuucacaagcugggcuacauccuccgcgauguuagcaaaaaggaaggaggcgcuauguaugccgacgauacagccgggugggacaccagaauuacacuggaggaucugaaaaaugaagagauggugaccaaccauauggaaggagagcacaagaaacucgcggaggcuaucuucaagcugacguaccagaauaaggucgugcggguucagcgccccacaccgagaggcaccgugauggacaucauuucucggcgcgaccagagagggagcggacaagucgugacauauggccuuaacaccuucacgaacauggaagcccagcugauccggcagauggagggggaaggcgucuuuaaauccauucaacagcucaccgugaaggaggagaucgccguuaaaaauuggcugauucgcgugggaagagaacggcuuucucgcauggcuaucagcggcgaugacugcgucgugaagccucuggaugacagauucgccuccgcucucacagcccugaacgauauggggaaagugcggaaggacauccagcagugggagcccucuagaggauggaaugauuggacccaaguucccuuuugcagccaucacuuccacgaacugauuaugaaggacggccgcgugcucgucgugccuugucggaaccaggaugagcugaucgggagagcgcgcauuucccagggagccggcuggucucuucgggaaacagcuugccuggggaaaagcuacgcccagauguggucccucauguauuuucauagacgcgaccugcggcuugcugccaaugcgaucuguagcgccguuccgucucacugggugcccaccuccagaacaaccuggagcauucaugcuacgcacgaguggaugacaaccgaggauaugcugaccgucuggaaccgcguguggauccaagaaaauccuuggauggaggacaagacacccgucgaaucuugggaggaaaucccuuaccucggcaaacgggaggaucaguggugcggaucccugauuggccugaccagcagagccacaugggcuaagaacauccagacggccauuaaucaggugcgcucccucaucgggaacgaggaauauaccgacuacaugcccucuaugaaacgguucagacgggaggaagaggaagcuggaguucugugguga

SEQ ID NO: 20259 - RNA, 9876 nt, Artificial Sequence
  derived and/or modified CDS sequence (opt5) from DENV-2__JN851116__SS-prME
accgccggaaucauuaucaugaugauucccacagugauggcuuuccaccugacgaccagaaacggggagccucauaugaucgucagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaauccuggccguuguguccgucagcccccuccugcuuacgucuucccaacagaaggccgacuggauuccucuggcucucaccaucaagggacugaaccccacagccauuuuucugaccacacuuagcagaaccucuaaaaagcgguccuggccgcugaaugaagcuaucauggccgugggcaugguuagcauucucgcgucuucccugcucaaaaacgauaucccuaugacggggccccugguggccggaggccuucugacagucugcuacgugcugaccggccgcagcgcugaccucgagcuggaaagagccgcugacguccggugggaggagcaggccgaaaucuccgggagcucuccuauucuuagcaucaccauuuccgaggauggaucuaugagcaucaagaaugaagaggaggaacagacacugaccauucucauccgcacaggccugcucgugauuuccgggcuguuccccguuucuaucccgaucacggccgcugcgugguaucuuugggaggugaaaaagcaaagagccggaguccugugggacgugccuucucccccucccguuggcaaagcugaacuggaggauggggccuaccggauuaagcagaagggaauccucggcuauucccagauuggcgccgggguguacaaagaaggaaccuuucacacaauguggcaugucacccgcggcgcugugcugaugcacaaggggaaaagaaucgagcccuccugggccgacgugaagaaagaucuuauuagcuacggaggcggguggaagcuggagggagaauggaaggagggcgaagagguucagguccucgcgcuggaaccuggcaaaaacccgcgggcugugcaaacaaagcccggacucuucaaaaccaacacgggaaccaucggcgccgugucccuggacuuuagcccugggacaucuggaucccccaucgucgauaagaaaggcaaggugguugggcuuuauggaaauggcguggucaccagaagcggcacauacgugucugccauugcucagaccgagaaguccaucgaggacaacccugaaauugaggaugacaucuuccgcaaaaagcggcugacaauuauggaucugcaucccggggccggaaaaacgaagagauaucucccugcgaucguucgcgaagcuaucaaacggggccugagaacccuuauucuggccccgacacgcguggucgccgcugagauggaagaggcccuccgggggcugcccaucagauaccagaccccugcuauucgcgccgagcacaccggacgggaaaucguggaccucaugugucaugcgacauucacgaugagacugcuuagccccauucggguuccuaauuauaaccugaucauuauggaugaggcccacuuuaccgaccccgcuuccaucgccgcucgcggcuacaucucuacaagaguggaaaugggggaggccgccggcauuuucaugaccgcuacaccgccuggaagccgggaccccuuuccccaguccaaugcgccuaucauggaugaggaacgcgagauucccgaaagaagcuggaacucuggccacgagugggucaccgacuucaaggggaagacggugugguuugugccuuccaucaaagccggaaaugauauugcugccugccugcggaagaacggcaaaaaggucauccaacucagcagaaaaacauucgacucugaauauaucaagacccgcaccaaugauugggacuuuguugugacaaccgauauuagcgagaugggggccaacuucaaggcugagcgggugaucgacccgagacgcuguaugaaacccgucauucugacagauggagaagaacgggugauccuugccggcccuaugcccguuacccauuccucugcggcucagagacgcgggcgggugggcagaaauccuaagaacgaaaaugaccaguacauuuacaugggagagccccuggaaaacgaugaggacugcgcccacuggaaagaggccaagaugcuccuggacaauaucaacacgccggaaggcaucauuccuagcauguuugagcccgaacgcgagaaagucgaugcuaucgacggggaauauagacugcggggagaggcccgcaagacauucguggaucucaugagacggggcgaccuuccuguuuggcuggcguaccgcguggccgcugaggggauuaacuaugccgauagacggugguguuuugacggagucaaaaauaaccaaauccuggaagagaauguggaagucgagauuuggaccaaggagggcgaaagaaagaaacucaagccccgcuggcuggaugcucggaucuacuccgacccucuugcccugaaagaguucaaggaguucgcugccgggagaaaaucucucacacugaaccugauuaccgagaugggccgccuccccacguuuaugacccagaaggcgaagaaugcccuugauaaccuggcugugcugcauacagccgaagcuggaggccgggccuauaaucacgcccucagcgagcugccggagacccuugaaacacugcuccugcugacccuccuugcuacaguuaccgggggaaucuuccuguuucugauguccggcaaagggaucggaaagaugacgcucggcaugugcugcauuaucacagcgagcauucugcuuugguacgcccagauccagccucacuggauugcugccucuaucauccuggaguucuuucucauugugcugcugauccccgaacccgagaaacaaagaaccccucaggacaaccagcucaccuauguggucauugccauccuuacaguuguggcugccaccauggcgaaugaaaugggcuuccuggagaagaccaaaaaggauuuugggcugggauccauuacgacccagcaaccggagagcaacauccucgacaucgaucugcggcccgccuccgcuuggacacuuuacgccguggcuaccacauucauuaccccuaugcugcgccauucuaucgaaaauagcuccgucaacgugucucucacggccauugcgaaucaggccaccguucugaugggccuggggaagggauggccccucagcaaaauggacaucggcgugccucuucuggcuauuggguguuacucccaggucaaccccaucacacugaccgccgcucuccugcuucugguggcccacuaugcuauuaucggaccuggccuccaggccaaggcgacaagagaggcccaaaaacgggcugccgcuggcaucaugaagaauccgaccgucgacgggaugacggugauugaucuggaccccaucccuuacgaucccaaauuugaaaagcagcugggacagguuaugcuccuugugcugugcgucacacaggugcugaugaugcgcaccacaugggcccucugugaggcccugacccuugcgaccggcccuauuagcacacugugggaagggaaccccggaagauucuggaauacgaccaucgcuguuucuauggccaacauuuuucggggcuccuaucucgcuggggccggacugcuguucagcaucaugaagaacacagccaauacccgcagaggcacaggcaacaccggggagacgcucggagagaaauggaagaaucggcuuaacgcucugggcaaaucugaauuucaaaucuacaagaaauccgggauucaggagguggaccgcacacuggccaaggaaggaaucaaaagaggcgagaccgaucaucacgcggucagccgggggucugccaagcucagaugguucguggagcgcaaucuggugaccccggaaggaaagguugucgaccuuggcugcggcagaggcggguggagcuauuacuguggagggcugaaaaacgugaaggaggugaaagggcucacaaagggcgggccuggacaugaagaacccauucccauguccaccuauggcuggaaucuggucagacugcagucuggcguugauguguucuuuacaccucccgaaaaaugcgacacgcuccuuugugauaucggggagagcuccccuaacccgaccguggaggcuggacgcacacugcggguccugaaucucguggaaaacuggcugaauaacaauacccaauucugcauuaagguucuuaaccccuacaugccuagcgugaucgagaagauggaagcccugcagagaaaauacggcggggcucucguccgcaauccccugucccggaacucuacacacgagauguauugggugagcaacgccuccggaaauaucguuucuagcgugaacaugauuuccagaaugcugaucaaucgcuuuaccaugcggcacaagaaagcgacguacgaaccugacgucgaucucggcucugggaccagaaacauuggaaucgagagcgagacacccaaucuugacauuaucggcaagcgcaucgagaaaauuaagcaggagcaugaaaccuccuggcacuaugaucaggaccauccguacaagacaugggccuaucacggcagcuacgagaccaaacaaacagggucugcuuccagcauggugaacggagugguccggcugcugaccaagccuugggacguuauccccauggugacgcagauggccaugacagauaccaccccuuucggccagcagagaguguuuaaagaaaaggucgacacacgcacgcaagagcccaaagaggggaccaagaagcucaugaaaauuacagcugaauggcuguggaaggagcuuggcaaaaagaaaaccccuagaauguguacacgggaagaguucacccgcaaggugagaucuaaugccgcucugggcgccaucuuuacagaugagaacaaauggaaguccgcgcgggaagccguugaggacagcggguucugggaacucguggauaaggagagaaaucugcaccuggaaggaaaaugcgagaccugugucuauaacaugaugggcaagcgggagaaaaagcucggcgaauuugggaaagcuaagggaucucgcgccauuugguacauguggcugggcgcuagauuccuugaguuugaagcccugggguuccucaaugaggaccauugguuuucccgggaaaacagccuguccggaguggagggcgaggggcuucacaagcugggcuacauccuccgcgauguuagcaaaaaggaaggaggcgccauguaugcggacgauacggcugggugggacaccagaauuacacuggaggaucugaaaaaugaagagauggugaccaaccauauggaaggagagcacaagaaacucgccgaggccaucuucaagcugacauaccagaauaaggucgugcggguucagcgccccaccccgagaggcacggugauggacaucauuucucggcgcgaccagagagggagcggacaagucgugacauauggccuuaacaccuucacaaacauggaagcucagcugauccggcagauggagggggaaggcgucuuuaaauccauucaacagcucaccgugaaggaggagaucgccguuaaaaauuggcugauucgcgugggaagagaacggcuuucucgcauggcuaucagcggcgaugacugcgucgugaagccucuggaugacagauucgccuccgcgcucacggcccugaacgauauggggaaagugcggaaggacauccagcagugggagcccucuagaggauggaaugauuggacccaaguucccuuuugcagccaucacuuccacgaacugauuaugaaggacggccgcgugcucgucgugccuugucggaaccaggaugagcugaucgggagagcucgcauuucccagggagccggcuggucucuucgggaaacagcuugccuggggaaaagcuacgcccagauguggucccucauguauuuucauagacgcgaccugcggcuugcggccaaugcuaucuguagcgccguuccgucucacugggugcccaccuccagaacaaccuggagcauucaugcuacacacgaguggaugaccacggaggauaugcugacagucuggaaccgcguguggauccaagaaaauccuuggauggaggacaagacccccgucgaaucuugggaggaaaucccuuaccucggcaaacgggaggaucaguggugcggaucccugauuggccugaccagcagagccacaugggcuaagaacauccagaccgccauuaaucaggugcgcucccucaucgggaacgaggaauauacagacuacaugcccucuaugaaacgguucagacgggaggaagaggaagcgggaguucugugguga

SEQ ID NO: 20260 - RNA, 9876 nt, Artificial Sequence
  derived and/or modified CDS sequence (opt5) from DENV-2__GU370051__SS-prME
accgccggaaucauuaucaugaugauucccaccgugauggcuuuccaccugacgacccggaacggggaaccucauaugaucgucagccggcaggaaaagggaaaaagccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccucgaaaaugcuuggaaagugagcuguacaacgcuggccguuguguccgucagcccccuccugcuuaccucuucccagcaaaaggccgacuggaucccucuggcucucacaauuaagggacugaaccccaccgccaucuuucugacaacccuuagcagaacgucuaaaaagcgguccuggccgcugaaugaggcuauuauggccgugggcaugguuagcauccucgcgucuucccugcucaaaaacgauauuccuaugacagggccccugguggccggaggccuucugaccgucugcuacgugcugaccggccgcagcgcugaccucgaacuggagagagccgcugacguccggugggaggaacaggccgagaucuccgggagcucuccuauccuuagcauuacaaucuccgaagauggaucuaugagcauuaagaaugaggaggaagaacagacccugacaauccucauucgcacgggccugcucgugaucuccgggcuguuccccguuucuauuccgaucaccgccgcugcgugguaucuuugggaagugaaaaagcagagagccggaguccugugggacgugccuucucccccucccguuggcaaagcugagcuggaagauggggccuaccggaucaagcaaaagggcauucucggcuauucccagaucggcgccgggguguacaaagagggaacauuucacaccauguggcaugucacacgcggcgcugugcugaugcacaaggggaaaagaauugagcccuccugggccgacgugaagaaagaucuuaucagcuacggaggcggguggaagcuggaaggagaguggaaggaaggcgaggaaguucagguccucgcgcuggagccuggcaaaaacccgcgggcugugcagaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucaaacagagaaguccauugaagacaacccugauaucgaggacgauauuuuccgcaaaaagcggcugacgaucauggaccugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaucucaugugucaugcgacguucaccaugagacugcuuagccccauccggguuccuaauuauaaccugauuaucauggacgaggcccacuuuacagaccccgcuuccauugccgcucgcggcuacaucucuaccagaguggaaaugggggaggccgccggcaucuucaugacagcuaccccgccuggaagccgggaucccuuuccccaguccaaugcgccuauuauggacgaggaacgcgagauccccgaaagaagcuggaacucuggccacgagugggucacggauuucaaggggaagacagugugguuugugccuuccauuaaagccggaaaugacaucgcugccugccugcggaagaacggcaaaaaggucauucagcucagcagaaaaaccuucgauucugaauauaucaagacccgcacaaaugacugggauuuuguugugaccacagacaucagcgagaugggggccaacuucaaggcugagcgggugauugauccgagacgcuguaugaaacccgucauccugaccgacggagaagaacgggugauucuugccggcccuaugcccguuacgcauuccucugcggcucaaagacgcgggcgggugggcagaaauccuaagaacgauaaugaccaguacaucuacaugggagaaccccuggagaacgacgaagauugcgcccacuggaaagaggccaagaugcuccuggacaauauuaacacaccggagggcaucaucccuagcauguuugaacccgagcgcgaaaaagucgaugcuauugacggggaguauagacugcggggagaagcccgcaagaccuucguggaucucaugagacggggcgaccuuccuguuuggcuggcguaccgcguggccgcugaggggaucaacuaugccgauagacggugguguuuugacggagucaaaaauaaccagauucuggaggaaaauguggaggucgaaaucuggacaaaggagggcgagagaaagaaacucaagccccgcuggcuggaugcucggauuuacuccgacccucuugcccugaaagaguucaaggaguucgcugccgggagaaaaucucucacccugaaccugaucacggaaaugggccgccuccccaccuuuaugacacaaaaggcgaagaaugcccuugauaaccuggcugugcugcauaccgccgaggcuggaggccgggccuauaaucacgcccucagcgaacugccggagacacuugagacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucagccucacuggaucgcugccucuauuauccuggaguucuuucucaucgugcugcugauucccgagcccgaaaaacagagaaccccucaagacaaccagcucacauauguggucaucgccauucuuaccguuguggcugccacaauggcgaaugagaugggcuuccuggaaaagacgaaaaaggauuuugggcugggauccaucaccacacagcagccggagagcaacauucucgacaucgaccugcggcccgccuccgcuuggacccuuuacgccguggcuacaaccuucaucacgccuaugcugcgccauucuauugagaauagcuccgucaacgugucucucaccgccaucgcgaaucaagccacaguucugaugggccuggggaagggauggccccucagcaaaauggauauuggcgugccucuucuggcuaucggguguuacucccaggucaaccccauuacccugacagccgcucuccugcuucugguggcccacuaugcuaucauuggaccuggccuccaggccaaggcgaccagagaagcccagaaacgggcugccgcuggcaucaugaagaauccgacggucgacgggaucacagugauugaucuggaccccaucccuuacgaucccaaauuugagaagcaacugggacagguuaugcuccuugugcugugcgucacccaggugcugaugaugcgcacaaccugggcccucugugaagcccugacccuugcgacaggcccuauuagcacgcugugggaggggaaccccggaagauucuggaauaccacaaucgcuguuucuauggccaacauuuuucggggcuccuaucucgcuggggccggacugcuguucagcaucaugaagaacaccgccaauacacgcagaggcaccggcaacacgggggaaacacucggagagaaauggaagaaucggcuuaacgcucugggcaaaucugaguuucagaucuacaagaaauccgggauucaagaaguggaccgcacccuggccaaggagggaaucaaaagaggcgaaaccgaucaucacgcggucagccgggggucugccaagcucagaugguucguggagcgcaaucuggugacaccggagggaaagguugucgaccuuggcugcggcagagggggauggagcuauuacuguggcgggcugaaaaacgugaaggaagugaaaggacucaccaagggcgggccuggacaugaggaacccauucccauguccacauauggcuggaaucuggucagacugcagucuggcguugauguguucuuuacgccucccgagaaaugcgacacccuccuuugugauaucggggaaagcuccccuaacccgacaguggaggcuggacgcacccugcggguccugaaucucguggagaacuggcugaauaacaauacacaguucugcauuaagguucuuacccccuacaugccuagcgugaucgaaaagauggaggcccugcaaagaaaauacggcggggcucucguccgcaacccccuguccagaaauucuacgcacgaaauguauugggugagcaacgccuccggaaacaucguuucuagcgugaauaugauuuccagaaugcugaucaaccgcuuuaccaugcggcacaagaaagcgacauacgagccugacgucgaucucggcucugggaccagaaauauuggaaucgaaagcgagacacccaaccuugacauuaucggcaagcgcaucggcaaaauuaagcaggagcaugaaaccuccuggcacuaugaccaggaucauccguacaagacaugggccuaucacgggagcuacgagaccaaacagacgggaucugcuuccagcauggugaauggcgugguccggcugcugacaaagccuugggacguuauccccauggugacccaaauggccaugaccgauacaacgccuuucgggcagcagagaguguuuaaagaaaaggucgacacccgcacacaggagcccaaagaaggaaccaagaagcucaugaaaauuacagcugaguggcuguggaaggagcuuggcaaaaagaaaaccccuagaauguguacacgggaagaguucacccgcaaggugagaucuaacgccgcucugggggccaucuuuacggaugaaaauaaauggaaguccgcgcgggaggccguugaggacagcggauucugggaacucguggauaaggagagaaaccugcaccuggaaggcaaaugcgagaccugugucuauaauaugaugggcaagcgggagaaaaagcucggggaguuuggaaaagcuaagggcucucgcgccauuugguacauguggcugggggcuagauuccuugaguuugaagcccugggauuccucaacgaggaccauugguuuucccgggaaaauagccuguccggcguggagggggaaggccuucacaagcugggauacauccuccgcgauguuagcaaaaaggagggcggggccauguaugcggacgauacagcuggaugggacaccagaauuacacuggaggaccugaaaaacgaagagauggugaccaaucauauggaaggcgagcacaagaaacucgccgaagccaucuucaagcugacguaccaaaacaaggucgugcggguucagcgccccacaccgagagggaccgugauggauaucauuucucggcgcgaccagagaggaagcggccaggucgugacauaugggcuuaauaccuucacgaacauggaggcucaacugauccggcagauggagggcgaaggagucuuuaaauccauucagcaacucaccgugaaggaggaaaucgccguugagaacuggcugaugcgcgugggcagagagcggcuuucucgcauggcuauuagcggggaugacugcgucgugaaaccucuggaugacagauucgccuccgcgcucacagcccugaaugauaugggaaaggugcggaaagacauccagcagugggaacccucuagaggcuggaacgauuggacccagguucccuuuugcagccaucacuuccacgagcugaucaugaaggacgggcgcgugcucgucgugccuugucggaaucaagaugaacugauuggacgggcucgcaucucccagggcgccggguggucucuucgggagacagcuugccugggcaagagcuacgcccagauguggucccucauguauuuucauagacgcgaccugcggcuugcggccaacgcuauuuguagcgccguuccgucucacugggugcccaccuccagaacaaccuggagcauccaugcuacgcacgaauggaugacaaccgaggauaugcugaccgucuggaaucgcguguggauucaggagaacccuuggauggaagacaaaacacccgucgagucuugggaagagaucccuuaccucggaaagcgggaagaccaauggugcggcucccugaucgggcugaccagcagagccacaugggcuaaaaauauucagacggccaucaaccaggugcgcucccucauuggaaaugaggaguauaccgauuacaugcccucuaugaagcgguucagacgggaagaggaagaggcgggcguucugugguga

SEQ ID NO: 20261 - RNA, 9876 nt, Artificial Sequence
  derived and/or modified CDS sequence (opt5) from DENV-2__EU359009__SS-prME
accgccggaaucauuaucaugaugauucccaccgugauggcuuuccaccugacgaccagaaacggggaaccucauaugaucgucagccggcaggaaaagggaaagagccugcuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaagcgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccaucgcgccuuccaugacgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcaucgaagcuaaacugacgaacacaaccaccgccucucgguguccgacacagggggagcccucccucaaugaggaacaagauaagcgcuuugugugcaaacauagcaugguggacagaggauggggcaacggcugugggcuguucggaaagggcgggauugugaccugcgcgauguuuacaugcaagaaaaauauggagggaaagaucguucagccugaaaaccuggaguauacgauugugaucacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaaaacaaggccuggcucgugcaccgccaaugguuucuggaucuuccguucccuuggcugcccggcgcugacacccagggguccaacuggauccagaaagagacacucgucaccuuuaagaauccucacgccaagaaacaggaugugguugugcugggaagccaagagggcgccaugcauacggcucugacaggggcgaccgaaauucagauguccucuggcaaccuccuguucacaggacaccuuaagugcagacugcggauggacaaacuccagcugaagggcaugagcuauuccauguguaccgggaaauucaaggucgugaaggagaucgccgaaacccaacauggaacaauugucaucagagugcaguacgagggcgacgggagccccugcaaaauccccuuugagauuauggaucuugaaaagcgccacguucugggacggcucaucacggugaauccuauugucaccgagaaagacucuccggugaacaucgaagcugagcccccuuucggcgauuccuacauuaucauugggguugaacccggccagcugaagcugagcugguuuaaaaagggaucuagcaucggccagauguucgagacaaccaugagaggggccaagcgcauggccauccucggagacacagcuugggauuuuggcucccucgggggaguguucaccucuauuggcaaagcccuucaucaagucuuuggggcgaucuauggcgcugccuucagcggaguguccuggacgaugaagauucugaucggcgugguuauuacauggaucgggaugaauagccggucuaccucccucagcgucucucuggugcuggugggagucgugacccuuuaccucggcguuauggugcaggccgacuccgggugugucgugagcuggaaaaacaaggagcugaaaugcggauccggcaucuuuauuacagauaauguucacaccuggacagaacaguauaaguuccagccugagucucccagcaagcuggcuuccgccauccaaaaagcucacgaagaggggauuuguggcaucagaucugugacgcgccucgaaaaccugauguggaagcagauuaccccggagcuuaaucauauccugagcgagaacgaagucaaacucacaaucaugaccggagacauuaagggcaucaugcaggccgggaaacggucccugagaccucagcccacagagcugaaguacagcuggaaagcguggggaaaggccaagaugcuuucuaccgaacuccacaaucauacguuucugauugauggcccugagaccgcugaaugccccaacacaaaucgcgccuggaacucccuggagguggaggacuauggguucggaguuuuuaccacaaauaucuggcucaaacugaaggaacggcaagauguguucugugacagcaaacuuaugucugcugccauuaaggacaacagagcgguccacgccgauaugggcuacuggaucgaguccgcucugaacgacaccuggaaaaucgaaaaggccagcuucauugaggugaagucuugccacuggccuaaaagccauacacucugguccaauggcgugcuggagagcgaaaugaucauucccaagaacuuugcugggccggucucucagcacaauuaucgcccuggauaccauacccagacggccggccccuggcaccuggggcggcuugagauggauuucgacuuuugugaaggaacaaccguuguggugaccgaggauugcggcaacagagggcccucccuccggacaaccacggccagcggaaaacugaucacagaauggugcugucgcuccugcacccugccuccgcucagauaccggggcgaggacggcuguugguaugggauggagauuagaccccugaaggaaaaagaggaaaaucuugucaacucucuggugacagcuggacauggccagaucgauaauuucagccucgggguucugggaauggcgcuguuucuugaggaaaugcuccgcacccgggugggcacaaagcacgccauucugcuggucgcuguguccuucguuacccucaucacggggaacaugucuuuuagagaccugggacgcgugauggucauggugggcgccaccaugacagaugacaucggcauggggguuaccuaccuugcccugcucgcugccuucaaggugagaccuacauuugcggcuggacugcugcuucggaaacugaccagcaaggagcucaugaugacgacaauuggcaucguccugcucucccaaucuaccauucccgagacaauccuggaacuuaccgaugcccuggcccucgggaugauggugcugaaaauugugcgcaauauggagaaguaucagcuggcugucaccaucauggccauccuuugcguuccuaacgcggugauucugcagaaugcuuggaaagugagcuguacaacgcucgccgucguguccguuagcccccugcuccugaccucuucccaacagaaggccgacuggaucccucuugcucugacaauuaagggacucaaccccaccgccaucuuccugacaacccugagcagaacgucuaaaaagcgguccuggccgcuuaaugaagcuauuauggccgugggcauggucagcauccuggcgucuucccuccugaaaaacgauaucccuaugacagggccccucguggccggaggccugcuuaccguuugcuacgugcugaccggccgcagcgcugaccuggagcucgaaagagccgcugacguccggugggaggagcaggccgaaauuuccgggagcucuccuauccugagcauuacaaucuccgaggauggaucuaugagcauuaagaaugaagaggaggaacagacccuuacaauccugauucgcacgggccuccuggugaucuccgggcucuuucccgucucuaucccgauuaccgccgcugcgugguaucugugggaggugaaaaagcaaagagccggaguucuuugggacgugccuucucccccucccgucggcaaagcugaacuggaggauggggccuaccggaucaagcagaagggcauucugggcuauucccagaucggcgccgggguguacaaagaaggaacauuccacaccauguggcauguuacacgcggcgcugugcucaugcacaaggggaaaagaauugagcccuccugggccgacgucaagaaagaucugaucagcuacggaggcggguggaaacuugagggagaauggaaggagggcgaagagguccaggugcuggcgcucgaaccuggcaaaaacccgcgggcuguucaaaccaagcccgggcuguuuaaaacgaacaccggaacaaucggcgccgucucccucgacuucagcccugggaccucuggaucccccauuguggauaagaaaggcaagguggucgggcuguauggaaauggcgugguuacaagaagcggcaccuacgugucugccaucgcucagacagagaaguccauugaggacaacccugaaaucgaggaugacauuuuccgcaaaaagcggcuuacgaucauggaucugcaucccggggccggaaaaaccaagagauaucugccugcgaucguccgcgaagcuauuaaacggggccucagaacacugauccuugccccgacccgcgugguugccgcugagauggaagaggcccugcgggggcuccccauuagauaccagaccccugcuauccgcgccgagcacacaggacgggaaauuguggaccugaugugucaugcgacguuuaccaugagacuccugagccccauccgggucccuaauuauaaccuuauuaucauggaugaggcccacuucacagaccccgcuuccaucgccgcucgcggcuacauuucuaccagaguggaaaugggggaggccgccggcaucuuuaugacagcuaccccgccuggaagccgggaccccuucccccaguccaaugcgccuauuauggaugaggaacgcgagauccccgaaagaagcuggaacucuggccacgaguggguuacggacuuuaaggggaagacagugugguucgucccuuccauuaaagccggaaaugauaucgcugccugccugcggaagaacggcaaaaaggugauccaacugagcagaaaaaccuuugacaccgaauauauuaagacacgcaccaaugauugggacuucguggucacaaccgauaucucugagaugggggccaacuuuaaggcugagcggguuauugacccgagacgcuguaugaaacccgugauccucacggauggagaggaacgggugauucuggccggcccuaugcccgucacacauagcuccgcggcucagagacgcgggcgggugggcagaaauccuaagaacgaaaaugaccaguacaucuacaugggagagccccuugaaaacgaugaggacugcgcccacuggaaagaggccaagaugcugcucgacaauaucaacaccccggaaggcauuaucccuucuauguucgagcccgaacgcgagaaaguugaugcuauugacggggaauauagacugcggggagaggcccgcaagacauuuguggaucugaugagacggggcgaccucccugucuggcuugcguaccgcguggccgcugaggggaucaacuaugccgauagacggugguguuucgacggaguuaaaaauaaccaaauucuggaagagaauguggaagucgagaucuggaccaaggagggcgaaagaaagaaacugaagccccgcuggcucgaugcucggauuuacagcgacccucuggcccuuaaagaguucaaggaauuugcugccgggagaaaaucccugacgcucaaccugaucaccgagaugggccgccugcccacauucaugacccagaaggcgcggaaugcccucgauaaccuugcugugcugcauacagccgaagcuggaggcagagccuauaaucacgcccugucugagcucccggagacccuggaaacacuucugcuccugacccugcucgcuacggucacagggggaaucuuucuuuuccugaugagcggcaaggggauuggaaaaaugacccugggcaugugcugcaucauuaccgcguccauccuccugugguacgcccagauucagccucacuggaucgcugccagcaucauucuugaguuuuuccugaucgugcuccugauucccgaacccgagaagcaacggacaccucaggacaaccagcugaccuauguugugaucgccauucucacaguggucgcugccacgauggcgaaugaaaugggcuuucuugagaaaaccaagaaagauuucgggcugggaucuaucacaacccagcaaccggaguccaacauccuggacauugaucuccgccccgccagcgcuuggacacuguacgccguugcuaccacguuuaucaccccuaugcuuagacauuccauugaaaauucuagcgugaacgugucccugacagccaucgcgaaucaggccaccguccucaugggccuggggaagggauggccccugucuaagauggacauuggcgugccucuccuugcuaucggguguuacagccagguuaaccccauuacacugaccgccgcucugcuccugcuuguggcccacuaugcuaucaucggaccuggccugcaggccaaagcgacgcgggaggcccaaaagcgcgcugccgcuggcauuaugaaaaauccgacagucgacgggaucaccgugauugaucucgaccccaucccuuacgaucccaaguucgaaaaacagcugggacaggucaugcugcucgugcuuugcguuacacaggugcugaugaugagaaccaccugggcccugugugaggcccucacacuggcgacgggcccuauuuccacccuuugggaagggaaccccggacgguuuuggaauacaaccaucgcugucagcauggccaacaucuuccgcggcucuuaucuggcuggggccggacuccuguuuuccauuaugaagaacacagccaauaccagacggggcacgggcaacacaggggagacccugggagagaaguggaaaaaucgccucaacgcucuuggcaagagcgaguuccaaaucuacaaaaagucugggauucaggagguggacagaacccuggccaaagaaggaaucaagcggggcgagacagaucaucacgcgguuuccagagggagcgccaaacugcgcugguucguggagcggaaucucgucaccccggaaggaaaggugguggaccugggcugcggcagagggggauggucuuauuacuguggcgggcuuaagaacguuaaagaggucaagggacugacaaaaggcgggccuggacaugaagaacccauucccaugagcacguauggcuggaaucucgugcgccugcaguccggcguggaugucuuuuucaccccucccgaaaagugcgacacacugcucugugauaucggggagucuagcccuaacccgaccguugaggcuggacggacacuuagagugcugaaucugguggaaaacuggcucaauaacaauacccaauuuugcaucaaaguccugaaccccuacaugccuuccgugauugagaagauggaagcccuucagcgcaaguacggcggggcucugguucggaauccccucagcagaaacuccacgcacgagauguauugggugucuaacgccagcggaaauaucgucuccucugugaacaugauuagccgcaugcugaucaaucgguucaccaugagacacaaaaaggcgacauacgaaccugacguugaucugggcuccgggacccgcaacauuggaaucgagucugagacacccaaucucgacaucauuggcaaacggaucgaaaagauuaaacaggagcaugaaaccagcuggcacuaugaucaggaccauccguacaagacaugggccuaucacggcuccuacgagaccaagcaaacggggagcgcuucuuccauggugaacggagucgugagacuucugacaaaaccuugggacgugauccccauggucacccagauggccaugaccgauacaacgccuuuuggccagcagcgcguuuucaaggaaaaaguggacaccagaacacaagagcccaaggaggggaccaaaaagcugaugaagauuacagcugaauggcucuggaaagagcugggaaagaaaaagaccccucggauguguacacgcgaagaguuuaccagaaaagugcggagcaaugccgcucuuggcgccaucuucacggaugagaacaaguggaaaucugcgagagaagccgucgaggacuccggguuuugggaacugguggauaaggagcggaaucuccaccuggaaggaaagugcgagaccuguguuuauaacaugaugggcaaacgcgagaagaaacugggcgaguucgggaaggcuaaaggaagcagagccauuugguacauguggcucggcgcucgguuucuggaguucgaagcccuuggguuucugaaugaggaccauugguucucucgcgaaaacucccucagcggaguggagggcgaggggcugcacaaacuuggcuacauccugagagaugucuccaagaaagaaggaggcgccauguaugcggacgauacagcugggugggacacccggaucacacucgaggaucugaagaaugaagagauggugaccaaccauauggaaggagagcacaaaaagcuggccgaggccauuuuccgccucacguaccagaauaaaguugugagaguccagcggcccacaccgcgcggcaccgugauggacaucauuagcagacgggaccagcgcgggucuggacaaguugugacauauggccugaacaccuuuacgaacauggaagcucagcuuaucagacagauggagggggaaggcgucuucaagagcauucaacaucugaccgugacagaggagaucgccgucaagaauuggcucgugcggguuggacgcgaaagacugucccggauggcuaucucuggcgaugacugcguggucaaaccucuugaugacagauuugccagcgcgcugaccgcccucaacgauauggggaaggugcgcaaagacauucagcagugggagcccucccggggauggaaugauuggacacaggugcccuucugcucucaccacuuucaugaacugaucaugaaggacggcagaguucugguggucccuugucgcaaccaagaugagcucauugggcgggcuagaaucagccagggagccggcuggucccugcgcgaaaccgcuugccuugggaaaucuuacgcccagauguggagccugauguauuuccaccggagagaccuccgccuggcggccaaugcuauuuguuccgccgugccgagccauuggguucccacaucucggaccacgugguccauccacgcuacacacgaguggaugaccaccgaggauaugcuuacaguguggaacagagucuggauccaggaaaauccuuggauggaggacaagacccccguggaaagcugggaggaaauuccuuaccugggcaagcgcgaggaucaauggugcggaucucucaucggccugacaucccgggccacgugggcuaaaaacauucagaccgccaucaaucaggucagaagccugauugggaacgaggaauauacagacuacaugcccuccaugaagcgguuuagacgcgaggaagaggaagcgggagugcucugguga

SEQ ID NO: 20262 - RNA, 9876 nt, Artificial Sequence
  derived and/or modified CDS sequence (opt5) from DENV-2__KC131142__SS-prME
accgccggaaucauuaucauggugauucccaccgucauggcuuuccaccugacgacccggaacggggagccucauaugaucguuagccggcaggaaaagggaaagagccuccuguuuaagacagagaauggacuuaacaugugcacccugauggccauggaccucggggaacugugugaggauaccauuaccuacaauugcccgcuucugcgccaaaacgaacccgaggacaucgauuguuggugcaauucuaccagcaccugggugacguauggaaccuguacagcgaccggcgagcacagacgggaaaaacgcuccguggcucucgucccucauguggggaugggacuggagacaagaaccgaaacguggaugucuagcgagggcgccuggaagcacgcccagcggaucgagacauggguucugcgccaucccggcuucaccauuauggcugccauccucgcuuacacaauugggaccaccuauuuucagagagugcugaucuucauucuucugacagccaucgcgccuuccaugacgaugcggugcauuggaaucucuaaccgcgacuuugucgaaggcgugagcgggggauccuggguugauaucgugcucgagcacggcagcugugucaccacaauggccaaaaauaagcccacccuggacuucgaacuuauuaagacagaggcuaaacacccugccacccugagaaaguacugcaucgaagcuaaacucacgaacacaaccaccgccucucgguguccgacacagggggagcccucccugaaugaggaacaagauaagcgcuuugugugcaaacauagcaugguggacagaggauggggcaacggcugugggcuguucggaaagggcgggauugugaccugcgcgauguuuacaugcaagaaaaauauggagggaaagaucguucagccugaaaaccucgaguauacgauugugaucacaccccacucuggcgaagagaaugccguggggaacgauacaggaaaacauggcaaggagaucaaagucaccccucaguccagcauuacagaagcugagcugaccggcuacgggacggugaccauggaauguucuccccggacaggacuugacuucaaugagaugguucugcuccagauggaaaacaaggccuggcuggugcaccgccaaugguuucuugaucugccgcucccuuggcugcccggcgcugacacccagggguccaacuggauccagaaagagacacuggucaccuucaagaauccucacgccaagaaacaggaugugguugugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauugucaucagagugcaguacgagggcgacgggagccccugcaaaauccccuucgagauuauggaucucgaaaagcgccacguucugggacggcugaucacggugaauccuauugucaccgagaaagacucuccggugaacaucgaagcugagcccccuuuuggcgauuccuacauuaucauugggguugaacccggccagcucaagcugagcugguucaaaaagggaucuagcaucggccagauguuugagacaaccaugagaggggccaagcgcauggccauccuuggagacacagcuugggauuucggcucccucgggggaguguuuaccucuauuggcaaagcccuccaucaagucuucggggcgaucuauggcgcugccuuuagcggaguguccuggacgaugaagauucugaucggcgugguuauuacauggaucgggaugaauagccggucuaccucccugagcgucucucuugugcucgugggagucgugacccuguaccugggcguuauggugcaggccgacuccgggugugucgugagcuggaaaaacaaggagcucaaaugcggauccggcaucuucauuacagauaauguucacaccuggacagaacaguauaaguuucagccugagucucccagcaagcuggcuuccgccauccaaaaagcucacgaagaggggauuuguggcaucagaucugugacgcgccuugaaaaccugauguggaagcagauuaccccggagcucaaucauauccugagcgagaacgaagucaaacugacaaucaugaccggagacauuaagggcaucaugcaggccgggaaacggucccuuagaccucagcccacagagcucaaguacagcuggaaagcguggggaaaggccaagaugcugucuaccgaacugcacaaucauacguuccucauugauggcccugagaccgcugaaugccccaacacaaaucgcgccuggaacucccuggagguggaggacuauggguuuggaguuuucaccacaaauaucuggcuuaaacugaaggaacggcaagauguguuuugugacagcaaacucaugucugcugccauuaaggacaacagagcgguccacgccgauaugggcuacuggaucgaguccgcucugaacgacaccuggaaaaucgaaaaggccagcuucauugaggugaagucuugccacuggccuaaaagccauacacugugguccaauggcgugcuugagagcgaaaugaucauucccaagaacuucgcugggccggucucucagcacaauuaucgcccuggauaccauacccagacggccggccccuggcaccucgggcggcuggagauggauuuugacuucugugaaggaacaaccguuguggugaccgaggauugcggcaacagagggcccucccugcggacaaccacggccagcggaaaacucaucacagaauggugcugucgcuccugcacccugccuccgcuuagauaccggggcgaggacggcuguugguaugggauggagauuagaccccugaaggaaaaagaggaaaaucucgucaacucucuggugacagcuggacauggccagaucgauaauuuuagccuggggguucuuggaauggcgcuguuccuggaggaaaugcugcgcacccgggugggcacaaagcacgccauucuccuggucgcuguguccuuuguuacccuuaucacggggaacaugucuuucagagaccugggacgcgugauggucauggugggcgccaccaugacagaugacaucggcauggggguuaccuaccucgcccugcuggcugccuuuaaggugagaccuacauucgcggcuggacuucugcuccggaaacugaccagcaaggagcucaugaugacgacaauuggcaucguccugcuuucccaaucuaccauucccgagacaauccuggaacucaccgaugcccuggcccuggggaugauggugcuuaaaauugugcgcaauauggagaaguaucagcuggcugucaccaucauggccauccucugcguuccuaacgcggugauucugcagaaugcuuggaaagugagcuguacaacgcucgccgucguguccguuagcccccugcuucugaccucuucccaacagaaggccgacuggaucccucucgcucugacaauuaagggacugaaccccaccgccaucuuucuuacaacccugagcagaacgucuaaaaagcgguccuggccgcucaaugaagcuauuauggccgugggcauggucagcauccuggcgucuucccuccugaaaaacgauaucccuaugacagggccccuuguggccggaggccugcugaccguuugcuacgugcucaccggccgcagcgcugaccuggagcuugaaagagccgcugacguccggugggaggagcaggccgaaauuuccgggagcucuccuauccugagcauuacaaucuccgaggauggaucuaugagcauuaagaaugaagaggaggaacagacccucacaauccugauucgcacgggccuccuggugaucuccgggcuuuuccccgucucuaucccgauuaccgccgcugcgugguaucugugggaggugaaaaagcaaagagccggaguucugugggacgugccuucucccccucccgucggcaaagcugaacucgaggauggggccuaccggaucaagcagaagggcauucugggcuauucccagaucggcgccgggguguacaaagaaggaacauuucacaccauguggcauguuacacgcggcgcugugcuuaugcacaaggggaaaagaauugagcccuccugggccgacgucaagaaagaucugaucagcuacggaggcggguggaagcucgagggagaauggaaggagggcgaagagguccaggugcuggcgcucgaaccuggcaaaaacccgcgggcuguucaaaccaagcccgggcuguucaaaacgaacaccggaacaaucggcgccgucucccuugacuuuagcccugggaccucuggaucccccauuguggauaagaaaggcaagguggucgggcuguauggaaauggcgugguuacaagaagcggcaccuacgugucugccaucgcucagacagagaaguccauugaggacaaccuggaaaucgaggaugacauuuuccgcaaaaagcggcucacggucauggaucugcauccuggggccggaaaaaccaagagauaucuucccgcgaucgugcgcgaagcuaucaaacggggccugagaacacucauucuggccccuacccgcguuguggccgcugagauggaagaggcccuccgggggcugccgaucagauaccagacccccgcuauucgcgccgagcacacaggacgggaaaucgucgaccuuaugugucaugcgacguucaccaugagacugcugagcccuauucgggugcccaauuauaaccucaucauuauggaugaggcccacuuuacagacccugcuuccaucgccgcucgcggcuacaucucuaccagaguugaaaugggggaggccgccggcauuuucaugacagcuacacccccgggaagccgggacccuuuuccccaguccaaugcgcccaucauggaugaggaacgcgagauuccugaaagaagcuggaacucuggccacgagugggugacggacuucaaggggaagacagucugguuugugcccuccaucaaagccggaaaugauauugcugccugccugcggaagaacggcaaaaaggugauccaacuuagcagaaaaaccuucgacaccgaauauaucaagacacgcaccaaugauugggacuuugucguuacaaccgauauuucugagaugggggccaacuucaaggcugagcgggugaucgacccuagacgcuguaugaaaccggugauucugacggauggagaggaacgggucauccucgccggccccaugccugugacacauagcuccgcggcucagagacgcgggcggguuggcagaaaucccaagaacgaaaaugaccaguacauuuacaugggagagccucuggaaaacgaugaggacugcgcccacuggaaagaggccaagaugcugcucgacaauaucaacacccccgaaggcaucauuccgucuauguuugagccugaacgcgagaaaguggaugcuaucgacggggaauauagacuucggggagaggcccgcaagacauucgucgaucugaugagacggggcgaccugcccguguggcucgcguaccgcguugccgcugaggggauuaacuaugccgauagacggugguguuuugacggagugaaaaauaaccaaauccuggaagagaaugucgaaguggagauuuggaccaaggagggcgaaagaaagaaacuuaagccucgcuggcuggaugcucggaucuacagcgacccccucgcccugaaagaguucaaggaguucgcugccgggagaaaaucccugacgcucaaccuuauuaccgagaugggccgccugccuacauuuaugacccagaaggcgcggaaugcccuggauaaccucgcuguccugcauacagccgaagcuggaggcagagccuauaaucacgcccuuucugagcugcccgagacccucgaaacacugcugcuccuuacccugcuggcuacggugacagggggaaucuuccucuuucugaugagcggcaaggggaucggaaaaaugacccuuggcaugugcugcauuaucaccgcguccauucugcucugguacgcccagauccagccgcacuggauugcugccagcaucauccuggaguucuuucugauuguucuccuuaucccugaacccgagaagcaacggacaccccaggacaaccagcugaccuauguggugauugccauccugacagucguugcugccacgauggcgaaugaaaugggcuuccucgagaaaaccaagaaagauuuugggcugggaucuauuacaacccagcaaccugaguccaacauccuugacaucgaucugcgcccggccagcgcuuggacacucuacgccguggcuaccacguucauuacccccaugcugagacauuccaucgaaaauucuagcgugaacgucucccugacagccauugcgaaucaggccaccgugcucaugggccuugggaagggauggccucugucuaagauggacaucggcguuccccugcucgcuauuggguguuacagccaggugaacccuaucacacugaccgccgcccuucugcuccuggucgcccacuaugcuauuaucggacccggccugcaggccaaagcgacgcgggaggcccaaaagcgcgcugccgcuggcaucaugaaaaauccuacaguggacgggauuaccgucaucgaucucgacccgauucccuacgauccuaaguuugaaaaacagcuuggacaggugaugcugcugguucucugcgugacacagguccugaugaugagaaccaccugggcccuuugugaggcccugacacucgcgacgggccccaucuccacccugugggaagggaacccuggacgguucuggaauacaaccauugcugugagcauggccaacaucuuucgcggcucuuaucuggcuggggccggacuccuuuucuccaucaugaagaacacagccaauaccagacggggcacgggcaacacaggggagacccugggagagaaguggaaaaaucgccugaacgcucucggcaagagcgaauuucaaauuuacaaaaagucugggauccaggagguugacagaacccuggccaaagaaggaauuaagcggggcgagacagaucaucacgcgguguccagagggagcgccaaacuucgcugguucgucgagcggaaucuggugacccccgaaggaaaggugguugaccucggcugcggcagagggggauggucuuauuacuguggcgggcugaagaacgucaaagaggugaagggacugacaaaaggcgggccgggacaugaagaaccuauccccaugagcacguauggcuggaaucucgugcgccuucaguccggcgucgauguuuucuuuacacccccugaaaagugcgacacacugcugugugauauuggggagucuagccccaacccuaccguggaggcuggacggacacucagagugcugaaucuugucgaaaacuggcugaauaacaauacccaauucugcaucaaagugcucaacccguacaugcccuccguuaucgagaagauggaagcccugcagcgcaaguacggcggggcucuggugcggaauccucucagcagaaacuccacgcacgagauguauugggucucuaacgccagcggaaauauuguguccucuguuaacaugaucagccgcaugcuuauuaaucgguuuaccaugagacacaaaaaggcgacauacgaacccgacguggaucugggcuccgggacccgcaacaucggaauugagucugagacaccuaaucuggacaucaucggcaaacggauugaaaagaucaaacaggagcaugaaaccagcuggcacuaugaucaggaccaucccuacaagacaugggccuaucacggcuccuacgagaccaagcaaacggggagcgcuucuuccauggucaacggaguggugaaacuccugacaaagccgugggacgucauuccuaugguuacccagauggccaugaccgauacaacgcccuucggccagcagagaguguuuaaagaaaagguggacacccgcacacaagagccuaaagaggggaccaagaaacuuaugaaaaucacagcugaauggcuguggaaggagcucggcaagaagaaaacccccagaauguguacacgggaagaguucacccgcaaggucagaagcaaugccgcucugggcgccauuuuuacggaugagaacaaauggaagucugcgagaggggcuguggaagacuccggauucugggagcugguugauaaggaaagaaaucuccaccuggagggcaaaugcgaaaccuguguguauaacaugaugggcaagcgggagaagaaacuuggggaguuuggaaaagcuaaaggcagccgcgccaucugguacauguggcugggggcuagauuccucgaauuugaggcccugggauuccuuaaugaagaccauugguuuucucgggagaacucccugagcggcgucgaaggggagggccuccacaagcugggauacauucugcgcgauguguccaaaaaggagggcggggccauguaugcggacgauacagcuggaugggacaccagaaucacacucgaagaucugaaaaaugaggaaaugguuaccaaccauauggagggcgugcacaagaaacuugccgaagccaucuuccggcugacguaccagaauaaggucgugcgcguucagagaccuacaccccgggggaccgugauggacauuaucagccgcagagaccagcggggaucuggccaagucgugacauaugggcucaacaccuucacgaacauggaggcucagcugauucgccagauggagggcgaaggagucuuuaagagcauccaacaucuuaccgugacagaggaaauugccguuaaaaauuggcuggugagagucggccgggagcgccucuccagaauggcuaucucuggggaugacugcguggugaagccgcuggaugaccgguucgccagcgcgcugaccgcccucaacgauaugggaaaaguuagaaaggacauccagcagugggagccuucccgcggcuggaaugauuggacacaggugcccuuuugcucucaccacuuccaugaacugauuaugaaagacgggcggguccuugugguucccuguagaaaccaagaugagcugaucggacgcgcucggauuagccagggcgccggguggucccucagagaaaccgcuugccugggcaagucuuacgcccagauguggagccuuauguauuuucaccgccgggaccugagacucgcggccaaugcuaucuguuccgccgugccuagccauugggucccgacaucucgcaccacgugguccauucacgcuacacacgaguggaugaccaccgaagauaugcugacaguguggaaccgggucuggauccaggagaaucccuggauggaggacaagaccccuguggaaagcugggaggaaauccccuaccugggaaaaagagaggaucaauggugcggcucucucauugggcugacaucccgcgccacgugggcuaagaacauccagaccgccauuaaucagguucggagccuuaucggaaacgaagaguauacagacuacaugccuuccaugaaaagauuccggagagaggaagaggaagcgggcgugcugugguga

SEQ ID NO: 20263 - RNA, 9876 nt, Artificial Sequence
  derived and/or modified CDS sequence (opt5) from DENV-2__AY858035__SS-prME
accgccggaaucauuaucaugaugauucccacagugauggcuuuccaccugacgaccagaaacggggagccucauaugaucgucagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucagcgagaacgaagugaaacugacaaucaugaccggagacaucaagggcauuaugcaggccgggaaacggucccugagaccucagcccacagagcuuaaguacagcuggaaaaccuggggaaaggcgaagaugcucucuacggaacugcacaaucauaccuuccugaucgauggcccugagacagccgaaugccccaacaccaaucgcgcuuggaacucccucgagguugaggacuauggguuuggaguguucacaaccaauauuuggcugaaacuuaaggaacggcaagaugucuuuugugacagcaaacugaugucugccgcuaucaaggacaacagagccgugcacgcggauaugggcuacuggauugaguccgcccucaacgacacauggaaaaucgaaaaggcuagcuucaucgaggugaagucuugccacuggccuaaaagccauacccugugguccaauggcguccuggagagcgaaaugauuauccccaagaacuucgccgggccgguuucucagcacaauuaucgcccuggauaccauacgcagacagcuggccccuggcaccuugggcggcucgagauggauuuugacuucugugaaggaaccaccgugguggucacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggugaacucucucguuaccgccggacauggccagauugauaauuuuagccugggggugcugggaauggcucuuuuccucgaggaaaugcugcgcacacgggucggcaccaagcacgcgauccugcucguggccguuuccuuugugacgcugauuaccgggaacaugucuuucagagaccuuggacgcgucauggugaugguuggcgcuacaaugaccgaugacaucggcaugggggugacauaccuggcccuccuggccgcuuuuaaggucagaccuaccuucgccgcgggacugcuucugcggaaacucacgagcaaggagcugaugaugacaaccaucggcauugugcuccugucccaaucuacaauccccgagaccauucuugaacugaccgaugcucucgcccuggggaugauggugcugaaaaucguccgcaauauggagaaguaucagcuugccguuacaauuauggcuauccugugcgugccuaacgccgugauccuccagaaugcguggaaagucagcuguacgacccuggcugugguuuccgugagcccccuccugcuuacaucuucccaacagaaggccgacuggauuccucuggcccucaccaucaagggacugaaccccacagcuauuuuucugaccacgcuuagcagaacaucuaaaaagcgguccuggccgcugaaugaagccaucauggcugucggcauggugagcauucucgccucuucccugcucaaaaacgauaucccuaugaccgggccccugguugcgggaggccuucugaccgugugcuacguccugacaggccgcagcgccgaccucgagcuggaaagagcugccgacgugcggugggaggagcaggcugaaaucuccgggagcucuccuauucuuagcaucaccauuuccgaggauggaucuaugagcaucaagaaugaagaggaggaacagacacugacgauucucauccgcaccggccugcucgucguguccgggcuguuccccguuucuauuccgaucacagccgccgcuugguaucuuugggaggugaaaaagcaaagagcgggaguccugugggacgugccuucucccccucccguuggcaaagccgaacuggaggauggggcuuaccggaucaagcagaagggcauucucggcuauucccagaucggcgccgggguguacaaagaaggaaccuuucacacaauguggcaugucacccgcggcgccgugcugaugcacaaggggaaaagaauugagcccuccugggcugacgugaagaaagaucuuaucagcuacggaggcggguggaagcuggagggagaauggaaggagggcgaagagguucagguccucgcccuggaaccuggcaaaaacccgcgggcggugcaaacgaagcccggacucuucaaaaccaacacaggaaccauuggcgcugugucccuggacuuuagcccugggacaucuggaucccccaucgucgauaagaaaggcaaggugguugggcuuuauggaaauggcguggucaccagaagcggcacauacgugucugccaucgcccagacggagaaguccauugaggacaacccugaaaucgaggaugacauuuuccgcaaaaagcggcugaccaucauggaucugcaucccggggcuggaaaaacaaagagauaucucccugccauuguucgcgaagcgaucaaacggggccugagaacccuuauccuggcuccgacccgcguggucgccgccgagauggaagaggcucuccgggggcugcccauuagauaccagaccccugccauccgcgcugagcacacgggacgggaaauuguggaccucaugugucaugccaccuucacaaugagacugcuuagccccauccggguuccuaauuauaaccugauuaucauggaugaggcgcacuuuaccgaccccgccuccauugcugcccgcggcuacaucucuacaagaguggaaaugggggaggcugccggcaucuucaugaccgccacgccgccuggaagccgggaccccuuuccccaguccaaugcuccuauuauggaugaggaacgcgagauccccgaaagaagcuggaacucuggccacgagugggucacagacuucaaggggaagaccgugugguuugugccuuccauuaaagcgggaaaugauaucgccgcuugccugcggaagaacggcaaaaaggucauucaacucagcagaaaaaccuucgacucugaauauaucaagacacgcaccaaugauugggacuuuguugugacaaccgauaucagcgagaugggggccaacuucaaggccgagcgggugauugacccgagacgcuguaugaaacccgucauccugacggauggagaagaacgggugauucuugcuggcccuaugcccguuacacauuccucugccgcgcagagacgcgggcgggugggcagaaauccuaagaacgaaaaugaccaguacaucuacaugggagagccccuggaaaacgaugaggacugcgcucacuggaaagaggccaagaugcuccuggacaauauuaacaccccggaaggcaucaucccuagcauguuugagcccgaacgcgagaaagucgaugccauugacggggaauauagacugcggggagaggcucgcaagacauucguggaucucaugagacggggcgaccuuccuguuuggcuggccuacaaaguggcggccgaggggaucaacuaugcugaucgcagaugguguuuugacggagucaagaauaaccaaauucuggaagagaauguggaagucgagaucuggaccaaggagggcgaacggaaaaagcucaaacccagauggcuggaugcccgcauuuacuccgacccucuugcucugaaggaguucaaagaguucgccgcugggcggaagucucucacgcugaaccugaucaccgagaugggcagacuccccacauuuaugacccagaaggcccgcaaugcgcuugauaaccuggccgugcugcauacagcugaagccggaggccgggcuuauaaucacgcccucagcgagcugccggagacccuugaaacacugcuccugcugacccuccuugccacgguuacagggggaauuuuccuguuucugauguccggcaaagggaucggaaagaugacccucggcaugugcugcaucauuaccgcuagcauccugcuuugguacgcgcagauucagccucacuggaucgccgcuucuauuauccuggaguucuuucucaucgugcugcugauucccgaacccgagaaacaaagaacaccucaggacaaccagcucaccuauguggucaucgccauucuuacaguuguggccgcuacgauggccaaugaaaugggcuuccuggagaagaccaaaaaggauuuugggcugggauccaucacaacccagcaaccggagagcaacauucucgacaucgaucugcggcccgcguccgccuggacacuuuacgcuguggccaccacguucaucaccccuaugcugcgccauucuauugaaaauagcuccgucaacgugucucucacagcuaucgccaaucaggcgaccguucugaugggccuggggaagggauggccccucagcaaaauggacauuggcgugccucuucuggccaucggguguuacucccaggucaaccccauuacacugaccgcugcccuccugcuucugguggcucacuaugccaucauuggaccuggccuccaggcuaaggccacgagagaggcgcaaaaacgggccgcugccggcaucaugaagaauccgacagucgacgggaucaccgugauugaucuggaccccaucccuuacgaucccaaauuugaaaagcagcugggacagguuaugcuccuugugcugugcgucacacaggugcugaugaugcgcaccaccugggcucucugugaggcccugacacuugccacgggcccuauuagcacccugugggaagggaaccccggaagauucuggaauacaaccaucgcgguuucuauggcuaacauuuuucggggcuccuaucucgccggggcuggacugcuguucagcaucaugaagaacacagccaauacccgcagaggcacgggcaacacaggggagacccucggagagaaauggaagaaucggcuuaacacccugggcaaaucugaauuucaaaucuacaagaaauccgggauucaggagguggaccgcacacuggccaaggaaggaaucaaaagaggcgagaccgaucaucacgcugucagccgggggucugccaagcucagaugguucguggagcgcaaucuggugacaccggaaggaaagguugucgaccuuggcugcggcagaggcggguggagcuauuacuguggagggcugaaaaacgugaaggaggugaaagggcucacgaagggcgggccuggacaugaagaacccauucccauguccaccuauggcuggaaucuggucagacugcagucuggcguugauguguucuuuacaccucccgaaaaaugcgacacccuccuuugugauaucggggagagcuccccuaacccgacaguggaggcgggacgcacccugcggguccugaaucucguggaaaacuggcugaauaacaauacgcaauucugcauuaagguucuuaaccccuacaugccuagcgugaucgagaagauggaagcccugcagagaaaauacggcggggcucucguccgcaauccccugucccggaacucuacccacgagauguauugggugagcaacgccuccggaaauaucguuucuagcgugaacaugauuuccagaaugcugaucaaucgcuuuacaaugcggcacaagaaagcuaccuacgaaccugacgucgaucucggcucugggacaagaaacauuggaaucgagagcgagauucccaaucuugacaucaucggcaagcgcauugagaaaaucaagcaggagcaugaaaccuccuggcacuaugaucaggaccauccguacaagacaugggccuaucacggcagcuacgagaccaaacaaacggggucugcguccagcauggugaacggagugguccggcugcugacaaagccuugggacguuauucccauggugacccagauggccaugaccgauacaacgccuuucggccagcagagaguguuuaaagaaaaggucgacacccgcacacaagagcccaaagaggggaccaagaagcucaugaaaaucacagcugaauggcuguggaaggagcuuggcaaaaagaaaaccagacggauguguacacgcgaagaguucaccagaaaggugcggucuaaugccgcucugggcgccauuuuuacggaugagaacaaauggaaguccgcuagagaagccguugaggacagcggguucugggaacucguggauaaggagcggaaucugcaccuggaaggaaaaugcgagaccugugucuauaacaugaugggcaagcgcgagaaaaagcucggcgaauuugggaaagcgaagggaucuagagccaucugguacauguggcugggcgcucgguuccuugaguuugaagcccugggguuccucaaugaggaccauugguuuucccgcgaaaacagccuguccggaguggagggcgaggggcuucacaagcugggcuacauucucagagauguuagcaaaaaggaaggaggcgcuauguaugccgacgauacagccgggugggacacccggaucacacuggaggaucugaaaaaugaagagauggugaccaaccauauggaaggagagcacaagaaacucgcggaggcuaucuucaagcugacguaccagaauaaggucgugcgcguucagagaccuacaccccggggcaccgugauggacauuaucucucgcagagaccagcgggggagcggacaagucgugacauauggccuuaacaccuucacgaacauggaagcccagcugauucgccagauggagggggaaggcgucuuuaaauccauccaacagcucaccgugacagaggagauugccguuaagaauuggcuggaaagagugggacgggagcgccuuucuagaauggcuaucagcggcgaugacugcgucgugaaaccgcuggaugaccgguucgccuccgcucucaccgcccugaacgauauggggaaggugagaaaagacauccagcagugggaaccuucucgcggauggaaugauuggacacaaguucccuuuugcagccaucacuuccacgagcugauuaugaaggacggccgggugcucgucgugcccuguagaaaccaggaugaacugaucgggcgcgcgcggauuucccagggagccggcuggucucuuagagagaccgcuugccugggaaagagcuacgcccagauguggucccucauguauuuucaucgccgggaccugagacuugcugccaaugcgaucuguagcgccguuccuucucacugggugccgacaucccgcaccacguggagcauucaugcuacacacgaguggaugaccaccgaagauaugcugacagucuggaaccggguguggauccaagagaaucccuggauggaagacaaaaccccugucgagucuugggaagagauccccuaccucggcaagagagaggaucaguggugcggaucccugauuggccugacaagccgcgccacgugggcuaaaaacauccagaccgccauuaaucaggugcggucccucaucgggaacgaagaguauacagacuacaugccuucuaugaagagauuccggagagaagaggaagaggcuggaguucugugguga

SEQ ID NO: 20264 - RNA, 9873 nt, Artificial Sequence
  derived and/or modified CDS sequence (opt5) from DENV-2__JX567951__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucagaucuauaagaaaucuggcauucaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggaaccuauccccaugagcacauacggcuggaaccuggucagacuccaauccgggguggauguguucuuuacgcccccugagaagugcgacacccugcugugugauauuggagaaagcucccccaauccuacaaucgaggcgggccgcacccuccggguucuuaaccuggucgaaaauuggcugaacaauaacacacaguucugcauuaaggugcucaauccguauaugcccucugugaucgagaaaauggaaacccugcagagaaaguacgggggagcccuuguccgcaacccucugagcagaaauuccacgcacgagauguacuggguuucuaacgcuaccggcaauauugugagcuccgugaacaugaucucuagaaugcucaucaaucgcuuuacaaugaaacacaagaaagccaccuaugagcccgacgucgaucuggggagcggaacacggaacauuggcaucgaauccgagauuccuaaccuggacaucauuggcaagagaaucgaaaagauuaaacaggagcaugaaaccagcuggcacuacgaccaagaucaucccuauaagacaugggcuuaccacgggucuuaugagaccaaacagacgggauccgccagcucuauggugaauggcguugugcgccuccuuacaaagccgugggacgucgugccuaugguuacccagauggcuaugaccgauacaacgcccuucgggcagcaacggguguuuaaagagaaggucgacaccagaacacaggaaccuaaggagggaaccaaaaagcugaugaaaaucacagccgaauggcuguggaaggagcucggcaaagagaagacaccccgcauguguacaagagaagaguucacccggaaagugcgcuccaacgcggcccugggggcuguguuuacggaugaaaauaaguggaaaagcgccagagaggcugucgaagacggacgguucugggagcuuguugauagagagcggaaccugcaccucgaaggcaaaugcgagaccuguguguacaauaugaugggcaagcgcgagaagaagcugggggaguuuggaaaagccaagggcucuagagccaucugguauauguggcugggggcgcgguuccucgaauuugaggcucugggauuccuuaacgaggaccauugguuuucccgcggcaauagccuguccgggguggaaggcgagggacuccacagacugggcuacauucuucgggaagucgggaagaaagagggaggcgccauguacgccgaugacacagcugggugggauacccgcaucacacuggaagaccucaagaacgaggagauggugaccaaucauaugaaaggagaacacaagaaacuggccgaggcuauuuucaagcugacguaucagaacaagguugugagaguccagcggccuacaccccgcggcaccgugauggacaucauuagcagaaaagaucaacgggggucuggccagguuggaacauacggccucaauaccuucacgaacauggaagcccagcugauccgccaaauggagggggagggaaucuuuaagagcauucagcaucuuaccgcgacagaagagaucgccgugcagaauuggcuggcuagagucggccgggaacgccucuccagaauggccauuucuggggacgauugcgugguuaaaccgaucgacgaucgguucgcuagcgcccugaccgcgcuuaacgacaugggaaaggugagaaaagauauucagcaaugggagccuucccgcggcuggaaugacuggacacagguccccuuuugcucucaccacuuccaugaacuggugaugaaggaugggcggguccucgugguucccuguagaaaccaggacgagcugaucggccgcgcccggaucagccagggagcuggcuggucccugaaggagaccgccugccucgggaaaucuuaugcucaaauguggacacugauguacuuucacagacgcgaucuucggcuggccgcuaacgccauuuguagcgcggugccuucccauugggucccgaccagcagaacgacauggucuauccacgccaagcacgaauggaugaccaccgaggacaugcucgcuguguggaaucgcguguggauucaggaaaaccccuggauggaggauaaaacaccuguugaauccugggaggaggugcccuaucugggaaagcgggaagaccaguggugcggcagccuuaucgggcugaccucuagagccacaugggccaaaaauauucagacggcuaucaaccaaguccgcucccucauuggaaaugagggcuacaccgacuauaugccuagcaugaagcgguucagacgggaagaggaagaggccggggugcugugg

SEQ ID NO: 20265 - RNA, 9873 nt, Artificial Sequence
  derived and/or modified CDS sequence (opt5) from DENV-2__JX567950__SS-prME
accgccggcgugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagacccggacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcgaagagaucaaaaucacaccucagucuuccauuaccgaagccgagcuuacgggguauggaaccgugacaauggaauguagcccccggaccggccuggauuucaacgagaugguucuccugcagauggaggacaaggcuuggcuugugcaccgccaaugguuucuggaucucccgcugccuuggcugcccggggccgacacacagggaucuaauuggauccagaaagaaacccucgucacguucaagaacccucaugcuaagaaacaggacgugguugugcugggcucccaagagggggccaugcacacagcccuuaccggcgcuacagaaauucagaugagcuccggaaaucugcucuuuaccggccaucugaagugcagacuucggauggauaaacugcagcucaaggggaugucuuacagcauguguaccggaaaauucaagaucgucaaggagauugcggagacacaacacggcacgaucgugaucagaguccaguaugaaggggacggaucccccugcaaaauucccuucgagaucaccgaucuggaaaagcgccaugugcugggccggcucauuacaguuaacccuaucgugaccgagaaagacagcccggucaacauugaagccgagcccccuuuuggggauucuuacaucauugugggcguugagcccggacagcugaaacuuaauugguucaaaaagggcuccagcaucgggcagauguuugaaacaaccaugagaggagcuaagcgcauggccauccugggcgacacggccugggauuucgggucucucggaggcguguuuacaagcauugggaaagcucugcaccaagucuucggcgccaucuacggagcggcuuuuuccggcgugucuuggaccaugaagauucugaucggggugauuaucaccuggaucggaaugaacagccgguccacaagccuuucuguuucccucguccuggugggcguggucacccuguaucucggggccauggugcaggccgacagcggauguauuguuucuuggaaaaauaaggagcugaaaugcggcuccgggaucuucauuacagauaacgugcacacguggaccgaacaguacaaguuucagccugagagccccuccaaacuugcuucugccauccaaaaagcucaugaagagggcauuuguggaaucagaagcgucacacgccuggagaaucucauguggaagcagaucaccccggaacugaaccacauucuguccgagaaugaagugaaacuuacaaucaugaccggcgacauuaaggggaucaugcaggccggaaaacggucucucagaccucagcccacggagcugaaguauagcuggaaaaccuggggcaaggcgaagaugcuguccacagaaagccauaaccaaaccuuccucauugaugggccugagacagccgagugccccaauaccaaccgcgcuuggaacucucuggaaguugaggacuacggauuuggcguguucacaaccaacaucuggcuuaaacugcgggaaaagcaggacgucuuuugugauuccaaacucaugagcgccgcuaucaaggacaauagagccgugcacgcggauaugggcuauuggauugagucugcccugaacgacacguggaaaauggagaaggcuuccuucaucgaaguuaagagcugccacuggccuaaaucucauacacuguggagcaauggggugcuugaguccgaaaugauuauccccaagaacuucgccggaccggucagccagcacaacuaccgcccuggcuaucauacccagaccgcugggcccuggcaccucggaaaacuggagauggauuuugacuucugugaaggcacaaccgugguggucacggaggauugcgggaaucggggacccucucugagaacaaccacagccuccggcaagcucauuaccgaguggugcugucggagcugcacacugccuccgcuucgcuacagaggcgaagacggguguugguacggaauggagauccggccccugaaagaaaaggaggaaaaccucguuaauucccuggugaccgccggccaugggcaaauugauaacuuuucucugggagugcuuggcauggcucucuuccuggaggagaugcugagaacgcgcgucgggaccaagcacgcgauccuccugguggcccuuagcuuuguuacacugaucaccggaaauauguccuuccgggaccucggcagagugauggucauggugggcgcuacaaugaccgaugacauugggaugggaguuacguaucuggcccugcuugccgcuuuuaaagugcgcccuacauucgccgcgggccugcuccugagaaagcucaccucuaaagaacugaugauggcuacaaucgggauugcccuucugagccaguccacccuccccgagaccauccuggaacugacagaugcccuugcucugggaaugauggcccucaagauuguccggaacauggagaaauaccagcuggcggugacgaucauggcuaucucuugcguuccuaaugccgugauucuccaaaacgccuggaaggucagcuguaccauccuggcugccguguccgugagcccccuucugcucacaucuucccagcagaaggcugacuggauuccucuggcccugaccaucaaaggccuuaaucccacagcgauuuuucugaccacgcucagccgcacaucuaagaaaagauccuggccgcugaacgaagccaucauggcugucgggaugguuagcauccucgccucuucccugcuuaagaaugacauuccuaugaccggaccccugguggcuggcggccugcucaccgugugcuauguccugacagggcggagcgccgaucuugagcuggagcgcgccgcugacgugaaaugggaagaucaggcggagaucuccggaagcucuccuauucucagcguuaccaucuccgaagacggcucuaugagcauuaagaacgaggaggaagaacaaacacugacgauccucauuagaaccgggcugcuugugaucuccggagucuuccccgugucuaucccgauuacagccgcugccugguaccugugggaaguuaaaaagcagcgggccggcgugcugugggaugucccuucucccccucccguggggaaggcugagcucgaagacggagccuaucgcaucaaacagagaggcauucugggcuacucccagaucggggcgggagucuauaaggagggcaccuuucacacaauguggcaugugaccagaggggcuguucuuaugcaccgcggaaaaagaauugagcccuccugggccgaugugaagaaagaccugaucagcuacggcgggggauggaagcucgaaggcgaguggaaggaaggcgaggaaguccaagugcuggcccucgagccugggaaaaauccgcgggcuguucagacgaagcccggaaucuucaaaaccaacacaggcaccauuggggccgugucccuggauuuuagcccuggaacaucuggcucccccaucgucgacagaaaggggaaaguggugggacuuuacggcaauggcguugucacccgcagcggggcguaugugucugcuauugcccagacagagaaguccaucgaagauaacccugagauugaagacgauaucuuccggaagaaaagacugacgaucauggaccugcaucccggagccggcaagaccaaacgcuaccucccugcuauugugcgggaggccaucaagagagggcugcgcacacuuauucuggcuccgacccgggucguggccgcggaaauggaggaggcccucagaggacugcccauccgcuaucagaccccugcuauucgggccgaacacacaggcagagagaucguugaccucaugugucaugcuacguucaccaugcggcugcuuagccccgugcgcgucccuaacuacaaucugauuaucauggaugaagcccacuuuuccgaccccgccucuaucgcugcgagaggguauauuagcacacggguggagaugggcgaggccgcuggaaucuucaugaccgccacaccgccuggcucccgcgaucccuuuccccaaagcaacgccccuauuauggacgaagagagagaaauccccgagcggucuuggaauagcgggcacgaauggguuaccgauuucaaaggaaagacggugugguuugucccuagcauuaaggcuggcaacgacaucgccgcgugccugcgcaagaaugggaagaaagugauccagcucucucgcaagacauucgauagcgaguacguuaaaacccgggcuaacgacugggauuuuguggucaccacagacauuuccgagaugggagccaauuucaaggccgaaagagugaucgauccgcgccgguguaugaagcccgugauucugaccgacggcgaggaaagagucauccuugcugggccuaugcccguuacacauucuagcgccgcgcagcgccggggcagaauuggacgcaacccuaaaaaugagaacgaccaauauaucuacaugggcgaaccccuggagaaugaugaggacugcgcccacuggaaggaagcuaaaaugcuccuggauaacaucaauaccccggaggggauuaucccuuccauguuugaacccgagagagaaaagguggacgccauugauggagaguaccggcugcgcggcgaggcuagaaaaacguucguggaccucaugcggcgcggggaucuuccugucuggcuggccuauaagguggcugccgaaggaaucaacuacgcggacagaaaaugguguuuugauggcauuaagaauaaccagauccuggaggaaaacguugagguggagauuuggacaaaggaaggggagcggaaaaagcucaaacccagauggcuggacgcccgcaucuauucugauccucuugcucugaaggaguucaaagaguucgccgcuggcagaaagagccucacccugaaucugaucacagaaaugggaagacuccccaccuuuaugacgcagaaggcccgcaacgcccuugacaaucuggcuguccugcauaccgcggaggugggcgggaaagccuacacacacgcucucaacgagcugccggaaacccuugagacacugcuccugcugacccuccuugccgccguuacaggaggcauuuuccuguuucugauguccgggaagggaaucggcaaaaugacccucggcaugugcugcauuaucacggcuagcauucugcuuugguaugcccagauccaaccucacuggaucgcggccucuauuauccuggaguucuuucucauugugcugcugauccccgagcccgaaaagcagcggacaccucaggauaaucagcucaccuacgucgugauugcuauccuuaccgucguggccgcuacaauggccaacgagaugggguuccuggagaaaaccaagaaguaucugggacucggcuccaucacaacgcaagaaagcgaguccaauauucuggacaucgaccuuagaccggcgucugccuggacccuguacgcuguugccacaaccuuugugacacccaugcuccggcauagcauugugaacuccucugucaauguuacccugacggcuaucgccaaccaggcuaccgugcugauggggcucggaaaaggcuggccucuuagcaagauggauauuggggugccccugcuggccaucggauguuacucccaggucaauccuauuacacucaccgcggcccugcuucugcucguggcucacuaugccaucaucggccccggccugcaggcuaaagccacacgcgaagcccaaaagagagcggcugccgggauuaugaaaaacccuaccguugacggaaucacggugauugaucuggagccgauccccuacgacccuaaguucgaaaagcagcucggccaggucaugcuucugauucugugcgugacacagguccucaugaugcggaccacaugggcucugugugaggcccuuacccuggccaccgggcccaucagcacacucugggagggaaauccuggccgcuuuuggaacacgaccaucgcugugucuauggccaauauuuucagaggguccuaucuggcgggagccggccugcucuuuagcaucaugaaaaacacaaccaauacacggcgcggcaccgggaacguuggagaaacgcuuggcgagaaguggaaaucuagacugaacgcucuggggaagaaugaguuccaaauuuacaaaaaguccggaauccaggagguggaucggacacucgccaaagagggcauuaagcgcggggaaaccgaccaucacgcugucagcagaggaucugccaagcugcggugguuuguggagagaaacaugguuacccccgaaggcaaaguggucgaucuuggcugcgggcgcggaggcuggagcuauuacugugggggacugaagaaugugcgggaggugaaaggccucacaaaagggggaccgggccaugaagaaccuauccccauguccaccuauggcuggaaccugguuagacugcagucuggggucgacguguucuucacacccccugagaaaugcgauacgcuccuuugugacaucggagaaagcucccccaauccuaccauugaggcgggccgcacacugcgggugcugaaccucgccgaaaauuggcugaacaauaacacccaauuuugcaucaagguccuuaauccguacaugcccagcguuauugagaagauggaaacacugcagagaaaauacgggggagcucucgugcgcaacccucuguccagaaauucuacccacgagauguauugggugagcaacgccacgggcaauaucgucuccucugugaacaugauuagcagaaugcugaucaaccgcuucaccaugaagcacaaaaaggcuacauacgagcccgauguugaccucggguccggaacccggaauaucggcauugaaucugagaucccuaaccuugauauuaucggcaaaagaauugaaaagaucaagcaggagcaugaaacaagcuggcacuaugaccaggaccaucccuacaaaaccugggccuaucacggguccuacgagacaaagcaaaccggaagcgcuucuuccauggugaauggcgucgugcgccugcugacgaaaccgugggauguugugccuauggucacacagauggccaugaccgacaccacacccuuugggcagcagcggguguucaaggagaaaguggauacgagaacccaagaaccuaaggagggaacaaagaaacucaugaagauuaccgcggaauggcuguggaaagagcuuggcaaggagaaaacaccccgcauguguaccagagaagaguuuacacggaagguccgcagcaacgccgcucugggggccguuuucaccgacgaaaauaaauggaagucugcuagagaggccguggaagauggacgguuuugggagcucguggacagagagcggaaccugcaccuggaaggcaagugcgagacgugugucuauaauaugaugggcaaacgcgaaaagaaacucggggaguucggaaaggccaaaggcuccagagcgaucugguacauguggcugggggcucgguuucuugaguucgaggcccugggauuucucaacgaggaucauugguucagccgcgaaaauucucuguccggcguggagggggaaggccuucacagacugggauacauccuccgggacguuagcaagaaggagggcggggccauguaugcugaugacaccgccggaugggauacacgcauuacccuggaagaccugaaaaacgaggagauggugacaaaucauaugaagggcgaacacaaaaagcucgcugaggccaucuuuaaacugaccuaccagaacaaggucgugagaguucagcggccuacgccccgcgggacagugauggacauuaucuccagacgggaucagcgcggaagcggccaagucgggaccuauggccuuaauacauucaccaacauggaagcgcagcugauuagacagauggagggagagggcaucuucaagucuauccaacaucucacggccaccgaagagauugcugugcagaauuggcuggcccggguugggcgcgaaagacuuagccggauggcuaucuccggagacgauugcguggucaaaccgauugacgauagauuugccucugcgcugacagcccucaacgacaugggcaaggugcgcaaagauauccagcagugggagccuagccggggguggaacgacuggacccaaguccccuucugcucccaccacuuucaugaacuggugaugaaggauggaagaguucuggugguccccugucgcaaucaggacgagcucauuggccgggcuagaaucucucagggggccggcuggagccugaaagagacagcuugccuuggaaaguccuacgcccagauguggacccugauguauuuccaccgccgggaucucagacuggcugccaacgcgaucuguucugccgugccuagccauugggugccgacaucccgcaccacguggagcauucacgcuaagcacgaauggaugacaaccgaggacaugcuugccguuuggaaucggguguggauccaagaaaaccccuggauggaggauaaaaccccugucgaaucuugggaggagauucccuaccugggcaagagagaagaccaguggugcgggucccucaucggacugacaagccgcgccaccugggcuaaaaauauucagacagccaucaaccaggugcggucucugauuggcaaugagggguauacggacuacaugccuuccaugaagagauuucggagagaagaggaagaggcgggaguucucugg

SEQ ID NO: 20266 - RNA, 9873 nt, Artificial Sequence
  derived and/or modified CDS sequence (opt5) from DENV-2__HQ012538__SS-prME
accgcgggagugaucauuaugcugauccccaccgcuauggccuuccaccucacgaccagaaauggggaaccucauaugauugugggacggcaggaaaagggcaagagccugcuuuuuaagaccgaagacgggguuaauaugugcacccugauggcgaucgaucucggagaacugugugaggacaccauuaccuacaagugcccgcuucugagacaaaaugaacccgaggauaucgacuguuggugcaauuccaccucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaaacuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaaacuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaacucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggucaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcccucuuccuggaggaaaugcugagaacacgcguggggaccaagcacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaaaguccgcccuaccuucgccgcgggccuucugcucagaaagcugacgucuaaagagcucaugauggcuacaauugggaucgcccugcuuagccaguccaccauucccgaaacaauccuggagcucaccgacgcccuggcucugggaaugauggugcuuaagaucguucggaacauggaaaaauaccagcuggccgugaccauuauggcgaucucuugcgucccuaaugcugugauucuccugaacgccuggaaggugagcuguacaauccucgccgcugucuccguuagcccccugcuucugacgucuucccaacagaagaccgauuggauuccucucgcccugacaaucaaaggccugaaucccaccgcuaucuuucuuacaacccugagccgcacgucuaagaaaagauccuggccgcucaacgaggccgugauggcgguggggauggucagcauucuggccucuucccuccugaagaaugacaucccuaugacaggaccccuuguggcuggcggccugcugaccguuugcuaugugcucaccgggcggagcgccgaccuggagcuugaacgcgcugccgaugucaaaugggaggaccaggccgaaauuuccggaagcucuccuauccugagcauuacaaucuccgaggauggcucuaugagcauuaagaacgaggaagaggaacagacccucacaauccugaucagaacggggcuccuggugauuuccggaguuuuccccgugucuaucccgauuaccgcugcggccugguaccuuugggaggucaaaaagcaacgggcuggcgugcugugggacgucccuucucccccucccguggaaaaggccgagcuggaggauggggccuaucgcaucaaacagagaggcauucucggcuacucccagaucggcgcugggguuuauaaggaaggaacauuucacaccauguggcaugugacacggggcgccguccugaugcaccgcgggaaaagaaucgagcccuccugggcggacgugaagaaagaucuuauuagcuacggaggcggguggaagcuggaaggagaguggaaggaaggcgaggagguucaggugcucgcucuggaaccuggcaaaaauccgcgggccguccaaaccaagcccggacucuucaaaacgaacaccggaacaaucggcgccgugucccuggacuuuagcccugggaccucuggaucccccauuguggauagaaagggcaaaguugucgggcuuuacggaaauggcguggugacacgcagcggcgcuuaugucucugccaucgcgcagaccgagaaguccauugaagacaacccugagaucgaagaugacaucuuccggaagaaaagacugacaauuauggaucugcaucccggggcuggaaagacgaaacgcuaccucccugccaucgugcgggaggccauuaagagaggccugcgcacccuuauccuggcuccgacacggguuguggccgcugagauggaagaggcccucagagggcugcccauucgcuaucagaccccugcgauccgggccgaacacaccggaagagagauugucgaccucaugugucaugcuacauucacgaugcggcugcuuagccccgugcgcguuccuaacuacaaucugaucaucauggacgaggcccacuuuaccgaucccgcuuccauugccgccagaggcuauaucucuacacggguggaaaugggggaggcugcgggcauuuucaugaccgccacaccgccuggaagccgcgaccccuuuccccaguccaacgcuccuaucauggaugaagagagagaaauucccgagcggagcuggaacucuggccacgagugggucaccgacuucaaagggaagacggugugguuuguuccuuccaucaaggccggaaacgauaucgccgcuugccugcgcaagaauggcaagaaagugauucaacucagccgcaagacauucgacucugaauacgucaaaacccgggccaacgauugggacuuuguggugaccacagauaucagcgagaugggggcgaauuucagagcugaacgcgucauugacccgcggagauguaugaagcccguuauccugaccgauggagaggaacgcgugauucuugccggcccuaugcccgugacacauuccucugccgcucagcggagagggcgcaucggcagaaacccuaagaaugagaacgaccaguauaucuacaugggagagccccuggaaaaugacgaggauugcgcccacuggaaagaagcgaagaugcuccuggacaacauuaauaccccggagggcaucauuccuagcauguuugaacccgagcgggagaaagucgaugccaucgacggggaauaccgccugagaggagaggcucggaagacguucguggaucucaugcgcagaggcgaccuuccuguuuggcuggccuaucggguggcugccgaagggauuaacuacgcugauagacgcugguguuuugacggaaucaaaaauaaccaaauucuggaggagaacgucgaaguggagaucuggacaaaggaaggcgagcggaaaaagcucaagcccagauggcuggaugcccgcaucuauuccgacccucuugcgcugaaagaguucaaggaguucgccgcugggcggaaaucucucacccugaaucugauuacagagaugggcagacuccccaccuuuaugacgcagaaggcccgggaugcucuugacaaccuggccguucugcauaccgccgaagcuggaggccgcgcguacaaucacgcccucagcgagcugccggaaacacuugagacccugcuccugcugacacuccuugcuaccgugacagggggaaucuuccuguuucugauguccggcaaagggauuggaaagaugacccucggcaugugcugcaucauuacggccagcauccugcuuugguaugcccagauccagccucacuggauugcugccucuaucauucuggaguucuuucucaucguccugcugauucccgagcccgagaagcaaagaacaccucaggauaaccagcucaccuacguggucaucgcgauccuuaccgugguugccgcuacaauggccaaugaaaugggcuuccuggagaaaaccaagaaagaccuggggcucggauccauuacaacgcaggaaagcgaguccaacauccuggacauugaucuucggccggcuucugccuggacccuguaugcgguggccacaaccuuugugacacccaugcuccgccauagcaucgaaaauuccucugucaacguuagccugaccgcuauugccaaucaagcuacggugcugaugggccucgggaagggauggccucuuuccaaaauggacaucggcgugccccugcuggccauuggguguuacagccaggucaacccuaucacccucacagcugcccugcuucugcucguggcgcacuacgccaucauuggacccggccugcaggcuaaggccaccagagaggcucagaagcgggccgccgcgggcaucaugaaaaauccuacaguugaugggauuaccgugaucgaccuggagccgauucccuaugauccuaaguucgaaaaacaacucggacaggucaugcuucugauccugugcgugacgcagguccucaugaugcgcacaaccugggcucugugugaggcccuuacacuggcuaccggccccaucucuacccucugggaagggaacccuggaagauuuuggaauacaacgauugccguguccauggccaacaucuuccggggcagcuaccuggcuggggccggacugcucuuuucuauuaugaagaauaccacaaacacccgcagaggcacaggcaauaucggggagacccuuggagagaaauggaagucccggcugaacgcgcugggcaagagcgaguuccagauuuauaaaaagucugggauccaagagguugacagaacgcucgccaaagaaggaaucaagcgcggcgagacagaucaucacgcugugagccggggguccgccaaacugagaugguuugucgaacgcaacauggugacccccgagggaaagguuguggaccuuggcugcggcagagggggauggucuuacuauuguggcgggcugaaaaauguccgggaggugaagggacucaccaagggcgggccgggacaugaagaaccuauucccaugagcacauacggcuggaaccuggugcgccugcaguccggcguugaugucuucuucacacccccugaaaaaugcgacacacuccuuugugauaucggggagagcucccccaauccuacgauugaagcuggacggacccugagagugcugaaccucguggagaauuggcugaacaauaacacacaguuuugcaucaagguccuuaauccguauaugcccucuguuauugagaaaauggaaacccugcaacgcaaguacggcggggcccucgugcggaacccucugagcagaaauuccacacacgagauguacugggugucuaacgcgaccggaaauaucgucagcuccgugaacaugaucucucgcaugcugauuaaucgguucacgaugaaacacaagaaggccaccuaugaacccgacguugaucucggcagcgggacaagaaacaucggaauugaguccgaaaucccuaaccuugacauuaucggcaaacgcauugagaagaucaaacaggagcaugaaaccagcuggcacuacgaccaggaucaucccuauaagacaugggcuuaccacggcucuuaugagaccaaacagacaggguccgccagcucuauggugaauggagucgugagacugcugaccaagccgugggacguugugccuauggucacgcaaauggcuaugacagauaccacccccuuuggccagcagcggguguucaaggaaaaaguggacacacgcacgcaggagccuaaggaggggaccaaaaagcucaugagaaucacagccgaauggcuguggaaagagcuuggaaagaagaaaacaccccggauguguacaagagaagaguuuacccggaagguccgcuccaacgcugcccugggcgcgauuuucacagaugaaaauaaauggaaaagcgccagagaggcuguugaggacucucgguuuugggaacucguggaucgcgagagaaaccugcaccuggaagggaaaugcgagaccuguguguacaauaugaugggaaagcgggagaagaagcucggcgaguucggcaaggccaaagggucccgcgcuaucugguauauguggcugggagccagauuucuugaguucgaagcccugggcuuucucaacgaggaccauugguucagccgggggaauagccugagcggagucgaaggcgaggggcuucaccgccugggcuacauucucagagaugugucuaagaaagaaggaggcgcgauguacgcugacgauacggccgggugggacacccggaucacacuggaggaccugaagaacgaggaaaugguuaccaaucauaugaaaggagagcacaagaagcucgccgaagcuauuuuuaaacugacauaucaaaacaaggugguccgcgugcagagaccuacaccccggggcacgguuauggauaucaucagccgcagagaccagcggggguccggacaggugggcacauacgggcuuaauaccuucacaaacauggaggcccaacugauuagacagauggagggcgaaggaaucuucaaaucuauucagcaucucaccgucacggaggaaaucgcugugcaaaauuggcuggcccgcguuggccgggagagacuuagccgcauggcgauuuccggggaugacugcguggucaagccgcuggaugaccgguuugccucugcucucaccgcccugaacgauaugggaaaagugagaaaggacauccagcagugggaaccuagccgcggcuggaaugauuggacacagguccccuucugcucccaccacuuucaugagcuggugaugaaggacgggcggguucucgugguccccuguagaaaccaagaugagcugaucggacgcgcucggauuucucagggcgccggguggagccuuaaagaaaccgcgugccugggcaaguccuaugcccagauguggacacucauguacuuccacagacgcgaccugcggcuugcugccaacgcuaucuguagcgccgugccuucucauugggugccgaccuccagaacaaccuggagcauucacgcuaaacacgaguggaugacgacagaagauaugcuggccguuuggaaucggguguggauccaggagaaccccuggauggaagacaagaccccugucgagucuugggaggaagugcccuaucucggaaaaagagaggaccaauggugcggcucccugauugggcugaccagccgcgcgacaugggccaagaauauccagaccgcuauuaaccagguucggucccucaucggaaaugaagaguacacagauuauaugccuucuaugaagagauuucgcagagaagaggaggaagccggcgugcugugg

SEQ ID NO: 20267 - RNA, 9873 nt, Artificial Sequence
  derived and/or modified CDS sequence (opt5) from DENV-2__HQ012533__SS-prME
accgccggcgugaucauuaugcugauccccaccgcuauggccuuccaccucacgacccggaauggggagccucauaugauugugggacggcaggaaaagggcaagagccugcuuuuuaagaccgaggacgggguuaauaugugcacccugauggcgaucgaucucggagaacugugugaggacaccauuaccuacaagugcccgcuucugcgccaaaaugaacccgaggauaucgacuguuggugcaauuccaccucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaagacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaaacuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaaacuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaacucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggucaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcccucuuccuggaggaaaugcugagaacacgcguggggaccaagcacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaaaguccgcccuaccuucgccgcgggccuucugcucagaaagcugacgucuaaagagcucaugauggcuacaauugggaucgcccugcuuagccaguccaccauucccgaaacaauccuggagcucaccgacgcccuggcucugggaaugauggugcuuaagaucguucggaacauggaaaaauaccagcuggccgugaccauuauggcgaucucuugcgucccuaaugcugugauucuccugaacgccuggaaggugagcuguacaauccucgccgcugucuccguuagcccccugcuucugacgucuucccaacagaagaccgauuggauuccucucgcccugacaaucaaaggccugaaucccaccgcuaucuuucuuacaacccugagccgcacgucuaagaaaagauccuggccgcucaacgaggccgugauggcgguggggauggucagcauucuggccucuucccuccugaagaaugacaucccuaugacaggaccccuuguggcuggcggccugcugaccguuugcuaugugcucaccgggcggagcgccgaccuggagcuugaacgcgcugccgaugucaaaugggaggaccaggccgaaauuuccggaagcucuccuauccugagcauuacaaucuccgaggauggcucuaugagcauuaagaacgaggaagaggaacagacccucacaauccugaucagaacggggcuccuggugauuuccggaguuuuccccgugucuaucccgauuaccgcugcggccugguaccuuugggaggucaaaaagcaacgggcuggcgugcugugggacgucccuucucccccucccguggggaaggccgaacuggaggauggagccuaucgcaucaaacagagaggcauucucggcuacucccagaucggggcuggaguuuauaaggagggcacauuucacaccauguggcaugugacaagaggggcgguccugaugcaccgcggaaaaagaaucgaacccuccugggcggacgugaagaaagaucuuauuagcuacggcgggggauggaagcuggagggcgaauggaaggagggcgaagagguucaggugcucgcucuggagccugggaaaaauccgcgggccguccaaaccaagcccggacucuucaaaacgaacaccggcacaaucggggccgugucccuggacuuuagcccuggaaccucuggcucccccauuguggauagaaaggggaaaguugucggacuuuacggcaauggcguggugacacgcagcggggcuuaugucucugccaucgcgcagaccgaaaaguccauugaggacaacccugaaaucgaggaugacaucuuccggaagaaaagacugacaauuauggaucugcaucccggagcuggcaagacgaaacgcuaccucccugccaucgugcgggaagccauuaagagagggcugcgcacccuuauccuggcuccgacacggguuguggccgcugagauggaggaagcccucagaggacugcccauucgcuaucagaccccugcgauccgggccgagcacaccggcagagaaauugucgaccucaugugucaugcuacauucacgaugcggcugcuuagccccgugcgcguuccuaacuacaaucugaucaucauggacgaggcccacuuuaccgaucccgcuuccauugccgccagaggguauaucucuacacggguggagaugggcgaagcugcgggaauuuucaugaccgccacaccgccuggcagccgcgaccccuuuccccaguccaacgcuccuaucauggaugaggaaagagagauucccgaacggagcuggaacucugggcacgagugggucaccgacuucaaaggaaagacggugugguuuguuccuuccaucaaggccggcaacgauaucgccgcuugccugcgcaagaaugggaagaaagugauucaacucagccgcaagacauucgacucugaguacgucaaaacccgggccaacgauugggacuuuguggugaccacagauaucagcgaaaugggagcgaauuucagagcugagcgcgucauugacccgcggagauguaugaagcccguuauccugaccgauggcgaagaaagagugauucuugccgggccuaugcccgugacacauuccucugccgcucagcggagaggccgcaucggaagaaacccuaagaaugaaaacgaccaguauaucuacaugggcgagccccuggagaaugacgaagauugcgcccacuggaaagaggcgaagaugcuccuggacaacauuaauaccccggaagggaucauuccuagcauguuugagcccgaacgggagaaagucgaugccaucgacggagaguaccgccugagaggcgaagcucggaagacguucguggaucucaugcgcagaggggaccuuccuguuuggcuggccuaucggguggcugccgagggaauuaacuacgcugauagacgcugguguuuugacggcaucaaaaauaaccaaauucuggaagagaacgucgagguggaaaucuggacaaaggagggggaacggaaaaagcucaagcccagauggcuggaugcccgcaucuauuccgacccucuugcgcugaaagaguucaaggaguucgccgcuggccggaaaucucucacccugaaucugauuacagagaugggaagacuccccaccuuuaugacgcagaaggcccgggaugcucuugacaaccuggccguucugcauaccgccgaggcuggcgggcgcgcguacaaucacgcccucagcgaacugccggagacacuugaaacccugcuccugcugacacuccuugcuaccgugacaggaggcaucuuccuguuucugauguccgggaaaggaauuggcaagaugacccucggcaugugcugcaucauuacggccagcauccugcuuugguaugcccagauccagccucacuggauugcugccucuaucauucuggaguucuuucucaucguccugcugauucccgaacccgagaagcaaagaacaccucaggauaaccagcucaccuacguggucaucgcgauccuuaccgugguugccgcuacaauggccaaugagaugggguuccuggagaaaaccaagaaagaccugggacucggcuccauuacaacgcaggaaagcgaauccaacauccuggacauugaucuucggccggcuucugccuggacccuguaugcgguggccacaaccuuugugacacccaugcuccgccauagcaucgagaauagcucugucaacguuagccugaccgcuauugccaaucaagcuacggugcugauggggcucggaaagggcuggccucuuuccaaaauggacaucggggugccccugcuggccauuggauguuacagccaggucaacccuaucacccucacagcugcccugcuucugcucguggcgcacuacgccaucauuggccccggccugcaggcuaaggccaccagagaagcucagaagcgggccgccgcggggaucaugaaaaauccuacaguugauggaauuaccgugaucgaccuggagccgauucccuaugauccuaaguucgagaaacaacucggccaggucaugcuucugauccugugcgugacgcagguccucaugaugcgcacaaccugggcucugugugaagcccuuacacuggcuaccgggcccaucucuacccucugggagggaaacccuggcagauuuuggaauacaacgauugccguguccauggccaacaucuuccgggggagcuaccuggcuggagccggccugcucuuuucuauuaugaagaauaccacaaacacccgcagaggcacagggaauaucggagaaacccuuggcgagaaauggaagucccggcugaacgcgcugggaaagagcgaguuccagauuuauaaaaagucuggaauccaagaaguugacagaacgcucgccaaagagggcaucaagcgcggggaaacagaucaucacgcugugagccggggauccgccaaacugagaugguuugucgagcgcaacauggugacccccgaaggcaagguuguggaccuuggcugcgggcggggaggcuggucuuacuauugugggggacugaaaaaugucagagaggugaagggccucaccaaagggggaccgggccaugaggaaccuauucccaugagcacauacggcuggaaccuggugcgccugcaguccgggguugaugucuucuucacacccccugagaaaugcgacacacuccuuugugauaucggagaaagcucccccaauccuacgauugaggcuggccggacccugagagugcugaaccucguggaaaauuggcugaacaauaacacacaguuuugcaucaagguccuuaauccguauaugcccucuguuauugagaaaauggagacccugcaacgcaaguacgggggagcccucgugcggaacccucugagcagaaauuccacacacgaaauguacugggugucuaacgcgaccggcaauaucgucagcuccgugaacaugaucucucgcaugcugauuaaucgguucacgaugaaacacaagaaggccaccuaugagcccgacguugaucucgggagcggaacaagaaacaucggcauugaauccgagaucccuaaccuugacauuaucggcaaacgcauugaaaagaucaaacaggagcaugagaccagcuggcacuacgaccaggaucaucccuauaagacaugggcuuaccacgggucuuaugaaaccaaacagacaggauccgccagcucuauggugaauggcgucgugagacugcugaccaagccgugggacguugugccuauggucacgcaaauggcuaugacagauaccacccccuuugggcagcagcggguguucaaggagaaaguggacacacgcacgcaggaaccuaaggagggaaccaaaaagcucaugagaaucacagccgaguggcuguggaaagaacuuggcaagaagaaaacaccccggauguguacaagagaggaauuuacccggaagguccgcuccaacgcugcccugggggcgauuuucacagaugagaauaaauggaaaagcgccagagaagcuguugaggacucucgguuuugggagcucguggaucgcgaaagaaaccugcaccuggagggaaaaugcgaaaccuguguguacaauaugaugggcaagcgggagaaaaagcucggcgaguucgggaaggccaaaggaucccgcgcuaucugguauauguggcugggcgccagauuucuugaguucgaggcccugggguuucucaacgaagaccauugguucagccggggaaauucccugagcggcgucgagggggaaggccuucaccgccugggauacauucucagagaugugucuaagaaagagggcggggcgauguacgcugacgauacggccggaugggacacccggaucacacuggaagaccugaagaacgaggagaugguuaccaaucauaugaaaggcgaacacaagaagcucgccgaggcuauuuuuaaacugacauaucaaaacaaggugguccgcgugcagagaccuacaccccgggggacgguuauggauaucaucagccgcagagaccagcggggauccggccagguggggacauacggccuuaauaccuucacaaacauggaagcccaacugauuagacagauggagggagagggcaucuucaaaucuauucagcaucucaccgucacggaagagaucgcugugcaaaauuggcuggcccgcguugggcgggaaagacuuagccgcauggcgauuuccggagaugacugcguggucaagccgcuggaugaccgguuugccucugcucucaccgcccugaacgauaugggcaaagugagaaaggacauccagcagugggagccuagccgcggguggaaugauuggacacagguccccuucugcucccaccacuuucaugaacuggugaugaaggacggacggguucucgugguccccuguagaaaccaagaugagcugaucggccgcgcucggauuucucagggggccggcuggagccuuaaagagaccgcgugccugggaaaguccuaugcccagauguggacacucauguacuuccacagacgcgaccugcggcuugcugccaacgcuaucuguagcgccgugccuucucauugggugccgaccuccagaacaaccuggagcauucacgcuaaacacgaauggaugacgacagaggauaugcuggccguuuggaaucggguguggauccaggaaaaccccuggauggaggacaagaccccugucgaaucuugggaggaggugcccuaucucggcaaaagagaagaccaauggugcgggucccugauuggacugaccagccgcgcgacaugggccaagaauauccagaccgcuauuaaccagguucggucccucaucggcaaugaggaauacacagauuauaugccuucuaugaagagauuucgcagagaggaagaggaggccggggugcugugg

SEQ ID NO: 20268 - RNA, 9873 nt, Artificial Sequence
  derived and/or modified CDS sequence (opt5) from DENV-2__HQ012534__SS-prME
accgccggcgugaucauuaugcugauccccaccgcuauggccuuccaccucacgacccggaauggggagccucauaugauugugggacggcaggaaaagggcaagagccugcuuuuuaagacagaggacgggguuaauaugugcacccugauggcgaucgaucucggagaacugugugaggacacaauuaccuacaagugcccccuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaagacagaggccaagcagccugcuacccugagaaaauauugcaucgaagccaagcucacgaacacaaccaccgagagccgguguccgacacaaggagagcccucucugaaugaggaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaaacuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaaacuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaacucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggucaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcgcuuuuccuggaggaaaugcugagaacacgcguggggaccaagcacgccauccuccuggucgcugugagcuuuguuacgcuuauuaccggaaauauguccuuccgggaucugggcagagugauggucaugcucggcgugccuaugacagacgauaucgggaugggaguuaccuaucuggcccugcuugccgcuuuuaaagugcgccccacauucgccgcgggccugcuccugagaaagcucaccucuaaagagcugaugauggcuacgauugggaucgcccuucugagccaguccacaauuccugaaaccauccucgagcugacagacgcccuggcucuuggaaugaugguccugaagaucgugcggaacauggaaaaauaccagcucgccguuaccauuauggcgaucucuugcgugcccaaugcugucauucugcucaacgccuggaaggugagcuguaccauccuggccgcuguguccgucagcccucuucugcucacaucuucccaacagaagacggauuggauuccccuggcccugaccaucaaaggccuuaauccgacagcuaucuuucugaccacacucagccgcaccucuaagaaaagauccuggccucugaacgaggccguuauggcgguggggauggugagcauucucgccucuucccugcuuaagaaugacauccccaugacgggaccucuggucgcuggcggccugcucacagugugcuauguucugaccgggcggagcgccgaccuugagcuggaacgcgcugccgaugugaaaugggaggaccaggccgaaauuuccggaagcucucccauccucagcauuaccaucuccgaggauggcucuaugagcauuaagaacgaggaagaggaacagacacugaccauccucaucagaacagggcugcuugucauuuccggaguguucccgguuucuaucccuauuacggcugcggccugguaccugugggaggugaaaaagcaacgggcuggcguccugugggacgugcccagcccuccgcccgucgggaaggccgaacucgaggauggagccuaucgcaucaaacagagaggcauucugggcuacucccagaucggggcuggaguguauaaggagggcaccuuucacacaauguggcauguuaccagaggggccgugcuuaugcaccgcggaaaaagaaucgaaccuucuugggcggacgucaagaaagaucugauuagcuacggcgggggauggaagcucgagggcgaauggaaggagggcgaagaggugcagguucuggcucucgagccggggaaaaauccccgggccgugcaaacaaagccuggacuguucaaaaccaacacgggcaccaucggggccgucucccuugacuuuagccccggaacaucuggcuccccuauuguggauagaaaggggaaagugguuggacuguacggcaauggcgucgugacccgcagcggggcuuaugugucugccaucgcgcagacagaaaaguccauugaggacaaccccgaaaucgaggaugacaucuuccggaagaaaagacugaccauuauggaucuccauccuggagcuggcaagacaaaacgcuaccugccggccaucguccgggaagccauuaagagagggcuucgcacgcugauccucgcucccacccgggugguugccgcugagauggaggaagcccugagaggacucccuauucgcuaucagacacccgcgauccgggccgagcacaccggcagagaaauuguggaccugaugugucaugcuaccuucacaaugcggcuucugagcccuguccgcgugcccaacuacaaucugaucaucauggacgaggcccacuuuacggauccggcuuccauugccgccagaggguauaucucuacccggguugagaugggcgaagcugcgggaauuuucaugacagccaccccucccggcagccgcgaccccuuuccucaguccaacgcucccaucauggaugaggaaagagagauuccugaacggagcuggaacucugggcacgagugggugacagacuucaaaggaaagaccgucugguuugugccguccaucaaggccggcaacgauaucgccgcuugccuccgcaagaaugggaagaaaguuauucaacugagccgcaagacguucgacucugaguacgugaaaacacgggccaacgauugggacuuugucgugaccaccgauaucagcgaaaugggagcgaauuucagagcugagcgcgugauugacccccggagauguaugaagccugucauccuuacagauggcgaagaaagaguuauucuggccgggcccaugccugugacccauuccucugccgcucagcggagaggccgcaucggaagaaaccccaagaaugaaaacgaccaguauaucuacaugggcgagccgcucgagaaugacgaagauugcgcccacuggaaagaggcgaagaugcugcuggacaacauuaauacaccugaagggaucauucccagcauguuugagccugaacgggagaaaguggaugccaucgacggagaguaccgccucagaggcgaagcucggaagaccuucgucgaucuuaugcgcagaggggaccugcccguguggcuggccuaucggguugcugccgagggaauuaacuacgcugauagacgcugguguuuugacggcaucaaaaauaaccaaauucucgaagagaacguggaggucgaaaucuggacgaaggagggggaacggaaaaagcugaagccuagauggcuugaugcccgcaucuauuccgacccccuggcgcucaaagaguucaaggaguucgccgcuggccggaaaucucugacacugaaucucauuaccgagaugggaagacuuccgacauuuaugacccagaaggcccgggaugcucuggacaaccuggccgugcuccauacggccgaggcuggcgggcgcgcguacaaucacgcccugagcgaacuuccugagacccuggaaacacuccugcugcucacccuucuggcuacaguuaccggaggcaucuuccuguuucucauguccgggaaaggaauuggcaagaugacacugggcaugugcugcaucauuaccgccagcauccuucugugguaugcccagauccagccccacuggauugcugccucuaucauucucgaguucuuucugaucgugcugcucauucccgaaccugagaagcaaagaacgccgcaggauaaccagcuuacauacgucgugaucgcgauccugaccgucguggccgcuaccauggccaaugagaugggguuccuggagaaaacaaagaaagaccucggacugggcuccauuaccacacaggaaagcgaauccaacauccuugacauugaucugcggcccgcuucugccuggacgcucuaugcgguugccaccacauuugugaccccuaugcugcgccauagcaucgaaaauuccucugugaacgucagccugacagcuauugccaaucaagcuaccguucucauggggcuuggaaagggcuggccccuguccaaaauggacaucggggugccucugcucgccauuggauguuacagccaggugaaccccaucacgcugaccgcugcccuucugcuccuggucgcgcacuacgccaucauuggcccuggccugcaggcuaaggccacaagagaagcucagaagcgggccgccgcggggaucaugaaaaauccgaccguggauggaauuacaguuaucgaccucgagcccauuccuuaugaucccaaguucgagaaacaacuuggccaggugaugcugcugauccucugcgucacccaggugcugaugaugcgcacgacaugggcucuuugugaagcccugacccucgcuacagggccuaucucuacccugugggagggaaaccccggcagauuuuggaauaccacaauugccgucuccauggccaacaucuuccgggggagcuaccuggcuggagccggccuccucuuuucuauuaugaagaauacgaccaacacacgcagaggcaccgggaauaucggagaaacacugggcgagaaauggaagucccggcugaacgcgcucggaaagagcgaguuccagauuuauaaaaagucuggaauccaagaaguggacagaacccuggccaaagagggcaucaagcgcggggaaacggaucaucacgcuguuagccggggauccgccaaacuuagaugguuuguggagcgcaacauggucacaccggaaggcaaggugguugaccugggcugcgggcggggaggcuggucuuacuauugugggggacucaaaaaugugagagaggucaagggccugaccaaagggggaccuggccaugaggaacccauucccaugagcaccuacggcuggaaccuggugcgccuccaguccgggguggauguuuucuucacaccucccgagaaaugcgacacccuucugugugauaucggagaaagcuccccuaauccgacaauugaggcuggccggacgcugagaguccucaaccugguggaaaauuggcuuaacaauaacacccaguuuugcaucaaggugcugaaucccuauaugccuucugucauugagaaaauggagacacuccaacgcaaguacgggggagcccugguucggaacccccugagcagaaauuccacccacgaaauguacugggugucuaacgcgacaggcaauaucgugagcuccgucaacaugaucucucgcaugcucauuaaucgguucaccaugaaacacaagaaggccacguaugagccugacguggaucuugggagcggaaccagaaacaucggcauugaauccgagauccccaaccuggacauuaucggcaaacgcauugaaaagaucaaacaggagcaugagacaagcuggcacuacgaccaggaucauccguauaagaccugggcuuaccacgggucuuaugaaacaaaacagaccggauccgccagcucuaugguuaauggcguggucagacugcucacaaagccuugggacgugguucccauggugacccaaauggcuaugacggauacaaccccuuuugggcagcagcgggucuucaaggagaaaguggacacccgcacacaggaacccaaggagggaacgaaaaagcugaugagaaucaccgccgaguggcuuuggaaagaacugggcaagaagaaaacaccucggauguguaccagagaggaauuuacacggaaggugcgcuccaacgcugcccucggggcgauuuucaccgaugagaauaaauggaaaagcgccagagaagcugucgaggacucucgguuuugggagcugguugaucgcgaaagaaaccugcaccucgagggaaaaugcgaaacauguguguacaauaugaugggcaagcgggagaaaaagcugggcgaguucgggaaggccaaaggaucccgcgcuaucugguauauguggcuuggcgccagauuucuggaguucgaggcccucggguuucugaacgaagaccauugguucagccggggaaauucccuuagcggcguggagggggaaggccugcaccgccucggauacauucugagagaugucucuaagaaagagggcggggcgauguacgcugacgauaccgccggaugggacacgcggaucacccuggaagaccucaagaacgaggagauggugacaaaucauaugaaaggcgaacacaagaagcuggccgaggcuauuuuuaaacuuaccuaucaaaacaagguugugcgcguccagagacccacaccgcgggggaccgugauggauaucaucagccgcagagaccagcggggauccggccagguugggacguacggccugaauacauucaccaacauggaagcccaacucauuagacagauggagggagagggcaucuucaaaucuauucagcaucugacagugaccgaagagaucgcuguccaaaauuggcuugcccgcguggggcgggaaagacugagccgcauggcgauuuccggagaugacugcguugugaagccucucgaugaccgguuugccucugcucugacggcccugaacgauaugggcaaagucagaaaggacauccagcagugggagcccagccgcggguggaaugauuggacccaggugcccuucugcucccaccacuuucaugaacucgucaugaaggacggacgggugcugguugugccuuguagaaaccaagaugagcuuaucggccgcgcucggauuucucagggggccggcuggagccugaaagagacagcgugccucggaaaguccuaugcccagauguggacccugauguacuuccacagacgcgaccuucggcuggcugccaacgcuaucuguagcgccgucccgucucauugggugcccacauccagaaccacauggagcauucacgcuaaacacgaauggaugaccacggaggauaugcucgccguguggaaucggguuuggauccaggaaaacccuuggauggaggacaagacacccguggaaucuugggaggaggucccuuaucugggcaaaagagaagaccaauggugcgggucccugauuggacucaccagccgcgcgaccugggccaagaauauccagacagcuauuaaccaggugcggucccugaucggcaaugaggaauacaccgauuauaugcccucuaugaagagauuucgcagagaggaagaggaggccgggguucuuugg

SEQ ID NO: 20269 - RNA, 9873 nt, Artificial Sequence
  derived and/or modified CDS sequence (opt5) from DENV-2__HQ012535__SS-prME
accgcgggagugaucauuaugcugauccccaccgcuauggccuuccaccucacgaccagaaauggggaaccucauaugauugugggacggcaggaaaagggcaagagccugcuuuuuaagaccgaagacgggguuaauaugugcacccugauggcgaucgaucucggagaacugugugaggacaccauuaccuacaagugcccgcuucugagacaaaaugaacccgaggauaucgacuguuggugcaauuccaccucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaaacuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaaacuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaacucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggucaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcccucuuccuggaggaaaugcugagaacacgcguggggaccaagcacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaaaguccgcccuaccuucgccgcgggccuucugcucagaaagcugacgucuaaagagcucaugauggcuacaauugggaucgcccugcuuagccaguccaccauucccgaaacaauccuggagcucaccgacgcccuggcucugggaaugauggugcuuaagaucguucggaacauggaaaaauaccagcuggccgugaccauuauggcgaucucuugcgucccuaaugcugugauucuccugaacgccuggaaggugagcuguacaauccucgccgcugucuccguuagcccccugcuucugacgucuucccaacagaagaccgauuggauuccucucgcccugacaaucaaaggccugaaucccaccgcuaucuuucuuacaacccugagccgcacgucuaagaaaagauccuggccgcucaacgaggccgugauggcgguggggauggucagcauucuggccucuucccuccugaagaaugacaucccuaugacaggaccccuuguggcuggcggccugcugaccguuugcuaugugcucaccgggcggagcgccgaccuggagcuugaacgcgcugccgaugucaaaugggaggaccaggccgaaauuuccggaagcucuccuauccugagcauuacaaucuccgaggauggcucuaugagcauuaagaacgaggaagaggaacagacccucacaauccugaucagaacggggcuccuggugauuuccggaguuuuccccgugucuaucccgauuaccgcugcggccugguaccuuugggaggucaaaaagcaacgggcuggcgugcugugggacgucccuucucccccucccguggaaaaggccgagcuggaggauggggccuaucgcaucaaacagagaggcauucucggcuacucccagaucggcgcugggguuuauaaggaaggaacauuucacaccauguggcaugugacacggggcgccguccugaugcaccgcgggaaaagaaucgagcccuccugggcggacgugaagaaagaucuuauuagcuacggaggcggguggaagcuggaaggagaguggaaggaaggcgaggagguucaggugcucgcucuggaaccuggcaaaaauccgcgggccguccaaaccaagcccggacucuucaaaacgaacaccggaacaaucggcgccgugucccuggacuuuagcccugggaccucuggaucccccauuguggauagaaagggcaaaguugucgggcuuuacggaaauggcguggugacacgcagcggcgcuuaugucucugccaucgcgcagaccgagaaguccauugaagacaacccugagaucgaagaugacaucuuccggaagaaaagacugacaauuauggaucugcaucccggggcuggaaagacgaaacgcuaccucccugccaucgugcgggaggccauuaagagaggccugcgcacccuuauccuggcuccgacacggguuguggccgcugagauggaagaggcccucagagggcugcccauucgcuaucagaccccugcgauccgggccgaacacaccggaagagagauugucgaccucaugugucaugcuacauucacgaugcggcugcuuagccccgugcgcguuccuaacuacaaucugaucaucauggacgaggcccacuuuaccgaucccgcuuccauugccgccagaggcuauaucucuacacggguggaaaugggggaggcugcgggcauuuucaugaccgccacaccgccuggaagccgcgaccccuuuccccaguccaacgcuccuaucauggaugaagagagagaaauucccgagcggagcuggaacucuggccacgagugggucaccgacuucaaagggaagacggugugguuuguuccuuccaucaaggccggaaacgauaucgccgcuugccugcgcaagaauggcaagaaagugauucaacucagccgcaagacauucgacucugaauacgucaaaacccgggccaacgauugggacuuuguggugaccacagauaucagcgagaugggggcgaauuucagagcugaacgcgucauugacccgcggagauguaugaagcccguuauccugaccgauggagaggaacgcgugauucuugccggcccuaugcccgugacacauuccucugccgcucagcggagagggcgcaucggcagaaacccuaagaaugagaacgaccaguauaucuacaugggagagccccuggaaaaugacgaggauugcgcccacuggaaagaagcgaagaugcuccuggacaacauuaauaccccggagggcaucauuccuagcauguuugaacccgagcgggagaaagucgaugccaucgacggggaauaccgccugagaggagaggcucggaagacguucguggaucucaugcgcagaggcgaccuuccuguuuggcuggccuaucggguggcugccgaagggauuaacuacgcugauagacgcugguguuuugacggaaucaaaaauaaccaaauucuggaggagaacgucgaaguggagaucuggacaaaggaaggcgagcggaaaaagcucaagcccagauggcuggaugcccgcaucuauuccgacccucuugcgcugaaagaguucaaggaguucgccgcugggcggaaaucucucacccugaaucugauuacagagaugggcagacuccccaccuuuaugacgcagaaggcccgggaugcucuugacaaccuggccguucugcauaccgccgaagcuggaggccgcgcguacaaucacgcccucagcgagcugccggaaacacuugagacccugcuccugcugacacuccuugcuaccgugacagggggaaucuuccuguuucugauguccggcaaagggauuggaaagaugacccucggcaugugcugcaucauuacggccagcauccugcuuugguaugcccagauccagccucacuggauugcugccucuaucauucuggaguucuuucucaucguccugcugauucccgagcccgagaagcaaagaacaccucaggauaaccagcucaccuacguggucaucgcgauccuuaccgugguugccgcuacaauggccaaugaaaugggcuuccuggagaaaaccaagaaagaccuggggcucggauccauuacaacgcaggaaagcgaguccaacauccuggacauugaucuucggccggcuucugccuggacccuguaugcgguggccacaaccuuugugacacccaugcuccgccauagcaucgaaaauuccucugucaacguuagccugaccgcuauugccaaucaagcuacggugcugaugggccucgggaagggauggccucuuuccaaaauggacaucggcgugccccugcuggccauuggguguuacagccaggucaacccuaucacccucacagcugcccugcuucugcucguggcgcacuacgccaucauuggacccggccugcaggcuaaggccaccagagaggcucagaagcgggccgccgcgggcaucaugaaaaauccuacaguugaugggauuaccgugaucgaccuggagccgauucccuaugauccuaaguucgaaaaacaacucggacaggucaugcuucugauccugugcgugacgcagguccucaugaugcgcacaaccugggcucugugugaggcccuuacacuggcuaccggccccaucucuacccucugggaagggaacccuggaagauuuuggaauacaacgauugccguguccauggccaacaucuuccggggcagcuaccuggcuggggccggacugcucuuuucuauuaugaagaauaccacaaacacccgcagaggcacaggcaauaucggggagacccuuggagagaaauggaagucccggcugaacgcgcugggcaagagcgaguuccagauuuauaaaaagucugggauccaagagguugacagaacgcucgccaaagaaggaaucaagcgcggcgagacagaucaucacgcugugagccggggguccgccaaacugagaugguuugucgaacgcaacauggugacccccgagggaaagguuguggaccuuggcugcggcagagggggauggucuuacuauuguggcgggcugaaaaauguccgggaggugaagggacucaccaagggcgggccgggacaugaagaaccuauucccaugagcacauacggcuggaaccuggugcgccugcaguccggcguugaugucuucuucacacccccugaaaaaugcgacacacuccuuugugauaucggggagagcucccccaauccuacgauugaagcuggacggacccugagagugcugaaccucgccgagaauuggcugaacaauaacacacaguuuugcaucaaggugcuuaauccguauaugcccucugucauugagaaaauggaaacccugcaacgcaaguacggcggggcgcucguucggaacccucugagcagaaauuccacacacgagauguacugggugucuaacgccaccggaaauaucgugagcuccgucaacaugaucucucgcaugcugauuaaucgguucacgaugaaacacaagaaggcuaccuaugaacccgacguggaucucggcagcgggacaagaaacaucggaauugaguccgaaaucccuaaccuugacauuaucggcaaacgcauugagaagaucaaacaggagcaugaaaccagcuggcacuacgaccaggaucaucccuauaagacaugggccuaccacggcucuuaugagaccaaacagacaggguccgcuagcucuaugguuaauggaguggucagacugcugaccaagccgugggacgugguuccuauggugacgcaaauggccaugacagauaccacccccuuuggccagcagcgggucuucaaggaaaaaguggacacacgcacgcaggagccuaaggaggggaccaaaaagcucaugagaaucacagcugaauggcuguggaaagagcuuggaaagaagaaaacaccccggauguguacaagagaagaguuuacccggaaggugcgcuccaacgccgcgcugggcgccauuuucacagaugaaaauaaauggaaaagcgcuagagaggccgucgaggacucucgguuuugggaacucguugaucgcgagagaaaccugcaccuggaagggaaaugcgagaccuguguguacaauaugaugggaaagcgggagaagaagcucggcgaguucggcaaggcuaaagggucccgcgccaucugguauauguggcugggagccagauuucuugaguucgaagcgcugggcuuucucaacgaggaccauugguucagccgggggaauagccugagcggaguggaaggcgaggggcuucaccgccugggcuacauucucagagaugucucuaagaaagaaggaggcgcuauguacgccgacgauacggccgggugggacacccggaucacacuggaggaccugaagaacgaggaaauggugaccaaucauaugaaaggagagcacaagaagcucgcugaagccauuuuuaaacugacauaucaaaacaagguugugcgcguccagagaccuacaccccggggcacggugauggauaucaucagccgcagagaccagcggggguccggacagguuggcacauacgggcuuaauaccuucacaaacauggaggcucaacugauuagacagauggagggcgaaggaaucuucaaaucuauucagcaucucaccgugacggaggaaaucgccguccaaaauuggcuggcgcgcgugggccgggagagacuuagccgcauggccauuuccggggaugacugcguugugaagccgcuggaugaccgguuugcuucugcccucaccgcucugaacgauaugggaaaagucagaaaggacauccagcagugggaaccuagccgcggcuggaaugauuggacacaggugcccuucugcucccaccacuuucaugagcuggucaugaaggacgggcgggugcucguugugcccuguagaaaccaagaugagcugaucggacgcgcccggauuucucagggcgcgggguggagccuuaaagaaaccgccugccugggcaaguccuaugcucagauguggacacucauguacuuccacagacgcgaccugcggcuugccgcuaacgccaucuguagcgcugucccuucucauugggugccgaccuccagaacaaccuggagcauucacgccaaacacgaguggaugacgacagaagauaugcuggcgguguggaaucggguuuggauccaggagaaccccuggauggaagacaagaccccuguggagucuugggaggaaguccccuaucucggaaaaagagaggaccaauggugcggcucccugauugggcugaccagccgcgccacaugggcuaagaauauccagaccgccauuaaccaggugcggucccucaucggaaaugaagaguacacagauuauaugccuucuaugaagagauuucgcagagaagaggaggaagccggcguucugugg

SEQ ID NO: 20270 - RNA, 9873 nt, Artificial Sequence
  derived and/or modified CDS sequence (opt5) from DENV-2__HQ012536__SS-prME
accgccggagugaucauuaugcugauccccaccgcuauggccuuccaccuuacgacccggaauggggagccucauaugauugucggacggcaggaaaagggcaagagccugcuuuuuaagacggaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggcuggacaagcuccagcugaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccucggccggcugaucacggugaacccuauuguuaccgggaaggauagcccggugaacaucgaggcugaacccccuuuuggcgacucuuacauuaucaucggagucgagcccggccagcuuaaacugaauugguucaagaagggguccagcauuggacagauguuugagacaaccaugagaggcgccaaacgcauggccauccucggggauacagcuugggacuucggaucucugggcgggguguuuaccagcauuggcaaggcccugcaccaaguuuucggagcgaucuacggcgcugccuuuuccggggugucuuggacgaugaaaauucuuaucggagucaucauuacauggaucggcaugaacagccgguccaccagccucucugugucccuggugcugguuggggucgugacccucuaucugggagccauggugcaggcugauagcggcugugucgugucuuggaagaauaaagaacuuaagugcggguccggcauuuucaucacagacaacguucacaccuggacagagcaguacaaguuucagccugaaagccccuccaaacuggccucugcuauucaaaaggcccaugaggaaggaaucuguggcaucagaagcgugacgcgccucgagaaucugauguggaaacagauuaccccggagcugaaccacauccuuuccgaaaaugaggucaagcucacaauuaugaccggggauaucaaaggaauuaugcaggcgggcaagcggucucugagaccucagcccacagaacugaaauauagcuggaagaccugggggaaggccaaaaugcucuccacggagagccauaaccaaaccuuccugaucgacggaccugaaacagcugagugccccaauaccaaccgcgccuggaacucucuugagguggaagauuacggcuuuggcguuuucacaaccaacaucuggcugaagcuccgggagaaacaggacguguuuugugacuccaagcugaugagcgcugccauuaaagauaauagagcgguccacgccgacaugggguauuggaucgaaucugcucugaacggaacauggaagauggagaaggccuccuucauugaggugaaaagcugccacuggccuaagucucauacccuuuggagcaauggcguucucgaauccgagaugaucauucccaaaaacuucgcugggccggugagccagcacaacuaccgcccuggauaucauacgcagacagccggccccuggcaccuggggaagcuggaaauggauuuugacuucugugagggaaccaccgucguggugacagaagauugcggcaaucggggccccucucucagaaccacgacagccuccgggaaacugaucaccgaguggugcugucggagcugcacacuuccuccgcugcgcuacagaggagaggacggcuguugguacgggauggaaauucggccccucaaggagaaggaagagaaccuggucaauucccugguuaccgcuggacauggccaaaucgauaacuuuucucuuggggugcucggaauggcgcuguuccuggaagagaugcucagaacacgcgugggcaccaaacacgccauccugcuugucgcugugagcuuuguuacgcugauuaccggcaauauguccuucaaggaccucgggcgggugauggucauggugggaguugccaugacagaugacaucggcaugggggugaccuaucuggcccugcuugcugccuuuaaagucagaccuacauucgcggcuggacugcuccugcgcaagcucaccucuaaagagcugaugauggccacgauuggcaucacacuucugagccaguccaccauucccgaaacaauccucgagcugaccgaugcccuggcucuugggaugauggugcugaagaucguuagaaacauggaaaaguaccagcucgccgugaccauuauggcgaucucuugcgucccuaaugcugugauucugcucaacgccuggaaagugagcuguacaauccuggccgcugucuccguuagcccccuucugcucacgucuucccaacagaagaccgacuggauuccucuggcccugacaaucaaaggacuuaaucccaccgcuaucuuucugacaacccucagccggacgucuaagaaacgcuccuggccgcugaacgaggccgugauggcggugggcauggucagcauucucgccucuucccugcuuaagaaugauaucccuaugacaggcccccugguggcugggggacugcucaccguuugcuaugugcugaccggcagaagcgccgaccuugaacuggagcgggcugccgacgucaaaugggaggaucaggccgaaauuuccgggagcucuccuauccucagcauuacaaucuccgaggacggaucuaugagcauuaagaacgaagaggaggaacagacccugacaauccucauccgcacgggccugcuugugauuuccgggguuuuccccgugucuaucccgauuaccgcugcggccugguaccugugggaggucaagaaacaaagagcuggagugcugugggaugucccuucucccccucccgugggcaaggccgaacucgaggacggcgccuaucggaucaaacagcgcgggauucugggauacucccagaucggcgcugggguuuauaaggaaggaacauuucacaccauguggcaugugacaagaggcgccguccuuaugcaccgggggaaacgcaucgagcccuccugggcggaugugaagaaggaccugauuagcuacggaggcggcuggaaacucgagggggaauggaaggagggagaagagguucaggugcuggcucucgaaccuggcaaaaauccgagagccguccaaaccaagcccgggcuguucaaaacgaacaccggaacaaucggcgccgugucccuugauuuuagcccugggaccucuggaucccccauuguggaccggaagggcaagguugucggccuguacgggaauggaguggugacaagaagcggcgcuuaugucucugccaucgcgcagaccgagaaauccauugaggauaacccugaaaucgaggacgauaucuuccgcaagaaacggcugacaauuauggaccuccaucccggggcuggaaagacgaaaagauaccugccugccaucgugcgcgaagccauuaagcggggccuuagaacccugauccucgcuccgacacgcguuguggccgcugagauggaagaggcccugcgggggcuccccauuagauaucagaccccugcgauccgcgccgagcacaccggccgggaaauugucgaucugaugugucaugcuacauucacgaugagacuucugagccccgugcggguuccuaacuacaaucugaucaucauggacgaggcccacuuuaccgaccccgcuuccauugccgcccgcggauauaucucuacaagaguggaaaugggcgaggcugcggggauuuucaugaccgccacaccgccuggaagccgggaucccuuuccccaguccaacgcuccuaucauggacgaggaacgcgagauucccgaaagaagcuggaacucuggccacgagugggucaccgauuucaaggggaaaacggugugguuuguuccuuccaucaaggccggaaacgacaucgccgcuugccuccggaaaaauggcaagaaagugauucaacugagcagaaagacauucgauucugaauacgucaagacccgcgccaacgacugggauuuuguggugaccacagacaucagcgagaugggggcgaauuuccgggcugagagagucauugauccgcgccgguguaugaaacccguuauccuuaccgacggcgaagagagagugauucuggccggaccuaugcccgugacacauuccucugccgcucagcgccggggcagagucgggcgcaacccuaagaaugaaaacgaucaguauaucuacaugggagagccccucgaaaaugacgaggacugcgcccacuggaaagaggcgaagaugcugcuggauaacaucaauaccccggaaggcauuaucccuagcauguuugagcccgaaagagagaaaguggacgccauugauggggaauaccggcuccgcggagaggcuagaaagacguucguugaccuuaugcggcgcggcgaucugccuguguggcuggccuauagagucgcugccgaggggaucaacuacgcugaccggagaugguguuuugauggcauuaaaaauaaccaaauccucgaagagaacguggaaguugagauuuggacaaaggagggagaacgcaagaaacugaagccccgguggcuugacgccagaaucuauuccgauccucuggcgcucaaagaguucaaggaguucgccgcuggccgcaaaucucugacccugaaucucaucacagagauggggcggcuucccaccuuuaugacgcagaaggccagagacgcucuggauaaccuggccgugcuccauaccgccgaagcuggaggccgggcguacaaucacgcccugagcgagcuuccggagacacuggaaacccuccugcugcucacacuucuggcuaccgucacagggggaauuuuccuguuucucauguccggcaagggcaucgggaaaaugacccugggaaugugcugcauuaucacggccagcauucuucugugguaugcccagauccagccucacuggaucgcugccucuauuauccucgaguucuuucugauugugcugcucauccccgaacccgagaagcaacgcacaccucaggacaaccagcuuaccuacgucgugauugcgauccugaccguuguggccgcuacaauggccaaugaaaugggcuuccuggagaaaaccaagaaagaucucgggcugggauccaucacaacgcaggagagcgaauccaacauucuugacaucgaccugagaccggcuucugccuggacccucuaugcgguggccacaaccuuugucacacccaugcugcggcauagcauugaaaauagcucuguuaacgugagccugaccgcuaucgccaaucaagcuacggugcucaugggccuugggaagggauggccucuguccaagauggauauuggcgucccccugcucgccaucggcuguuacagccaggugaacccuauuacccugacagcugcccuucugcuccugguugcgcacuacgccaucaucgggcccggacugcaggcuaaagccacccgcgaagcucagaagagagccgccgcgggcauuaugaaaaauccuacaguggacgggaucaccgucauugaucucgagccgauccccuaugacccuaaguucgaaaaacaacuuggacaggugaugcugcugauucucugcgucacacaggugcugaugaugcggacaaccugggcucuuugugaggcccugacacucgcuaccggccccaucucuacccugugggaggggaacccuggacgcuuuuggaauacaacgaucgccguuuccauggccaacauuuucagaggcagcuaccuggcuggcgccgggcuccucuuuucuaucaugaagaauaccacaaacacccggcgcggaacaggcaauauuggggaaacccugggagagaaguggaaauccagacugaacgcgcucggcaagagcgaguuccagaucuauaaaaagucugggauucaagagguggaucggacgcuggccaaagagggaaucaagagaggcgaaacagaccaucacgcugucagccgcggcuccgccaaacuucggugguuuguggagagaaacaugguuacccccgaagggaagguggucgaucugggaugcggccgcgggggauggucuuacuauuguggcgggcucaagaaugugcgggaggugaaaggacugaccaagggcggcccggggcaugaagaaccuauccccaugagcacauacggauggaaccugguuagacuccaguccggcgucgacguguucuucacacccccugagaaaugcgauacacuucugugugacauuggggaaagcucccccaauccuacgaucgaggcuggacgcacccugcgggugcucaaccuggucgaaaauuggcuuaacaauaacacacaguuuugcauuaagguucugaauccguauaugcccucugugaucgagaaaauggaaacccuccaaagaaaguacggcggggcccuggugcgcaacccucugagcagaaauuccacacacgagauguacugggucucuaacgcgaccggaaauauugugagcuccguuaacaugaucucuagaaugcucaucaaucgcuucacgaugaagcacaaaaaggccaccuaugagcccgauguggaccuuggcagcggcacacggaacauugggaucgaauccgagauuccuaaccuggauaucauuggaaaaagaaucgaaaagauuaaacaggagcaugaaaccagcuggcacuacgaccaggaccaucccuauaagacaugggcuuaccacggcucuuaugagaccaagcagacaggguccgccagcucuauggucaauggagugguucgccugcucaccaaaccgugggauguggucccuauggugacgcaaauggcuaugacagacaccacccccuuuggccagcagagaguguucaaggagaaagucgauacacggacgcaggaaccuaaggaggggaccaaaaagcugaugcgcaucacagccgaauggcuuuggaaggagcugggcaagaagaaaacccccagaauguguacacgggaggaauuuaccagaaagguucgguccaacgcugcccucggcgcgaucuucacagacgagaauaaauggaaaagcgcccgcgaagcuguggaggauucuagauuuugggaacugguggaccgggagcgcaaccugcaccucgagggcaaaugcgaaaccugugucuacaauaugauggggaagagagagaagaaacugggagaguucggcaaggccaaagggucccgggcuauuugguauauguggcuuggagcccgcuuucuggaguucgaagcccucggcuuucugaacgaggaucauugguucagcagaggaaauucccuuagcggcguggagggagaaggccugcaccggcucggguacauccugcgcgacguuucuaagaaagagggaggcgcgauguacgcugaugacacggccgggugggauaccagaauuacacuggaagaccucaagaacgaggaaauggugaccaaucauaugaagggagagcacaaaaagcuggccgaggcuaucuuuaaacuuacauaucaaaacaaggucgugcggguucagcgcccuacccccagaggcacggugauggacauuaucagccggcgcgaucagagaggguccggccaggucggaacauacggccugaauaccuucacaaacauggaagcccaacucauccggcagauggagggggaaggaauuuucaaaucuauccagcaucugaccgugacggaggagauugcuguucaaaauuggcuugccagagugggccgcgaacggcugagcagaauggcgaucuccggggacgauugcgucgugaagccgcucgacgaucgcuuugccucugcucugaccgcccugaacgacaugggaaagguccggaaagauauucagcagugggagccuagcagaggcuggaaugacuggacacaggugcccuucugcucccaccacuuucaugaacucguuaugaaggaugggcgcgugcuggucgugcccugucggaaccaagacgagcuuaucggcagagcucgcaucucucagggagccggcuggagccugaaagaaaccgcgugccucgggaaguccuaugcccagauguggacacugauguacuuccaccggagagaucuucgccuggcugccaacgcuauuuguagcgccgugccuucucauuggguuccgaccucccggacaaccuggagcauccacgcuaaacacgaguggaugacgacagaggacaugcucgccguguggaauagagucuggauucaggaaaaccccuggaugggagauaagaccccuguggagucuugggaagagguucccuaucugggcaagcgggaagaccaauggugcgggucccugaucggacucaccagcagagcgacaugggccaaaaauauucagaccgcuaucaaccaggugcgcucccugauuggcaaugaggaguacacagacuauaugccuucuaugaagcgguuuagacgcgaagaggaagaggccgggguccuuugg

SEQ ID NO: 20271 - RNA, 9873 nt, Artificial Sequence
  derived and/or modified CDS sequence (opt5) from DENV-2__HQ012537__SS-prME
accgcgggagugaucauuaugcugauccccaccgcuauggccuuccaccucacgaccagaaauggggagccucauaugauugucggacggcaggaaaagggcaaaagccugcuuuuuaagacagaggacgggguuaauaugugcacccugauggcgaucgaucucggagaacugugugaggacaccauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacaucuggcuuaagcugcgggaaaaacaggacguguuuugugacuccaagcucaugagcgcugccauuaaagauaauagagcgguccacgccgacaugggcuauuggaucgagucugcucugaacgauacauggaagauggagaaggccuccuucauugaagugaaaagcugccacuggccuaagucucauacccuguggagcaaugggguucuugaguccgaaaugaucauucccaaaaacuucgcuggaccggugagccagcacaacuaccgcccuggcuaucauacgcagacagccgggcccuggcaccucggaaagcuggagauggacuuugauuucugugaaggcaccaccgucguggugacagaggacugcgggaaucggggacccucucugagaaccacgacagccuccggcaaacucaucaccgaguggugcugucggagcugcacacugccuccgcuucgcuacagaggcgaagauggguguugguacggaauggagauucggccccugaaggaaaaggaggaaaaccucgucaauucccugguuaccgcuggccaugggcaaaucgacaacuuuucucugggagugcuuggcauggcccucuuccuggaggagaugcugagaacacgcguggggaccaaacacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaagguccgcccuaccuucgccgcgggccuucugcucagaaaacugacgucuaaggaacucaugauggcuacaauugggaucgcccugcuuagccaguccaccauucccgagacaauccuggaacucaccgacgcccuggcucugggaaugauggugcuucggaucguucgcaacauggagaaauaccagcuggccgugaccauuauggcgaucucuugcgucccuaaugcugugauucuccugaacgccuggaaggugagcuguacaauccucgccgcugucuccguuagcccccugcuucugacgucuucccaacagaagaccgauuggauuccucucgcccugacaaucaaaggccugaaucccaccgcuaucuuucuuacaacccugagcagaacgucuaagaaacgguccuggccgcucaacgaagccgugauggcgguggggauggucagcauucuggccucuucccuccugaagaaugacaucccuaugacaggaccccuuguggcuggcggccugcugaccguuugcuaugugcucaccgggcgcagcgccgaccuggagcuugagagagcugccgaugucaaaugggaagaccaggccgagauuuccggaagcucuccuauccugagcauuacaaucuccgaagauggcucuaugagcauuaagaacgaggaggaagaacagacccucacaauccugauccggacggggcuccuggugauuuccggaguuuuccccgugucuaucccgauuaccgcugcggccugguaccuuugggaagucaaaaagcaacgcgcuggcgugcugugggacgucccuucucccccucccguggagaaggccgaacuggaggauggggccuauagaaucaaacagcggggcauucucggcuacucccagaucggcgcugggguuuauaaggagggaacauuucacaccauguggcaugugacacgcggcgccguccugaugcacagagggaaacggaucgaacccuccugggcggacgugaagaaagaucuuauuagcuacggaggcggguggaagcuggagggagaauggaaggagggcgaagagguucaggugcucgcucuggagccuggcaaaaauccgagagccguccaaaccaagcccggacucuucaaaacgaacaccggaacaaucggcgccgugucccuggacuuuagcccugggaccucuggaucccccauuguggaucgcaagggcaaaguugucgggcuuuacggaaauggcguggugacacggagcggcgcuuaugucucugccaucgcgcagaccgaaaaguccauugaggacaacccugaaaucgaggaugacaucuucagaaagaaacgccugacaauuauggaucugcaucccggggcuggaaagacgaaacgguaccucccugccaucgugagagaagccauuaagcgcggccugcggacccuuauccuggcuccgacaagaguuguggccgcugagauggaggaagcccuccgcgggcugcccauucgguaucagaccccugcgaucagagccgagcacaccggacgggaaauugucgaccucaugugucaugcuacauucacgaugcgccugcuuagccccgugagaguuccuaacuacaaucugaucaucauggacgaggcccacuuuaccgaucccgcuuccauugccgcccggggcuauaucucuacacgcguggagaugggggaagcugcgggcauuuucaugaccgccacaccgccuggaagcagagaccccuuuccccaguccaacgcuccuaucauggaugaggaacgggagauucccgaaagaagcuggaacucuggccacgagugggucaccgacuucaaagggaagacggugugguuuguuccuuccaucaaggccggaaacgauaucgccgcuugccugcgcaaaaauggcaagaaagugauucaacucagccggaagacauucgacucugaguacgucaaaaccagagccaacgauugggacuuuguggugaccacagauaucagcgaaaugggggcgaauuuccgcgcugagcgggucauugacccgagacgcuguaugaagcccguuauccugaccgauggagaagaacgggugauucuugccggcccuaugcccgugacacauuccucugccgcucagagacgcgggagaaucggccggaacccuaagaaugaaaacgaccaguauaucuacaugggagagccccuggagaaugacgaagauugcgcccacuggaaagaggcgaagaugcuccuggacaacauuaauaccccggaaggcaucauuccuagcauguuugagcccgaacgcgagaaagucgaugccaucgacggggaguacagacugcggggagaagcucgcaagacguucguggaucucaugagacggggcgaccuuccuguuuggcuggccuauagaguggcugccgaggggauuaacuacgcugaucgccggugguguuuugacggaaucaaaaauaaccaaauucuggaagagaacgucgagguggaaaucuggacaaaggagggcgaacgcaagaagcucaagccccgcuggcuggaugcccggaucuauuccgacccucuugcgcugaaagaguucaaggaguucgccgcugggagaaaaucucucacccugaaucugauuacagagaugggccggcuccccaccuuuaugacgcagaaggcccgcgaugcucuugacaaccuggccguucugcauaccgccgaggcuggaggcagagcguacaaacacgcccucagcgaacugccggagacacuugaaacccugcuccugcugacacuccuugcuaccgugacagggggaaucuuccuguuucugauguccggcaaggggauuggaaagaugacccucggcaugugcugcaucauuacggccagcauccugcuuugguaugcccagauccagccucacuggauugcugccucuaucauucuggaguucuuucucaucguccugcugauucccgaacccgagaaacaacggacaccucaggauaaucagcucaccuacguggucaucgcgauccuuaccgugguugccgcuacaauggccaacgagaugggcuuccuggaaaagaccaaaaaggaccuggggcucggauccauuacaacgcaggagagcgaauccaauauccuggacauugaucuucgcccggcuucugccuggacccuguaugcgguggccacaaccuuugugacacccaugcucagacauagcaucgagaacuccucugucaauguuagccugaccgcuauugccaaccaagcuacggugcugaugggccucgggaaaggauggccucuuuccaagauggacaucggcgugccccugcuggccauuggguguuacagccaggucaauccuaucacccucacagcugcccugcuucugcucguggcgcacuacgccaucauuggacccggccugcaggcuaaggccacccgggaagcucagaaacgcgccgccgcgggcaucaugaagaacccuacaguugaugggauuaccgugaucgaccuggagccgauucccuaugauccuaaauucgagaagcaacucggacaggucaugcuucugauccugugcgugacgcagguccucaugaugagaacaaccugggcucugugugaagcccuuacacuggcuaccggccccaucucuacccucugggaggggaauccuggacgguuuuggaacacaacgauugccguguccauggccaauaucuuccgcggcagcuaccuggcuggggccggacugcucuuuucuauuaugaaaaacaccacaaauaccagacggggcacaggcaacaucggggaaacccuuggagagaaguggaaguccagacugaaugcgcugggcaaaagcgaguuccagauuuauaagaaaucugggauccaagaaguugaccgcacgcucgccaaggagggaaucaaacggggcgaaacagaucaucacgcugugagcagaggguccgccaagcugcgcugguuugucgagcggaacauggugacccccgaaggaaaaguuguggaccuuggcugcggcagagggggauggucuuacuauuguggcgggcugaagaacguccgcgaggugaagggacucaccaaaggcgggccgggacaugaggaaccuauucccaugagcacauacggcuggaaucuggugcggcugcaguccggcguugaugucuucuucacacccccugagaagugcgacacacuccuuugugauaucggggaaagcucccccaacccuacgauugaggcuggaagaacccugcgcgugcugaaucucgccgaaaacuggcugaauaacaauacacaguuuugcaucaaagugcuuaacccguauaugcccucugucauugagaagauggagacccugcaacggaaauacggcggggcgcucguuagaaauccucugagccgcaacuccacacacgaaauguacugggugucuaaugccaccggaaacaucgugagcuccgucaauaugaucucucggaugcugauuaacagauucacgaugaagcacaagaaagcuaccuaugagcccgacguggaucucggcagcgggacacgcaauaucggaauugaauccgagaucccuaaccuugacauuaucggcaagagaauugagaagaucaagcaggagcaugagaccagcuggcacuacgaccaggaucaucccuauaaaacaugggccuaccacggcucuuaugaaaccaagcagacaggguccgcuagcucuaugguuaacggagugguccggcugcugaccaagccgugggacgugguuccuauggugacgcaaauggccaugacagauaccacccccuuuggccagcagcgcgucuucaaagagaagguggacacaagaacgcaggaaccuaaagaggggaccaagaaacucaugcggaucacagcugaguggcuguggaaggaacuuggaaagaaaaagacccccagaauguguacacgggaggaauuuacccgcaaagugagauccaaugccgcgcugggcgccauuuucacagaugagaacaaguggaaaagcgcucgggaagccgucgaggacucucgcuuuugggagcucguugauagagaacggaaucugcaccuggaggggaagugcgaaaccuguguguacaacaugaugggaaaacgcgagaagaagcucggcgaguucggcaaagcuaagggguccagagccaucugguauauguggcugggagcccgguuucuugaguucgaggcgcugggcuuucucaaugaagaccauugguucagccgcgggaacucccugagcggaguggagggcgaagggcuucacagacugggcuacauucuccgggaugucucuaaaaaggagggaggcgcuauguacgccgacgauacggccgggugggacacccgcaucacacuggaagaccugaaaaaugaggagauggugaccaaccauaugaagggagaacacaagaaacucgcugaggccauuuuuaagcugacauaucaaaauaaaguugugagaguccagcggccuacccccagaggcacggugauggauaucaucagcagaaaggaccagcggggguccggacagguuggcacauacgggcuuaacaccuucacaaauauggaagcucaacugauuagacagauggagggcgagggaaucuucaaaucuauucagcaucucaccgugacggaagagaucgccguccaaaacuggcuggcgcgcgugggccgggaaagacuuagccgcauggccauuuccggggaugacugcguugugaagccgcuggaugaccgguuugcuucugcccucaccgcucugaaugauaugggaaaggucagaaaagacauccagcagugggagccuagccgcggcuggaacgauuggacacaggugcccuucugcucccaccacuuucaugaacuggucaugaaggacgggcgggugcucguugugcccuguagaaaucaagaugagcugaucggacgcgcccggauuucucagggcgcgggguggagccuuaaagagaccgccugccugggcaaguccuaugcucagauguggacacucauguacuuccacagacgcgaccugcggcuugccgcuaacgccaucuguagcgcugucccuucucauugggugccgaccuccagaacaaccuggagcauucacgccaaacacgaauggaugacgacagaggauaugcuggcgguguggaaccggguuuggauccaggaaaaucccuggauggaggacaagaccccuguggaaucuugggaggagguccccuaucucggaaagagagaagaccaauggugcggcucccugauugggcugaccagccgcgccacaugggcuaaaaacauccagaccgccauuaaucaggugcggucccucaucggaaacgaggaauacacagauuauaugccuucuaugaagagauuucgcagagaggaagaggaggccggcguucugugg

SEQ ID NO: 20272 - RNA, 9876 nt, Artificial Sequence
  derived and/or modified CDS sequence (opt5) from DENV-2__KU365901__SS-prME
accgccggcaucauuaucaugaugauucccaccgugauggcuuuccaccucacgaccagaaacggggagccucauaugaucgugagccggcaggaaaaggggaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucacccaggagcugaaucauauucucagcgagaacgaagugaaacugacaaucaugaccggagacaucaagggcauuaugcaggccgggaaacggucccugagaccgcaaccuacagagcuuaaguacagcuggaaaaccuggggaaaggcgaagaugcucucuacggaacugcacaaucauaccuuccugaucgauggccccgagacagccgaaugcccuaacaccaaucgcgcuuggaacucccucgagguugaggacuauggguuuggaguguucacaaccaauauuuggcugaaacuuaaggaaaaacaggaugucuuuugugacagcaagcugaugucugccgcuaucaaagacaaccgggccgugcacgcggauaugggcuacuggauugaguccgcccucaacgacacauggaagaucgaaaaggcuagcuucaucgaggugaaaucuugcaauuggcccaagagccacacccugugguccaacggcguccuggagagcgaaaugauuaucccuaaaaauuucgccgggcccguuucucagcauaacuauagaccgggauaccacacgcagacagcuggcccuuggcaucuugggcgccucgagauggauuuugaguucugugagggaaccaccgugguggucacagaagacugcggcaaucgggggcccucccugagaaccacgacagccagcggaaagcugauuaccgaguggugcugucgguccugcacacugcccccucugcgcuacagaggcgaggauggcuguugguaugggauggaaauccggccgcuuaaagagaaggaagagaaccuggucaauucucucguuaccgccggacacggccaaauugacaacuuuagccugggggugcugggaauggcucuuuuccucgaagagaugcugagaacacgcgucggcaccaagcaugcgauccugcucguggccguuacguuugugacccugauuacagggaauauguccuuccgggaucuuggaagagucauggugaugguuggcgcuaccaugacagacgauaucggcaugggggugaccuaccuggcccuccuggccgcuuuuaaaguccgccccacguucgccgcgggacugcuucugagaaagcucacaucuaaagagcugaugauggcuaccaucggcauugugcuccugagccaguccacaaucccugaaaccauucuugagcugaccgacgcccucgcccuggggaugauggugcugaagaucguccggaacauggaaaaauaucagcuugcuguuacaauuauggccauccugugcgugcccaaugcggugauccuccaaaacgcuuggcgcgucucuuguacgacccuggccgugguuagcguguccccucuccugcuuacaagcucucagcagaaggccgauuggauuccccuggcucucaccaucaagggacugaauccuacagccauuuuucugaccacgcuuuccagaacaagcaaaaagcggucuuggccccugaacgaggcuaucauggccgucggcaugguguccauucucgcgagcucucugcucaaaaaugacaucccgaugaccgggccucugguugccggaggccuucugaccgugugcuacguccugacaggccgcuccgcugaucucgaacuggagagagccgcugacgugcggugggaggaacaggccgagaucagcggguccagccccauucuuucuaucaccauuagcgaagacggauccaugucuaucaagaacgaggaggaagaacaaacacugacgauucucauccgcaccggccugcucgucauuagcgggcuguucccuguguccauccccaucacagccgcugcgugguaucuuugggaaguuaaaaagcagagagccggagugcugugggaugucccgucuccucccccugugggcaaagcugagcuggaagacggggccuaccggauuaagcagaagggaauccucggcuauagccagauuggcgccgggguuuacaaagagggaaccuuucacacaauguggcacgugacccgcggcgcuguccugaugcauaaggggaaaagaaucgagcccuccugggccgaugugaagaaagaccuuauuucuuacggaggcggguggaagcuggaaggagaguggaaggaaggcgaggaagugcaaguucucgcgcuggagcccggcaaaaacccucgggcuguccagacgaagccgggacucuucaaaaccaauacaggaaccaucggcgccgugagccuggauuuuucccccgggacaagcggaucuccuaucguggacaagaaaggcaaggucguggggcuuuauggaaacggcguugugaccagauccggcacauacgucagcgccauugcucagacggagaagucuaucgaagauaaucccgagauugaagacgauaucuuccgcaaaaagcggcugaccauuauggaccugcacccuggggccggaaaaacaaagagauaucuccccgcgaucgugcgcgaggcuaucaaacggggccugagaacccuuauucuggccccuacccgcguuguggccgcugaaauggaggaggcccuccgggggcugccgaucagauaccagacacccgcuauucgcgccgaacauacgggacgggagaucgucgaucucaugugucacgcgaccuucacaaugagacugcuuuccccuauucgggugcccaacuauaaucugaucauuauggacgaagcccauuuuaccgauccugcuagcaucgccgcucgcggcuacaucuccacaagaguugagaugggggaggccgccggcauuuucaugaccgcuacgcccccgggaucucgggacccuuuuccccaaagcaacgcgcccaucauggacgaagaacgcgaaauuccugagagauccuggaauagcggccacgaaugggugacagauuucaaggggaagaccgucugguuugugcccucuaucaaagccggaaacgacauugcugccugccugcggaagaauggcaaaaaggugauccagcucuccagaaaaaccuucgauagcgaguauaucaagacacgcaccaacgacugggauuuugucguuacaaccgacauuucugagaugggggccaauuucaaggcugaacgggugaucgauccuagacgcuguaugaaaccggugauucugacggacggagaggaacgggucauccuugccggccccaugccugugacacacagcuccgcggcucagagacgcgggcggguuggcagaaaccccaagaaugagaacgaucaauacauuuacaugggagaaccucuggagaaugacgaggauugcgcccauuggaaagaagccaagaugcuccuggacaacaucaacacccccgagggcaucauuccgucuauguuugaaccugagcgcgaaaaaguggacgcuaucgauggggaguauagacugcggggagaggcccgcaagacauucgucgaccucaugagacggggcgaucuucccguguggcuggcguaccgcguugccgcugaagggauuaauuaugccgacagacggugguguuuugauggagugaaaaacaaucagauccuggaggaaaacgucgagguggagauuuggaccaaggaaggcgagagaaagaaacucaagccucgcuggcuggacgcucggaucuacagcgauccccuugcccugaaagaguucaaggaguucgcugccgggagaaaaucccucacgcugaaucugauuaccgaaaugggccgccucccuacauuuaugacccagaaggcgcggaacgcccuugacaaucuggcuguccugcacacagccgaggcuggaggcagagccuauaaccaugcccucucugagcugcccgaaacccuugagacacugcuccugcugacccuccuugcuacggugacagggggaaucuuccuguuucugaugagcggcaaggggaucggaaaaaugacccucggcaugugcugcauuaucaccgcguccauucugcuuugguacgcccagauccaaccgcacuggauugcugccagcaucauccuggaguucuuucucauuguucugcugaucccugagcccgaaaagcagcggacaccccaggauaaucagcucaccuauguggugauugccauccuuacagucguugcugccacgauggcgaacgagaugggcuuccuggagaaaaccaagaaagacuuugggcugggaucuauuacaacccaacagccugaauccaauauccucgauaucgaccugcgcccggccagcgcuuggacacuuuacgccguggcuaccacguucauuacccccaugcugagacacuccaucgagaacucuagcgugaaugucucccucacagccauugcgaaccaggccaccgugcugaugggccuggggaagggauggccucucucuaagauggauaucggcguuccccuucuggcuauuggguguuacagccaggugaauccuaucacacugaccgccgcucuccugcuucuggucgcccauuaugcuauuaucggacccggccuccaagccaaagcgacgcgggaagcccagaagcgcgcugccgcuggcaucaugaaaaacccuacaguggacgggauuaccgucaucgaccuggauccgauucccuacgacccuaaguuugagaaacagcugggacaggugaugcuccuuguucugugcgugacacaaguccugaugaugagaaccaccugggcccucugugaagcccugacacuugcgacgggccccaucuccacccugugggaggggaauccuggacgguucuggaacacaaccauugcugugagcauggccaacaucuuucgcggcucuuaucucgcuggggccggacugcuguucuccaucaugaagaauacagccaacaccagacggggcacgggcaauacaggggagacccucggagaaaaguggaaaaaccgccuuaaugcucugggcaagagcgaguuucagauuuacaaaaagucugggauccaggaaguugauagaacccuggccaaagagggaauuaagcggggcgagacagaccaccaugcgguguccagagggagcgccaaacuccgcugguucgucgaacggaaccuggugacccccgagggaaaggugguugaucuuggcugcggcagagggggauggucuuauuacuguggcgggcugaagaaugucaaagaagugaagggacucacaaaaggcgggccgggacacgaggaaccuauccccaugagcacguauggcuggaaccuggugcgccugcaauccggcgucgacguuuucuuuacacccccugagaagugcgauacacuccuuugugacauuggggagucuagccccaauccuaccguggaagcuggacggacacugagagugcugaaccucgucgagaauuggcugaacaauaacacccaguucugcaucaaagugcuuaauccguacaugcccuccguuaucgaaaagauggaggcccugcagcgcaaguacggcggggcucucgugcggaacccucugagcagaaacuccacgcaugaaauguauugggucucuaaugccagcggaaacauuguguccucuguuaauaugaucagccgcaugcugauuaaccgguuuaccaugagacacaaaaaggcgacauacgagcccgauguggaccucggcuccgggacccgcaauaucggaauugagucugaaacaccuaaccuugauaucaucggcaaacggauugagaagaucaaacaggaacacgagaccagcuggcauuaugaccaagaucaccccuacaagacaugggccuaucauggcuccuacgaaaccaagcagacggggagcgcuucuuccauggucaauggaguggugagacugcugacaaaaccgugggacgucauuccuaugguuacccagauggccaugaccgacacaacgcccuucggccagcaacgcguguuuaaggagaaaguggauaccagaacacaggagccuaaggaagggaccaaaaagcucaugaagaucacagcugaguggcuguggaaagaacuuggacggaagaaaacaccccgcauguguacaagagaggaguucacccggaaggucagaagcaacgccgcucugggcgccauuuuuacggacgaaaauaaauggaagucugcgcgggaggccguggaagauuccggguucugggagcucguugacaaagaacgcaaccugcaccuggagggaaagugcgagaccuguguguauaauaugaugggcaagagagagaaaaagcucggcgaauuugggaaagcuaagggaagccgggccaucugguacauguggcugggcgcucgcuuccuugaauuugaggcccugggguuccucaacgaagaucacugguuuucuagagaaaauucccugagcggagucgagggcgaagggcuucauaaacugggcuacauucuccgggacguguccaagaaggagggaggcgccauguaugcggaugacacagcugggugggauacccgcaucacacuggaagaccugaaaaacgaggaaaugguuaccaaucacauggagggagagcauaagaaacucgccgaagccaucuucaagcugacguaccagaacaaaguggucagagugcagcggccuacaccccgcggcaccguuauggauauuaucagcagacgggaccaacgcgggucuggacagguggucacauauggccuuaacaccuucacgaauauggaggcucagcugauuagacaaauggaaggggagggcguguuuaagagcauccagcagcucaccgucacagaggaaauugccgugaagaacuggcuggcucggguuggacgcgagagacuuucccggauggccaucucuggcgacgauugcguggucaaaccgcuggacgauagauucgcgagcgcccucaccgcucugaaugacauggggaaggugcgcaaagauauccagcaaugggaaccuucccggggauggaacgacuggacacaggugcccuuuugcucucaccauuuccacgagcugauuaugaaggauggcagaguucucgugguccccugucgcaaucaggacgaacugaucgggcgggccagaauuagccagggagcuggcuggucccuucgcgagaccgccugccuggggaaaucuuacgcgcaaauguggagccucauguauuuucaccggagagaucugcgccuugccgcuaacgccaucuguuccgcugugccuagccauuggguuccgacaucucggaccacgugguccauucacgccacacaugaguggaugaccaccgaagacaugcugacaguguggaauagagucuggauccaggagaaccccuggauggaagauaagaccccuguggagagcugggaagagauccccuaccucggcaagcgcgaggaccaguggugcggaucucugauuggccugacaucccgggcuacgugggccaaaaauauccagaccgcgauuaaccaagucagaagccucaucgggaaugaagaguauacagauuacaugccuuccaugaagcgguucagacgcgaagaggaagaggccggagugcugugguga

SEQ ID NO: 20273 - RNA, 9876 nt, Artificial Sequence
  derived and/or modified CDS sequence (opt5) from DENV-2__GQ398258__SS-prME
accgccggaaugaucauuaugcugauccccaccgugauggcuuuccaccucacgaccagaaauggggaaccucauaugauugucagccggcaggaaaagggaaaaucccugcuuuuuaagaccgaagacggcguuaauaugugcacccugauggccauggaucucggggaacugugugaagacacgaucaccuacaacugcccccuucugcgccaaaaugaacccgaagauauugacuguuggugcaacucuacaagcaccugggugacguauggaaccuguacagcgaccggcgagcacagacgggaaaaacgcuccguggcucucgucccucauguggggaugggacuggagacaagaaccgaaacguggaugucuagcgagggcgccuggaagcacgcccagcggaucgagacauggauccugcgccaucccggcuucaccauuauggcugccauccucgcuuacacaauugggaccaccuauuuucagagaguucugaucuucauucuucugacagccguggcgccuuccaugacgaugcggugcaucggaauuucuaaucgcgauuuugucgaaggcgugagcgggggauccuggguugacaucgugcucgagcacggcagcugugucaccacaauggccaaaaacaagcccacccuggauuucgaacuuaucaagacagaggcuaaacagccugccacccugagaaaguacugcauugaagcuaaacucacgaauacaaccaccgccucucgguguccgacacaaggggagcccucccugaacgaggaacaggacaagcgcuuugugugcaaacacagcaugguggauagaggauggggcaauggcugugggcuguucggaaagggcgggaucgugaccugcgcgauguuuacaugcaagaaaaacauggagggaaagguugugcagccugaaaaucucgaguauacgauugugaucacaccccauucuggcgaagagaacgccgucgggaaugacacaggaaaacacggcaaggagauuaaaaucaccccucaguccagcaucacagaagcugagcugaccggcuacgggacggugaccauggaauguucuccccggacaggacuugauuucaacgagaugguucugcuccaaauggaaaauaaggccuggcuggugcaucgccagugguuucuugaccugccgcucccuuggcugcccggcgcugauacccagggguccaacuggauucagaaagagacacuggucaccuucaagaacccucacgccaagaaacaagacgugguugugcucggaagccaggagggcgccaugcacacggcucugacaggggcgaccgaaauccagauguccucuggcaaucuucuguuuacaggacaucucaagugcagacugcggauggacaaacuucaacugaagggcaugagcuauuccauguguaccgggaaauucaaggucgugaaggagauugccgaaacccagcacggaacaaucgucauuagagugcaguacgagggcgaugggagccccugcaaaauccccuucgagaucauggaccucgaaaagcgccauguucugggacggcugauuacggugaacccuaucgucaccgagaaagauucuccggugaauauugaagcugagcccccuuuuggcgacuccuacaucauuaucgggguugaacccggccagcucaagcugaacugguucaaaaagggaagcucuauuggccaaauguuugagacaaccaugagaggggccaagcgcauggccauccuuggagauacagcuugggacuucggcagccucggcgggguguuuaccuccaucgggaaagcccuccaccaggucuucggggcgauuuauggcgcugccuuuucuggagugagcuggacgaugaagauccugauuggcgugguuaucacauggauugggaugaacucccggagcaccucucuguccgucagccuugugcucgugggagucgugacccuguaccugggcguuauggugcaggccgauucugggugugucguguccuggaaaaacaaggagcucaaaugcggaagcggcaucuucaucacagacaauguucauaccuggacagaacaguauaaguuucaaccugagucccccucuaagcuggcuagcgccauucagaaagcucacgaagaggggaucuguggcauuagauccgugacgcgccuugaaaaccugauguggaagcagaucaccccggagcucaaucacauucugucugagaacgaagucaaacugacaaucaugaccggagauaucaagggcauuaugcaggccgggaaacggagccuuagaccucaacccacagagcucaaguacuccuggaaaaccuggggaaaggcgaagaugcugagcacggaacugcauaaucagaccuuccucaucgacggcccugagacagccgaaugccccaacaccaaucgcgcuuggaacucucuggagguggaggauuauggguuuggaguuuucacaaccaauauuuggcuuaaacugaaggaacggcaggacguguuuugugacccuaaacucauguccgccgcuaucaaggauaacagagccguccacgcggacaugggcuacuggauugagagcgcccugaacgauacauggaaaaucgaaaaggcuucuuucaucgaggugaaguccugccauuggcccaaaagccacacccuguggucuaauggcgugcuugagagcgaaaugauuaucccgaagaacuucgccgggccugucucccagcacaauuaucgccccggauaccauacgcaaacagcuggccccuggcaccucgggaaacuggagauggacuuugauuucugugaaggaaccaccguuguggugacagaggacugcggcaaccgggggccuagccugagaaccacgacagccucuggaaagcucauuaccgaauggugcugucgguccugcacacugccgccccuucgcuacaaaggcgaggauggcuguugguaugggauggagaucagaccucugaaggaaaaggaggaaaaucucgucaacagccuggugaccgccggacauggccagauugacaauuuuucccuggggguucuuggaauggcucucuuccuggaggaaaugcugcggacaagagugggcaccaaacacgcgauccuccuggucgccgugucuuuuguuacgcuuauuaccgggaacaugagcuuccgcgaucugggacgggugauggucauggugggcgcuacaaugaccgacgauaucggcauggggguuacauaccucgcccugcuggccgcuuuuaaggugagacccaccuucgccgcgggacuucugcuccgcaaacugacguccaaggagcucaugaugacaaccaucggcauuguccugcuuucucagagcacaaucccugagaccauucuggaacucaccgacgcucuggcccuggggaugauggugcuuaaaaucgugaagaauauggagaaguaucaacuggccgucacaauuauggcuauccucugcguucccaacgccgugauccugcagaaugcguggaaaguguccuguacgauucucgcugucgugucuguuagcccucugcuucugaccuccagccagcagaaggccgauuggaucccccucgcccugacaauuaaaggacugaacccgaccgcuaucuuucuuacaacccugucuagaacguccaagaaacggagcuggccucucaaugaagccauuauggcugugggcauggucucuauccuggccuccagccuccugaagaacgacauccccaugacagggccucuuguggcgggaggccugcugaccguuugcuacgugcucaccggccgcucugccgaccuggagcuugaaagagcugccgauguccggugggaggaccaagcugagauuuccgggagcucccccauccugagcauuacaaucucugaagauggaagcauguccauuaaaaaugaggaagaggagcagacccucacaauccugauucgcacgggccuccuggugaucucugggcuuuucccggucagcaucccuauuaccgccgccgcuugguaucugugggaagugaagaagcagagagcgggaguucugugggacgugcccuccccuccgcccgucggcaaagccgagcucgaagauggggcuuaccggaucaagcagaaaggcauucugggcuauucucaaaucggcgccgggguguacaaggagggaacauuucauaccauguggcacguuacacgcggcgccgugcuuaugcacaaagggaagagaauugaaccuagcugggcugacgucaagaaagaucugaucuccuacggaggcggguggaagcucgagggagaguggaaagaaggcgaggaaguccaggugcuggcccucgagccgggcaagaacccccgggcgguucagaccaaaccugggcuguucaagacgaacaccggaacaaucggcgcugucucucuugacuuuagccccgggaccuccggaagcccuauuguggauaagaaaggcaagguggucgggcuguauggaaauggcgugguuacacgcucuggcaccuacguguccgccaucgcccagacagaaaagagcauugaggacaaccccgagaucgaggaugacauuuucagaaagaaacggcugacgaucauggaucuccauccuggggcuggaaagaccaagagauaucugccggccaucguccgcgaggcgauuaaacggggccuuagaacacugauccucgcucccacccgcgugguugccgccgaaauggaggaagcucugcgggggcucccuauuagauaccaaacccccgccauccgcgcugagcacacaggacgggagauuguggaccugaugugucaugccacguucaccaugagacuucugucuccuguccgcgugcccaauuauaaccugaucauuauggacgaagcgcacuuuacagauccggccuccaucgcugcccggggcuacaucagcaccagaguugagaugggggaagcugccggcauuuucaugacagccaccccucccggaucccgggaccccuuuccucagucuaaugcucccaucauggaugaggagcgcgaaauuccugagagaagcuggaacuccggccaugaaugggugacggacuucaaggggaaaacagucugguuugugccgagcaucaaggcgggaaaugauauugccgcuugccuccggaaaaacggcaagaaggugauccagcugucucgcaaaaccuucgacuccgaguauaucaagaccagaacaaaugauugggacuuugucguuaccacagauauuagcgaaaugggggccaacuucaaagccgagcgggugaucgaccccagacgcuguaugaagccugugauucuuaccgauggagaggaacgggucauccuggcuggccccaugccugugacgcacucuagcgccgcgcaaagacgcgggcggauuggcagaaaucccaaaaacgagaaugaccaguacaucuacaugggagaaccgcucgagaacgacgaagauugcgcucacuggaaggaggccaaaaugcugcuggacaauaucaacacaccugagggcauuauccccuccauguuugaaccugagcgcgaaaagguugaugccauugacggggaguaucggcucagaggagaagcucgcaagaccuucguggaucuuaugagacggggcgaccugcccgucuggcuggccuaccgcguggcggccgaggggaucaacuaugcugauagacggugguguuuugacggaauuaaaaauaaccagauccucgaggaaaauguugagguggaaauuuggacaaaggagggcgagcgcaaaaagcugaaaccuagauggcuugaugcccggaucuacucugacccccuggcucucaaggaguucaaggaguucgccgcugggagaaaaagccugacccugaaccucaucacggaaaugggccgccuuccgaccuuuaugacacagaaggcccggaaugcgcuggauaaccuggccguccuccauaccgcugaggccggaggcagagcuuauaaucacgcccuguccgaacuuccugagacacuggagacccuccugcugcucacacuucuggccaccgugacagggggaauuuuccuguuucucaugucuggcaaagggaucggaaagaugacacugggcaugugcugcauuaucaccgcuagcauucuucugugguacgcgcaaauccagccccauuggaucgccgcuuccauuauccucgaguucuuucugauuguccugcucauccccgagccugaaaaacagcgcaccccgcaggacaaccaacuuacauaugugguuauugccauccugaccgugguggccgcuacaauggccaaugagaugggcuuccuggaaaagacgaagaaagauuuugggcucggaagcaucgcgacccaccagcccgagucuaacauucuggacaucgaccuucggccugccuccgcuuggacacuguacgccgucgcuaccacauucauuacccccaugcucagacacagcaucgaaaauuccucuguuaacgugagccugacggccauugcgaaucaggccaccgugcugaugggccucgggaagggauggccucuuuccaaaauggauaucggcgucccccugcuggcuauuggguguuacucucaggugaacccuaucacacucaccgccgcucugcuucugcucguugcccauuaugcuaucauuggaccgggccugcaagccaaggcgacacgggaagcccagaaacgcgcugccgcuggcaucaugaagaaucccaccguggacgggauuacggucaucgaucuggacccuauucccuacgauccuaaguuugagaaacagcucggacaggugaugcuucugguccugugcgugacacaaguucucaugaugagaaccacaugggcccugugugaagcccuuacccuggcgaccggccccaucagcacacucugggaggggaacccgggacgguucuggaauacgaccaucgcuguguccauggccaacauuuuucgcggcagcuaucuggcuggggccggacugcuguucucuaucaugaagaacacagccaauaccagacggggcacaggcaacaccggggaaacgcuuggagagaaauggaagaaucgccugaacgcucugggcaaauccgaguuucagauuuacaagaaaagcgggauccaggaagucgacagaacacucgccaaggagggaauuaagcggggcgaaaccgaucaccaugcggugucucgcggguccgccaaacugagaugguucguugagcggaaucuugugaccccugagggaaaggucguggaccugggcugcggcagagggggauggagcuauuacuguggcgggcucaaaaacgugcgcgaaguuaagggacugacaaaaggcgggcccggacacgaggaacccaucccuaugucuaccuauggcuggaaucugguccggcuccaaagcggcguggauguguucuuuacacccccugagaagugcgacacgcuucugugugauaucggggaauccucuccgaaccccaccgucgaggcuggaagaacacugcgcguucucaaucugguggagaacuggcuuaauaacaauacccaguucugcauuaaggugcugaacccuuacaugcccagcgucaucgagaagauggaggcccuccagcggaaguacggcggggcucuggugagaaauccucugucccgcaacagcacacaugaaauguauuggguuuccaacgccucuggaaauauugugagcuccgucaacaugaucucucggaugcucauuaauagauuuaccaugcgccacaaaaaggcgacguacgagcccgacguggaucuuggcagcgggacccggaacaucggaaucgaauccgagacaccgaaucuggacauuaucggcaaaagaauugagaagaucaagcaggaacacgagaccucuuggcauuaugaccaagaucacccuuacaaaacaugggccuaucauggcagcuacgaaaccaagcagacaggguccgcuagcucuaugguuaacggagugguccgccugcucaccaaacccugggacgugauuccuauggugacgcagauggccaugacagauaccacccccuucggccagcaacgggucuuuaaggagaaaguugacacaagaacgcaggaaccuaaggaggggaccaagaaacugaugaagaucacagcugaguggcuuuggaaagaacugggaaagaaaaagacaccccgcauguguacaagagaggaguucacccggaaagugcgcuccaaugccgcucucggcgccauuuuuacagaugagaacaaguggaaaagcgcgagagaggccguggaagacucucgguucugggagcuggucgauaaagaaagaaaucugcaccucgaggggaagugcgaaaccuguguguauaacaugaugggaaaacgggagaagaaacugggcgaguuuggcaaggcuaaggggucccgcgccaucugguacauguggcuuggagcuagauuccuggaauuugaggcccucggcuuccugaaugaagaccacugguuuagccgggagaacucucuuuccgggguugaaggagagggccugcauaaacucggguacauccugcgcgaugugagcaagaaagagggcggagccauguaugcggacgauacggcuggcugggacaccagaauuacacuggaagaccucaagaaugaggaaauggucaccaaccacauggagggggaacauaaaaagcuggccgaggccaucuucaaacuuacauaccagaauaaagugguucgggugcagcgcccgaccccuagaggaacggucauggauauuaucucccggcgcgaccaaagaggcagcggacaggugggaacauauggccugaacaccuucacaaacauggaggcucagcucauucggcaaauggaaggggagggcguuuuuaagucuauccagcaccugaccgugacggaagagaucgccguccagaauuggcuugcucgcgugggaagagagcggcugagccgcauggccauuuccggcgaugacugcgucgugaaaccccucgaugacagauucgcgucugcccugaccgcucugaacgauauggggaagguucggaaagacauccagcaaugggaacccagcagaggauggaaugauuggacacaggugccuuuuugcucccaucacuuccacgagcucauuaugaaggacggccgcguccugguggugccgugucggaaccaggaugaacuuaucgggagagcccgcauuucucagggagcuggcuggagccugcgggagaccgccugccucgggaaguccuacgcgcaaauguggucucugauguauuuucauagacgcgaccuucggcuggccgcuaaugccaucuguagcgcuguucccucccacugggugccuacaagcagaaccacauggucuauccaugcccgccacgaauggaugaccacggaggauaugcucacagucuggaaccggguguggguucaggagaaucccuggauggaagacaaaaccccuguggaguccugggaagagauucccuaccugggcaagagagaagaccaguggugcggaagccugaucggccucaccucucgcgcuacaugggccaaaaacauucagaccgcgaucaaucaaguccggucccugauugggaacgaggaguauacagauuacaugccuagcaugaagagauuccggagagaagaggaagaggccggagugcuuugguga

SEQ ID NO: 20274 - RNA, 9876 nt, Artificial Sequence
  derived and/or modified CDS sequence (opt5) from DENV-2__GQ398259__SS-prME
accgccggaaugaucauuaugcugauccccaccgugauggcuuuccaccucacgaccagaaauggggaaccucauaugauugugagccggcaggaaaagggaaaaucccugcuuuuuaagacggaagacggcguuaauaugugcacccugauggccauggaucucggggaacugugugaagacacaaucaccuacaacugcccgcuucugcgccaaaaugaacccgaggauauugacuguuggugcaacucuacaagcaccugggugacguauggaaccuguacagcgaccggcgagcacagacgggaaaaacgcuccguggcucucgucccucauguggggaugggacuggagacaagaaccgaaacguggaugucuagcgagggcgccuggaagcacgcccagcggaucgagacauggauccugcgccaucccggcuucaccauuauggcugccauccucgcuuacacaauugggaccaccuauuuucagagaguucugaucuucauucuucugacagccguggcgccuuccaugacgaugcggugcaucggaauuucuaaucgcgauuuugucgaaggcgugagcgggggauccuggguugacaucgugcucgagcacggcagcugugucaccacaauggccaaaaacaagcccacccuggauuucgaacuuaucaagacagaggcuaaacagccugccacccugagaaaguacugcauugaagcuaaacucacgaauacaaccaccgccucucgguguccgacacaaggggagcccucccugaacgaggaacaggacaagcgcuuugugugcaaacacagcaugguggauagaggauggggcaauggcugugggcuguucggaaagggcgggaucgugaccugcgcgauguuuacaugcaagaaaaacauggagggaaagguugugcagccugaaaaucucgaguauacgauugugaucacaccccauucuggcgaagagaacgccgucgggaaugacacaggaaaacacggcaaggagauuaaaaucaccccucaguccagcaucacagaagcugagcugaccggcuacgggacggugaccauggaauguucuccccggacaggacuugauuucaacgagaugguucugcuccaaauggaaaauaaggccuggcuggugcaucgccagugguuucuugaccugccgcucccuuggcugcccggcgcugauacccagggguccaacuggauucagaaagagacacuggucaccuucaagaacccucacgccaagaaacaagacgugguugugcucggaagccaggagggcgccaugcacacggcucugacaggggcgaccgaaauccagauguccucuggcaaucuucuguuuacaggacaucucaagugcagacugcggauggacaaacuucaacugaagggcaugagcuauuccauguguaccgggaaauucaaggucgugaaggagauugccgaaacccagcacggaacaaucgucauuagagugcaguacgagggcgaugggagccccugcaaaauccccuucgagaucauggaccucgaaaagcgccauguucugggacggcugauuacggugaacccuaucgucaccgagaaagauucuccggugaauauugaagcugagcccccuuuuggcgacuccuacaucauuaucgggguugaacccggccagcucaagcugaacugguucaaaaagggaagcucuauuggccaaauguuugagacaaccaugagaggggccaagcgcauggccauccuuggagauacagcuugggacuucggcagccucggcgggguguuuaccuccaucgggaaagcccuccaccaggucuucggggcgauuuauggcgcugccuuuucuggagugagcuggacgaugaagauccugauuggcgugguuaucacauggauugggaugaacucccggagcaccucucuguccgucagccuugugcucgugggagucgugacccuguaccugggcguuauggugcaggccgauucugggugugucguguccuggaaaaacaaggagcucaaaugcggaagcggcaucuucaucacagacaauguucauaccuggacagaacaguauaaguuucaaccugagucccccucuaagcuggcuagcgccauucagaaagcucacgaagaggggaucuguggcauuagauccgugacgcgccuugaaaaccugauguggaagcagaucaccccggagcucaaucacauucugucugagaacgaagucaaacugacaaucaugaccggagauaucaagggcauuaugcaggccgggaaacggagccuuagaccucaacccacagagcucaaguacuccuggaaaaccuggggaaaggcgaagaugcugagcacggaacugcauaaucagaccuuccucaucgacggcccugagacagccgaaugccccaacaccaaucgcgcuuggaacucucuggagguggaggauuauggguuuggaguuuucacaaccaauauuuggcuuaaacugaaggaacggcaggacguguuuugugacuccaaacucaugagcgccgcuaucaaggauaacagagccguccacgcggacaugggcuacuggauugagucugcccugaacgauacauggaaaaucgaaaaggcuuccuucaucgaggucaaguccugccauuggccuaaaucucacacccuguggagcaauggcgugcuugaguccgaaaugauuauccccaagaacuucgccgggccggucagccagcacaauuaucgcccuggauaccauacgcaaacagcuggccccuggcaccucgggaaacuggagauggacuuugauuucugugaaggaaccaccguuguggugacagaggacugcggcaaccgggggcccucucugagaaccacgacagccuccggaaagcucauuaccgaauggugcugucggagcugcacacugccuccgcuucgcuacaaaggcgaggauggcuguugguaugggauggagaucagaccccugaaggaaaaggaggaaaaucucgucaacucccuggugaccgccggacauggccagauugacaauuuuucucuggggguucuuggaauggcucucuuccuggaggaaaugcugcggacaagagugggcaccaaacacgcgauccuccuggucgccgugagcuuuguuacgcuuauuaccgggaacauguccuuccgcgaucugggacgggugauggucauggugggcgcuacaaugaccgacgauaucggcauggggguuacauaccucgcccugcuggccgcuuuuaaggugagaccuaccuucgccgcgggacuucugcuccgcaaacugacgucuaaggagcucaugaugacaaccaucggcauuguccugcuuagccaguccacaauccccgagaccauucuggaacucaccgacgcucuggcccuggggaugauggugcuuaaaaucgugaagaauauggagaaguaucaacuggccgucacaauuauggcuauccucugcguuccuaacgccgugauccugcagaaugcguggaaagugucuuguacgauucucgcugucgugagcguuagcccccugcuucugaccagcucucagcagaaggccgauuggaucccucucgcccugacaauuaaaggacugaaccccaccgcuaucuuucuuacaacccuguccagaacgagcaagaaacggucuuggccgcucaaugaagccauuauggcugugggcauggucuccauccuggccagcucucuccugaagaacgacaucccuaugacagggccccuuguggcgggaggccugcugaccguuugcuacgugcucaccggccgcuccgccgaccuggagcuugaaagagcugccgauguccggugggaggaccaagcugagauuagcggguccagcccuauccugucuauuacaaucagcgaagauggauccaugucuauuaaaaaugaggaagaggagcagacccucacaauccugauucgcacgggccuccuggugaucagcgggcuuuuccccgucuccaucccgauuaccgccgccgcuugguaucugugggaagugaagaagcagagagcgggaguucugugggacgugccuucucccccucccgucggcaaagccgagcucgaagauggggcuuaccggaucaagcagaaaggcauucugggcuauagccaaaucggcgccgggguguacaaggagggaacauuucauaccauguggcacguuacacgcggcgccgugcuuaugcacaaagggaagagaauugaacccuccugggcugacgucaagaaagaucugaucucuuacggaggcggguggaagcucgagggagaguggaaagaaggcgaggaaguccaggugcuggcccucgagccuggcaagaacccgcgggcgguucagaccaaacccgggcuguucaagacgaacaccggaacaaucggcgcugucagccuugacuuuuccccugggaccagcggaucucccauuguggauaagaaaggcaagguggucgggcuguauggaaauggcgugguuacacgcuccggcaccuacgugagcgccaucgcccagacagaaaaaucuauugaggacaacccugagaucgaagaugacauuuucagaaagaaacggcugacgaucauggaucuccaucccggggcuggaaagaccaagagauaucugccugccaucguccgcgaggcgauuaaacggggccuuagaacacugauccucgcuccgacccgcgugguugccgccgaaauggaggaagcucugcgggggcuccccauuagauaccaaaccccugccauccgcgcugagcacacaggacgggagauuguggaccugaugugucaugccacguucaccaugagacuucugucccccguccgcgugccuaauuauaaccugaucauuauggacgaagcgcacuuuacagaucccgccagcaucgcugcccggggcuacaucuccaccagaguugagaugggggaagcugccggcauuuucaugacagccaccccgccuggaucucgggaccccuuuccccagagcaaugcuccuaucauggaugaggagcgcgaaauucccgagagauccuggaacagcggccaugaaugggugacggacuucaaggggaaaacagucugguuugugccuucuaucaaggcgggaaaugauauugccgcuugccuccggaaaaacggcaagaaggugauccagcugucccgcaaaaccuucgacagcgaguauaucaagaccagaacaaaugauugggacuuugucguuaccacagauauuucugaaaugggggccaacuucaaagccgagcgggugaucgacccgagacgcuguaugaagcccgugauucuuaccgauggagaggaacgggucauccuggcuggcccuaugcccgugacgcacagcuccgccgcgcaaagacgcgggcggauuggcagaaauccuaaaaacgagaaugaccaguacaucuacaugggagaaccccucgagaacgacgaagauugcgcucacuggaaggaggccaaaaugcugcuggacaauaucaacacaccggagggcauuaucccuucuauguuugaacccgagcgcgaaaagguugaugccauugacggggaguaucggcucagaggagaagcucgcaagaccuucguggaucuuaugagacggggcgaccugccugucuggcuggccuaccgcguggcggccgaggggaucaacuaugcugauagacggugguguuuugacggaauuaaaaauaaccagauccucgaggaaaauguugagguggaaauuuggacaaaggagggcgagcgcaaaaagcugaaacccagauggcuugaugcccggaucuacagcgacccucuggcucucaaggaguucaaggaguucgccgcugggagaaaaucccugacccugaaccucaucacggaaaugggccgccuucccaccuuuaugacacagaaggcccggaaugcgcuggauaaccuggccguccuccauaccgcugaggccggaggcagagcuuauaaucacgcccugucugaacuuccggagacacuggagacccuccugcugcucacacuucuggccaccgugacagggggaauuuuccuguuucucaugagcggcaaagggaucggaaagaugacacugggcaugugcugcauuaucaccgcuuccauucuucugugguacgcgcaaauccagccucauuggaucgccgcuagcauuauccucgaguucuuucugauuguccugcucauccccgagcccgaaaaacagcgcaccccucaggacaaccaacuuacauaugugguuauugccauccugaccgugguggccgcuacaauggccaaugagaugggcuuccuggaaaagacgaagaaagauuuugggcucggaucuaucgcgacccaccagccggaguccaacauucuggacaucgaccuucggcccgccagcgcuuggacacuguacgccgucgcuaccacauucauuaccccuaugcucagacacuccaucgaaaauucuagcguuaacgugucccugacggccauugcgaaucaggccaccgugcugaugggccucgggaagggauggccccuuucuaaaauggauaucggcgucccucugcuggcuauuggguguuacagccaggugaaccccaucacacucaccgccgcucugcuucugcucguugcccauuaugcuaucauuggaccuggccugcaagccaaggcgacacgggaagcccagaaacgcgcugccgcuggcaucaugaagaauccgaccguggacgggauuacggucaucgaucuggaccccauuccuuacgaucccaaguuugagaaacagcucggacaggugaugcuucugguccugugcgugacacaaguucucaugaugagaaccacaugggcccugugugaagcccuuacccuggcgaccggcccuaucuccacacucugggaggggaaccccggacgguucuggaauacgaccaucgcugugagcauggccaacauuuuucgcggcucuuaucuggcuggggccggacugcuguucuccaucaugaagaacacagccaauaccagacggggcacaggcaacaccggggaaacgcuuggagagaaauggaagaaucgccugaacgcucugggcaaaagcgaguuucagauuuacaagaaaucugggauccaggaagucgacagaacacucgccaaggagggaauuaagcggggcgaaaccgaucaccaugcggugucccgcgggagcgccaaacugagaugguucguugagcggaaucuugugaccccggagggaaaggucguggaccugggcugcggcagagggggauggucuuauuacuguggcgggcucaaaaacgugcgcgaaguuaagggacugacaaaaggcgggccuggacacgaggaacccauccccaugagcaccuauggcuggaaucugguccggcuccaauccggcguggauguguucuuuacaccucccgagaagugcgacacgcuucugugugauaucggggaaucuagcccuaacccgaccgucgaggcuggaagaacacugcgcguucucaaucugguggagaacuggcuuaauaacaauacccaguucugcauuaaggugcugaaccccuacaugccuuccgucaucgagaagauggaggcccuccagcggaaguacggcggggcucuggugagaaauccccugagccgcaacuccacacaugaaauguauuggguuucuaacgccagcggaaauauuguguccucugucaacaugaucagccggaugcucauuaauagauuuaccaugcgccacaaaaaggcgacguacgagccugacguggaucuuggcuccgggacccggaacaucggaaucgaaucugagacacccaaucuggacauuaucggcaaaagaauugagaagaucaagcaggaacacgagaccagcuggcauuaugaccaagaucacccguacaaaacaugggccuaucauggcuccuacgaaaccaagcagacagggagcgcuucuuccaugguuaacggagugguccgccugcucaccaaaccuugggacgugauucccauggugacgcagauggccaugacagauaccaccccuuucggccagcaacgggucuuuaaggagaaaguugacacaagaacgcaggaacccaaggaggggaccaagaaacugaugaagaucacagcugaguggcuuuggaaagaacugggaaagaaaaagaccccucgcauguguacaagagaggaguucacccggaaagugcgcagcaaugccgcucucggcgccauuuuuacagaugagaacaaguggaagucugcgagagaggccguggaagacucccgguucugggagcuggucgauaaagaaagaaaucugcaccucgaggggaagugcgaaaccuguguguauaacaugaugggaaaacgggagaagaaacugggcgaguuuggcaaggcuaaggggagccgcgccaucugguacauguggcuuggagcuagauuccuggaauuugaggcccucggcuuccugaaugaagaccacugguuuucucgggagaacucccuuagcgggguugaaggagagggccugcauaaacucggguacauccugcgcgauguguccaagaaagagggcggagccauguaugcggacgauacggcuggcugggacaccagaauuacacuggaagaccucaagaaugaggaaauggucaccaaccacauggagggggaacauaaaaagcuggccgaggccaucuucaaacuuacauaccagaauaaagugguucgggugcagcgccccaccccgagaggaacggucauggauauuaucagccggcgcgaccaaagaggcucuggacaggugggaacauauggccugaacaccuucacaaacauggaggcucagcucauucggcaaauggaaggggagggcguuuuuaagagcauccagcaccugaccgugacggaagagaucgccguccagaauuggcuugcucgcgugggaagagagcggcugucccgcauggccauuucuggcgaugacugcgucgugaaaccucucgaugacagauucgcgagcgcccugaccgcucugaacgauauggggaagguucggaaagacauccagcaaugggaacccuccagaggauggaaugauuggacacaggugcccuuuugcucucaucacuuccacgagcucauuaugaaggacggccgcguccugguggugccuugucggaaccaggaugaacuuaucgggagagcccgcauuagccagggagcuggcuggucccugcgggagaccgccugccucgggaagucuuacgcgcaaauguggagccugauguauuuucauagacgcgaccuucggcuggccgcuaaugccaucuguuccgcuguuccgagccacugggugcccacaucuagaaccacaugguccauccaugcccgccacgaauggaugaccacggaggauaugcucacagucuggaaccggguguggguucaggagaauccuuggauggaagacaaaacccccguggagagcugggaagagauuccuuaccugggcaagagagaagaccaguggugcggaucucugaucggccucaccucccgcgcuacaugggccaaaaacauucagaccgcgaucaaucaaguccggagccugauugggaacgaggaguauacagauuacaugcccuccaugaagagauuccggagagaagaggaagaggccggagugcuuugguga

SEQ ID NO: 20275 - RNA, 9876 nt, Artificial Sequence
  derived and/or modified CDS sequence (opt5) from DENV-2__GQ398268__SS-prME
accgccggcaugaucauuaugcugauccccacagugauggcuuuccaccucacgaccagaaauggggaaccucauaugauugucagccggcaggaaaagggaaagucccugcuuuuuaagacagaggacggcguuaauaugugcacccugauggccauggaucucggggaacugugugaggacacaaucaccuacaagugcccgcuucugcgccaaaacgaacccgaggauauugacuguuggugcaauucuacaagcaccugggugacguauggaaccuguacaaccacaggcgagcaccggcgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacaauuauggccgcuauccucgccuacaccauugggaccacacacuuucagagagcucugaucuucauucuucugacggccguugcgccuuccaugaccaugcggugcaucggaauuucuaaccgcgauuuuguggaaggcgucagcgggggauccuggguggacaucguucucgagcacggcagcugugugacaaccauggccaagaauaagcccacacuggauuucgaacuuaucaaaaccgaggcuaagcagccugccacgcugagaaaauauugcauugaagcuaagcucacaaacaccaccacagagucucgguguccgacccaaggggagcccucccugaaugaagaacaggacaaacgcuuugucugcaagcauagcaugguggauagaggauggggcaacggcugugggcuguucggaaagggcgggaucgugacaugcgccauguuuacgugcaaaaagaauauggaaggaaaagucguucagccugagaaccucgaauacaccauugugaucacaccccacucuggcgaggagcaugcgguggggaaugacaccggaaagcacggcaaagaaauuaagaucacaccucaguccagcaucaccgaggccgaacugacgggcuaugggaccgucacaauggaguguucuccccggaccggacuugauuucaacgaaauggugcugcuccaaauggagaauaaggcuuggcugguucaccgccagugguuucuugaccugccgcucccuuggcugcccggcgccgauacacagggguccaacuggauucagaaggagacccuggugacguucaagaauccucaugcuaaaaagcaagacgucgugguucucggaagccaggaaggcgccaugcacacagcccugaccggggcuacagagauccagauguccucuggcaaccuucuguuuaccggacaucucaaaugcagacugcggauggacaaacuucaacugaaaggcaugagcuacuccauguguaccgggaaguucaagguggucaaagaaauugcggagacacagcacggaacgaucgugauuagaguccaguaugagggcgaugggagccccugcaagauccccuucgaaaucauggaccucgagaaacgccaugugcugggacggcugauuaccguuaacccuaucgugacagaaaaggauucuccggucaauauugaggccgaacccccuuuuggcgacuccuacaucauuaucgggguggagcccggccagcucaaacugaacugguucaagaagggaagcucuauuggccaaauguuugagaccacaaugagaggggcuaaacgcauggccauccuuggagauaccgccugggacuucggcagccucggagggguuuuuacguccaucggcaaggcucuccaccagguguucggggccauuuacggcgcggcuuuuucuggagucagcuggacaaugaaaauccugauuggcgugaucauuaccuggaucgggaugaacucccggagcaccucucuguccgugagccuuguucucgucggaguggugacacuguaucugggcgucauggugcaggccgauucuggguguguuguguccuggaagaacaaagaacucaagugcggaagcggcaucuucauuaccgacaauguccacacauggacggagcaguacaaguuucaaccugaaucccccucuaaacuggccagcgcuauccagaaggcccaugaggaagggauuuguggcaucagauccgugacccgccuugagaaccugauguggaaacagauuacaccggagcucaaucacauccugucugaaaacgagguuaagcugaccaucaugacaggagauauuaaaggcaucaugcaggcugggaagcggagccuuagaccucaacccaccgaacucaaauauuccuggaagacguggggaaaggccaaaaugcugagcaccgagucucauaaucagacauuccugauugacggcccugaaaccgcggagugccccaacacaaaucgcgccuggaacucccucgagguggaagauuacggguuuggagucuucaccacaaauaucuggcugaaacuucgggagaaacaggacguguuuugugacagcaagcugaugucugcugccauuaaagauaacagagcuguucacgccgacaugggcuauuggaucgaauccgcgcucaaugauaccuggaagaucgagaaggccagcuucauugaggugaaaucuugccacuggccuaagagccauacgcugugguccaacggcguccuggaaagcgagaugaucauucccaaaaacuucgcugggccggugucucagcacaauuaccgcccuggauaucauacacaaaccgccggccccuggcaccuugggaagcucgaaauggacuuugauuucugugagggaaccacaguggucguuaccgaagacugcggcaaccgggggcccucccugagaacgacaaccgcuagcggaaaacugaucacagaguggugcugucgguccugcacccucccuccgcugcgcuacagaggcgaggauggcuguugguacgggauggaaauucggccccuuaaggagaaggaagagaaucuggugaacucucucgugacagccggacauggccagaucgacaauuuuagccuggggguccugggaauggcccuuuuccucgaagagaugcugagaacccgcgugggcacgaaacacgcuauucugcucguugcgguguccuuugucacccugaucacagggaacaugucuuuccgggaucuuggaagagugaugguuauggugggcgccaccaugacagacgauaucggcaugggggucaccuaucuggcucuccuggccgccuuuaaggugcgcccuacguucgcugccggacugcuucugagaaaacucacaagcaaggagcugaugaugaccacaauuggcaucguucuccugucccagucuaccauucccgaaaccauccuugagcugacagacgcgcucgcucuggggaugauggugcugaaaaugguccggaagauggaaaaguaccaacuugccgugacgauuauggccauccugugcgugccuaaugcugucauccuccagaacgccuggaaaguuagcuguaccauucuggcggugguguccgucagcccccuccugcuuacaucuucccagcagaaggcugauuggaucccucuggcccucaccauuaaaggacugaaucccacagccaucuuucugaccacgcuuagccgcacaaacaagaaaagaucuuggccgcugaaugaggcuauuauggccgugggcaugguuuccauccucgcuagcucucugcucaagaacgacaucccuaugaccgggccccugguggccggaggccuucugaccgucugcuaugugcugacaggccgguccgcggaccucgaacuggagcgcgccgcugauguuaaaugggaggaccaagccgaaauuagcggguccagcccuauccuuucuauuaccaucagcgaggauggauccaugucuauuaagaaugaagaggaggaacagacacugacgauccucauuagaaccggccugcucgugaucagcgggcuguuccccgucuccaucccgauuacagcugccgccugguaccuuugggaggugaagaaacagcgggcuggaguccugugggacgugccuucucccccucccguuggcaaggcggaacuggaggauggggccuaucgcaucaaacagaaggggauucucggcuacagccaaaucggcgcugggguguauaaagaaggaaccuuucacacaauguggcaugucaccagaggcgccgugcugaugcacaaggggaagcggauugagcccuccugggccgacguuaaaaaggaucuuaucucuuacggaggcggguggaaacuggagggagaauggaaggagggcgaagaggugcagguccucgcucuggaaccuggcaaaaacccgcgcgccgugcagacgaagcccgggcuguucaagaccaaugcgggaacaaucggcgcugugagccuggacuuuuccccugggaccagcggaucucccauuaucgauaaaaagggcaaaguugucgggcuuuacggaaacggcguggugacaagauccggcgccuaugucagcgccauugcucagaccgagaagucuaucgaggacaacccugaaauugaggaugacaucuuccggaaaagaaagcugacaaucauggaucugcaucccggggccggaaagacgaaacgcuaccucccugcgauugugcgggaagcuaucaagagaggccugcgcacccuuauucuggccccgacacggguuguggccgcugagauggaagaggcccucagagggcugcccauccgcuaucaaaccccugcuauucgggccgagcacaccggaagagaaaucgucgaccucaugugucaugcgacauucacgaugcgccugcuuucccccgugcggguuccuaauuacaaccugauuaucauggacgaggcccacuuuaccgaucccgcuagcaucgccgcuagaggcuauauuuccacacggguggaaaugggggaggccgccggcaucuucaugaccgcuacaccgccuggaucucgcgaccccuuuccccagagcaaugcgccuauuauggaugaggaaagagagauccccgaacgguccuggagcucuggccacgagugggucaccgacuucaaagggaagacggugugguuuguuccuuccauuaaagccggaaacgauaucgcugccugccugcgcaagaauggcaagaaagugauccagcucagcagaaagacauucgacucugaauacgucaaaacccggaccaacgauugggacuuuguggugacaaccgauauuagcgagaugggggccaauuucaaggcugagagagucaucgacccgcgccgguguaugaaacccguuauucugacagauggagaagagagagugauccuugccggcccuaugcccgugacccauuccucugcggcucaacgccgggggagaauuggccgcaacccuaagaaugaaaacgaccaguauaucuacaugggagagccccuggaaaaugacgaggauugcgcccacuggaaagaggccaagaugcuccuggacaacaucaauacgccggaaggcauuaucccuagcauguuugagcccgaacgggagaaggucgaugcuauugacggggaauacagacugcgcggagaggccagaaaaacauucguggaucucaugcggcgcggcgaccuuccuguuuggcuggcguauagaguggccgcugaggggaucaacuacgccgaucggcgcugguguuuugacggaauuaagaauaaccagauccuggaagagaacgucgaaguggagauuuggaccaaagagggcgaaagaaagaaacucaagccccgguggcuggaugcuagaaucuauuccgacccucuugcccugaaggaguucaaagaguucgcugccgggcgcaagucucucacacugaaucugaucaccgagaugggccggcuccccacguuuaugacccagaaagcgagagaugcccuugacaaccuggcuguucugcauacagccgaagcuggaggccgcgccuacaaucacgcccucagcgagcugccggagacccuugaaacacugcuccugcugacccuccuugcuacagugaccgggggaauuuuccuguuucugauguccggccgggggaucggaaagaugacgcucggcaugugcugcauuaucacagcgagcauucugcuuugguaugcccaaauccagccucacuggaucgcugccucuauuauccuggaguucuuucucauuguccugcugauccccgaacccgagaaacagagaaccccucaggauaaccaacucaccuacguggucauugccauccuuacagugguugcugccaccauggcgaaugaaaugggcuuccuggagaagacaaagaaagaccuggggcucggauccaucacgacccagcagccggagagcaacauucuggacaucgaucuucggcccgccuccgcuuggacacuguaugccguggcuaccacauuugugaccccuaugcuccgccauucuauugaaaauagcuccgucaacguuucucugacggccaucgcgaaucaggccaccgugcugaugggccucgggaagggauggccccuuagcaaaauggacauuggcgugccucugcuggcuaucggguguuacucccaagucaaccccauuacacucaccgccgcucugcuucugcucguggcccacuacgcuaucaucggaccuggccugcaggccaaggcgacaagagaggcccagaaacgggcugccgcuggcauuaugaagaauccgaccguugaugggaucacggugauugaccuggaucccaucccuuaugaccccaaguucgaaaaacagcucggacaagucaugcuucuggugcugugcgucacacaggugcucaugaugcgcaccacaugggcccugugugaggcccuuacccuggcgaccggcccuauuagcacacucugggaagggaaccccggaagauuuuggaauacgaccaucgcuguuucuauggccaacaucuuccggggcuccuaccuggcuggggccggacugcucuuuagcauuaugaagaauacaaccaacacacgcagaggcaccggcaauaucggggagacgcuuggagagaaauggaagucucggcugaacgcccugggcaaauccgaguuccagauuuauaagaaaagcgggauccaagagguggaucgcacacucgcuaaggaaggaauuaagagaggcgagaccgaccaucacgccgucucucgggggagcgcgaaacugagaugguuuguggagcgcaacaugguuaccccggaaggaaagguggucgaucuuggcugcggcagagggggaugguccuacuauuguggcgggcugaaaaaugugagagaggugaagggacucacaaaaggcgggccuggacaugaagaacccauccccaugucuaccuacggcuggaaccugguucgccugcagagcggcgucgacguguucuucacaccucccgaaaagugcgauacgcuccuuugugacaucggggaguccagcccuaauccgaccguggaggccggacggacacugagaguccugaaccucguugaaaauuggcugaacaauaacacccaguuuugcauuaaggugcuuaaucccuauaugccuuccgugaucgagaaaauggaagcucugcagcgcaaguacggcggggcccucguccggaacccccugucuagaaauagcacacacgagauguacuggguguccaacgcuucuggaaauauuguuagcuccgugaacaugaucucucgcaugcugauuaaucgguucaccaugagacacaaaaaggccacguaugaaccugaugucgaccucggcagcgggacccgcaacaucggaaucgaguccgagauucccaaccuugacaucauuggcaaacggaucgaaaagauuaagcaagagcaugaaacaagcuggcacuacgaucaggaccauccguauaaaaccugggcguaccacggcucuuaugagacaaagcagaccggguccgccagcucuauggugaauggaguugugagacugcugacaaaaccuugggaugucgugcccauggugacccagauggcuaugacggacacaaccccuuuuggccaacagcgcgucuucaaggaaaaaguugauaccagaacacaggagcccaaggaggggacgaagaaacucaugaagaucaccgccgaauggcuguggaaagagcuuggaaagaaaaagacaccucggauguguacccgcgaagaguuuacaagaaaagugcgguccaacgcugcccugggcgcuauuuucaccgacgagaauaaguggaaaagcgccagagaagcgguggaggauucucgguuuugggaacucgucgacaaagagcgcaaccugcaccuggaagggaagugcgagacauguguguacaauaugaugggaaaaagagagaagaaacucggcgaguucggcaaggccaaggggucccgggcuaucugguauauguggcugggagcccgcuuucuugaguucgaagcucugggcuuucucaacgaggaucauugguucagcagagaaaauucccugagcgggguugagggagagggccuucacaaacugggguacauccuccgggacgugucuaagaaagaaggcggagccauguacgccgaugacaccgcgggcugggacacgcgcauuacccuggaggaucugaagaacgaagagauggucacaaaucauauggaaggggagcacaaaaagcucgcugaggccaucuuuaagcugaccuaucagaacaaagugguuagagugcaacggcccacaccgcgcggaaccgucauggacauuaucagcagacgggaucagcgcggcuccggacaggugggaacguacggccuuaauacauucaccaacauggaagcccaacugauuagacagauggagggggaaggcguuuucaagucuauccagcaucucacagugaccgaggagaucgcuguccagaauuggcuggcccgggugggacgcgaaagacuuagccggauggcuauuuccggcgacgauugcgucgugaaaccucuggacgauagauuugccucugcgcucacggcccugaacgacauggggaagguucgcaaagauauccaacagugggagcccagccggggauggaaugacuggacccaggugcccuucugcucccaccacuuucaugaacugauuaugaaggauggcagaguccucguggugccuugucgcaaccaggacgagcugaucgggcgggcuagaauuucucaaggagccggcuggagccuucgcgaaacagcuugccuggggaaguccuaugcccagauguggagccucauguacuuccaccggagagaucugcgccuugcggccaacgcuaucuguucugccguuccgucccauugggugcccaccagccggacaaccuggucuauccacgcuaaacacgaguggaugacaaccgaggacaugcugacggucuggaauagaguguggauucaggaaaacccuuggauggaggacaagacacccguugaauccugggaggaaaucccuuaucucggcaaacgcgaggaucaguggugcggaagccugauuggccugaccucccgggccaccugggcuaagaauauccaaacagccauuaaccaggugagaucucucaucgggaaugaggaauacaccgacuauaugcccagcaugaaacgguuuagacgcgaggaagaggaagcgggaguccugugguga

SEQ ID NO: 20276 - RNA, 9876 nt, Artificial Sequence
  derived and/or modified CDS sequence (opt5) from DENV-2__GQ398263__SS-prME
accgccggaaugaucauuaugaugauccccacagugauggcuuuccaccugacgaccagaaacggggagccucauaugauugucagccggcaggaaaagggaaaaagccuccuguuuaagacagaggacggcguuaauaugugcacccuuauggccauggaucugggggaacucugugaggacacaaucaccuacaacugcccgcugcuucgccaaaaugaacccgaggauauugacuguuggugcaacucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccaucauggcugccauucuggcuuacacaaucgggaccaccuauuuucagagagugcucauuuucauccugcuuacagccgucgcgccuuccaugacgaugcggugcauuggaaucucuaaucgcgauuuuguggaaggcguuagcgggggauccuggguggacauuguccuggagcacggcagcugugugaccacaauggccaaaaacaagcccacccucgauuucgaacugaucaagacagaggcuaaacacccugccacccuuagaaaguacugcaucgaagcuaaacugacgaauacaaccaccgccucucgguguccgacacagggggagcccucccucaacgaggaacaagacaagcgcuuugugugcaaacauagcauggucgauagaggauggggcaauggcugugggcuguucggaaagggcgggauuguuaccugcgcgauguuuacaugcaagaaaaacauggagggaaagguggugcagccugaaaaucuggaguauacgaucgucauuacaccccacucuggcgaagagaacgccguggggaaugacacaggaaaacauggcaaggagaucaaaauuaccccucaguccagcaucacagaagcugagcucaccggcuacgggacgguuaccauggaauguucuccccggacaggacuggauuucaacgagauggugcuucugcagauggaaaauaaggccuggcucguccaccgccaaugguuucuggaccuuccgcugccuuggcuccccggcgcugauacccagggguccaacuggauccagaaagagacacuggugaccuucaagaacccucacgccaagaaacaggacguugugguccugggaagccaagagggcgccaugcauacggcucucacaggggcgaccgaaauucagauguccucuggcaaucugcuuuuuacaggacaccugaagugcagacuccggauggacaaacugcagcuuaagggcaugagcuauuccauguguaccgggaaauucaagguggucaaggagaucgccgaaacccaacauggaacaauugugguuagagugcaguacgagggcgaugggagccccugcaaaauccccuucgagauuauggaccuggaaaagcgccacguccucggacggcugaucacggugaacccuaucguuaccgagaaagauucuccggugaauauugaagcugagcccccuuuuggcgacuccuacaucauuaucggggucgaacccggccagcugaagcucagcugguucaaaaagggaucuagcauuggccagauguuugagacaaccaugagaggggccaagcgcauggccauccugggagauacagcuugggacuucggcucccuugggggaguguuuaccucuauuggcaaagcccugcaucaaguguucggggcgaucuauggcgcugccuuuagcggaguuuccuggacgaugaagauccucauuggcgucgugaucacauggauugggaugaacagccggucuaccucccugagcgugucucugguccuugugggaguugugacccucuaccugggcgucauggugcaggccgauuccggguguguugugagcuggaaaaauaaggagcugaaaugcggauccggcaucuucauuacagacaacguccacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaaguuaaacugacaaucaugaccggagauauuaagggcaucaugcaggccgggaaacggucccugagaccucagcccacagagcuuaaguacagcuggaaaaccuggggaaaggcgaagaugcucucuacggaacugcacaaccauaccuuccugaucgacggcccugagacagccgaaugccccaccacaaaucgcgcuuggaacucccucgagguggaggauuauggguuuggagucuucaccacaaauauuuggcugaaacuuaaggaacggcaagacgugcugugugacagcaaacucaugucugccgcuaucaaggauaacagagccgugcacgcggacaugggcuacuggauugaguccgcccugaaugauaccuggaaaaucgaaaaggcuagcuuuauugaggucaagucuugccacuggccuaaaagccauacgcugugguccaacggcguucuugagagcgaaaugaucauccccaagaacuucgccgggccggugucucagcacaauuaucgcccuggauaccauacacagaccgcuggccccuggcaccucgggaaacuggagauggacuucgauuuuugugaaggaaccacaguggucgugaccgaggacugcggcaaccgggggcccucccugagaacgacaaccgccagcggaaagcucauuacagaauggugcugucgguccugcacccugccuccgcuucgcuacagaggcgaggauggcuguugguaugggauggagauccggccccugaaagacaaggaagagaaucucguuaacucucuggugacagccggacauggccagauugauaauuucagccuggggguccuuggaauggcucucuuucuggaagagaugcugagaacccgcgugggcacgaagcacgcgauccuccugguugccguguccuucgucacccuuauuacagggaacaugucuuuucgggaccugggaagagugaugguuauggugggcgcuaccaugacagaugacaucggcaugggggucaccuaccucgcccugcuggccgcuuucaaagugcgcccuacguuugccgcgggacuucugcucagaaagcugacaagcaaagaacucaugaugaccacaauuggcaucgugcugcuuucccaaucuaccauccccgagaccauucuggagcucacagaugcucuggcccuggggaugaugguccuuaagaucguucggaauauggaaaaauaucagcuggccgugacgauuauggcuauccucugcgugccuaacgccgucauucugcagaaugcguggaaggugagcuguaccauccucgcuguuguguccgucagcccccugcuucugacaucuucccaacagaaggccgacuggaucccucucgcccugaccauuaaaggacugaaccccacagcuaucuuccuuaccacgcugagccgcacaucuaagaaaagauccuggccgcucaaugaggccauuauggcugugggcaugguuagcauccuggccucuucccuccugaagaacgacauuccuaugaccgggccccuuguggcgggaggccugcugaccgucugcuacgugcucacaggccggagcgccgaucuggaacuugagcgcgcugccgacgucagaugggaagaucaggcugagaucuccgggagcucuccuauccugagcauuaccaucuccgaggacggaucuaugagcauuaaaaaugaagaggaagaacagacacucacgauccugauucggaccggccuccuggugaucuccgggcuuuuucccguuucuauuccgaucacagccgccgcuugguaucugugggaggugaagaaacaacgcgcgggaguccugugggaugugccuucucccccucccguuggcaaggccgaacucgaggacggggcuuacagaaucaagcagaaaggcauucugggcuauucccagaucggcgccgggguguacaaggaaggaaccuuccacacaauguggcaugucacccggggcgccgugcuuaugcacaaagggaagcgcauugagcccuccugggcugaugugagaaaagaccugaucagcuacggaggcggguggaagcucgaaggagaguggaaggagggcgaagagguucagguccuggcccucgaaccuggcaaaaacccgcgggcggugcaaacgaagcccgggcuguuuaaaaccaauacaggaaccauuggcgcugugucccuugauuucagcccugggacaucuggaucccccaucgucgacaagaaaggcaaggugguugggcuguauggaaacggcguggucaccagaagcggcacauacgugucugccaucgcccagacggagaaguccauugaagauaacccugagaucgaggacgauauuuuucgcaaaaagcggcugaccaucauggaccuccaucccggggcuggaaaaacaaagagauaucugccugccauuguucgcgaagcgaucaaacggggccuuagaacccugauccucgcuccgacccgcguggucgccgccgagauggaagaggcucugcgggggcuccccauuagauaccagaccccugccauccgcgcugaacacacgggacgggagauuguggaccugaugugucaugccaccuucacaaugagacuucugagccccguucgggugccuaauuauaaccugaucauuauggaugaggcgcacuucaccgaccccgccuccaucgcugcccgcggcuacauuucuacaagagucgaaaugggggaggcugccggcaucuuuaugaccgccacgccgccuggaagccgggaucccuucccccaguccaaugcuccuaucauggacgaggaacgcgagauucccgaaagaagcuggaacucuggccacgagugggugacagauuuuaaggggaagaccgugugguucgucccuuccaucaaagcgggaaaugacauugccgcuugccuccggaagaacggcaaaaagguuauccaacugagcagaaaaaccuuugauucugaauauauuaagacacgcaccaaugacugggauuucguggugacaaccgacaucagcgagaugggggccaacuuuaaggccgaacgggucaucgauccgagacgcuguaugaaacccgugauucuuacggacggagaggagcggguuauccuggcuggcccuaugcccgugacacauuccucugccgcgcagagacgcgggcggauuggcagaaauccuaagaacgaaaaugaccaguacaucuacaugggagagccccucgaaaacgaugaggacugcgcucacuggaaagaagccaagaugcugcuggauaauauuaacaccccggagggcaucaucccuagcauguucgagcccgaacgcgagaaagucgacgccauugauggggaauauagacuccggggagaggcucgcaagacauuuguggaccuuaugagacggggcgaucugccuguuuggcuggccuaccgcguggcggccgaagggaucaauuaugcugacagacggugguguuucgauggaauuaaaaacaaccaaauccucgaggagaaugucgaaguggagauuuggaccaaggaaggcgagagaaagaaacugaagccccgcuggcuugacgcccggaucuacuccgauccucuggcucucaaagaguuuaaggaguucgccgcugggagaaaaucucugacgcugaaccucauuaccgagaugggccgccuucccacauucaugacccagaaggcccggaaugcgcuggacaaccuggccguccuccauacagcugaagccggaggcagagcuuauaaucacgcccugagcgagcuuccggaaacccuggagacacuccugcugcucacccuucuggccacggugacagggggaaucuuucuguuccucauguccggcaaggggaucggaaaaaugacccugggcaugugcugcauuaucaccgcuagcauucuucugugguacgcgcagauccagccucacuggauugccgcuucuaucauccucgaguuuuuccugauuguucugcucauccccgaacccgagaagcaacggacaccucaggauaaccagcuuaccuauguggugauugccauccugacagucguugccgcuacgauggccaaugaaaugggcuuucuggagaaaaccaagaaagacuucgggcucggauccauugcgacacagcaaccggaaagcaacauccuggacaucgaucuucgccccgccuccgcuuggacccuguacgccguggcuacaaccuuuauuacgccuaugcucagacauucuaucgagaauagcuccgugaacgucucucugaccgccauugcgaaucaggccacagugcugaugggccucgggaagggauggccccuuagcaagauggacaucggcguuccucugcuggcuauuggguguuacucccaggugaaccccaucacccucacagccgcucugcuucugcucgucgcccacuaugcuauuaucggaccuggccugcaggccaaagcgacccgggaggcccaaaagcgcgcugccgcuggcaucaugaaaaauccgacgguggaugggauuacagucaucgaccuggaucccauuccuuacgaccccaaguucgaaaaacagcucggacaggugaugcuucugguucugugcgugacccagguccucaugaugagaacaaccugggcccugugugaggcccuuacccuggcgacaggcccuaucagcacgcucugggaagggaaccccggacgguuuuggaauaccacaauugcugugucuauggccaacaucuuccgcggcuccuaucuggcuggggccggacugcucuuuagcaucaugaagaauaccgccaacacaagacggggcaccggcaacacgggggagacacuuggagaaaaguggaaaaaucgccugaacgcucugggcaagucugaguuccaaauuuacaaaaaguccgggauccaggagguugauagaacccucgccaaagaaggaauuaagcggggcgagaccgaccaucacgcggugagcagagggucugccaaacugcgcugguuugucgaacggaaucuugugacaccggagggaaaggugguugaucugggcugcggcagagggggauggagcuauuacuguggcgggcucaagaacgucaaagaggugaagggacugaccaaaggcgggccuggacaugaggaacccauccccauguccacauauggcuggaaucuggugcgccuccagucuggcgucgacguuuucuucacgccucccgaaaagugcgauacccuucugugugacauuggggagagcuccccuaacccgacaguggaagcuggacggacccugagagugcucaaucuggucgagaacuggcuuaauaacaauacacaauuuugcaucaaagugcugaaccccuacaugccuagcguuaucgagaagauggaagcccuccagcgcaaguacggcggggcucuggugcggaauccccuguccagaaacucuacccacgagauguauugggucagcaaugccuccggaaacauugugucuagcguuaacaugaucucccgcaugcucauuaaucgguucacgaugagacacaaaaaggcgaccuacgaaccugauguggaccuuggcucugggacacgcaacaucggaauugagagcgaaauccccaaucuggacgucaucggcaaacggauugagaagaucaaacaggagcaugaaaccuccuggcacuaugaucaggaccauccguacaagacaugggccuaucacggcagcuacgagaccaagcaaacagggucugcuuccagcauggugaacggaguggucagacugcucaccaaaccuugggauguuauucccauggugacgcagauggccaugacagacaccaccccuuuuggccagcagcgcguguucaaggaaaaagucgauacaagaacgcaagagcccaaggaagggaccaaaaagcugaugaagaucacagcugaguggcuuuggaaagagcugggaaagaaaaagaccccucggauguguacacgcgaagaguuuaccagaaaagugcggucuaaugccgcucucggcgccauuuauacagacgaaaacaaguggaaauccgcgagagaggccguugaggauagccgguucugggaacugguggacaaggagcgcaaucugcaccucgaagggaagugcgagaccugugucuacaacaugaugggaaaaagagaaaagaaacugggcgaguuuggcaaggcuaaagggucucgggccaucugguacauguggcuuggagcucgcuuccuggaguuugaagcccucggcuuccugaaugaggaucauugguuuuccagagaaaacagccuuuccgggguggagggagaaggccugcacaagcucggguauauucugcgggacguuagcaagaaagagggcggagccauguacgcggaugacacggcuggcugggacacccgcaucacacuggaggaucucaagaaugaagagauggugaccaaccauauggaaggggagcacaaaaagcuggccgaagccaucuucaaacuuacauaucagaauaaggucgugagaguucagcggcccaccccgcgcggaacggugauggacauuaucucuagacgggaucagcgcggcagcgggcaagucgugacauacggacugaacaccuuuacaaauauggaggcucagcucauuagacagauggagggcgaaggggucuucaaguccauccaacaucugaccgugacggaggaaauugccguuaaaaacuggcuugcucgggugggccgcgagagacugucucggauggccaucagcggagacgauugcgucgugaagccucucgacgauagauucgcguccgcccugaccgcucugaacgacaugggcaaagugcgcaaggauauccagcagugggagcccucucggggguggaaugacuggacacagguucccuuuugcagccaccacuuccaugaacucauuaugaaagauggaagagugcuggucgugccuugucgcaaccaagacgagcuuaucggccgggccagaauuucccagggggcuggauggucucugcgcgaaaccgccugccucggcaagagcuaugcgcagauguggucccugauguacuuucaccggagagaucuucgccuggccgcuaaugccaucuguagcgcuguuccgucucauugggugcccacaucccggaccacauggagcauucacgccacccacgaguggaugacgacagaagacaugcucaccgucuggaacagaguguggauccaggagaauccuuggauggaggacaagacccccgucgaaucuugggaggaaaucccuuaucuggggaaacgcgaggaucaauggugcggcucccugauuggacucacaagccgggcuaccugggccaagaacauccagacagcgauuaaucaggugagaucccugaucggcaacgaagaguacacggacuacaugcccucuaugaaacgguucagacgcgaggaagaggaagccgggguucuuugguga

SEQ ID NO: 20277 - RNA, 9876 nt, Artificial Sequence
  derived and/or modified CDS sequence (opt5) from DENV-2__GQ398264__SS-prME
accgccggaaugaucauuaugaugauccccacagugauggcuuuccaccugacgaccagaaacggggaaccucauaugauugucagccggcaggaaaaggggaaaagccuccuguuuaagacagaaaauggaguuaacaugugcacccuuauggccauggaccugggggaacucugugaagauacaaucaccuacaauugcccgcugcuucgccaaaacgaacccgaagacauugauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccaucauggcugccauucuggcuuacacaaucgggaccaccuauuuucagagagugcucauuuucauccugcuuacagccgucgcgccuuccaugacgaugcggugcauuggaaucucuaaccgcgacuuuguggaaggcguuagcgggggauccuggguggauauuguccuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggauuguuaccugcgcgauguuuacaugcaagaaaaauauggagggaaagguggugcagccugaaaaccuggaguauacgaucgucauuacaccccacucuggcgaagagaaugccguggggaacgauacaggaaaacauggcaaggagaucaaaauuaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauccagaaagagacacuggugaccuucaagaauccucacgccaagaaacaggauguugugguccugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaagguggucaaggagaucgccgaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagcugagcccccuuuuggcgauuccuacauuaucauugggguggaacccggccagcugaagcucagcugguucaaaaagggaucuagcaucggccagauguuugagacaaccaugagaggggccaagcgcauggccauucugggagacacagcuugggauuucggcucccuugggggagucuuuaccucuaucggcaaagcccugcaucaaguguucggggcgaucuauggcgcugccuuuagcggaguguccuggacgaugaagauucucaucggcguugucauuacauggaucgggaugaauagccggucuaccucccugagcgugucucuggugcuugucggagugguuacccucuaccugggcgugaugguccaggccgacuccgggugugugguuagcuggaaaaacaaggagcugaaaugcggauccggcauuuucaucacagauaaugugcacaccuggacagaacaguauaaguuucagccugagucucccagcaagcucgcuuccgccauccaaaaagcucacgaagaggggauuuguggcaucagaucugucacgcgccuggaaaaccuuauguggaagcagauuaccccggagcugaaucauauccucagcgagaacgaagugaaacugacaauuaugaccggagacaucaagggcaucaugcaggccgggaaacggucccugagaccucagcccacagagcuuaaguacagcuggaaaaccuggggaaaggcgaagaugcucucuacggaacugcacaaucauaccuuccugauugauggcccugagacagccgaaugccccaacaccaaucgcgcuuggaacucccucgagguugaggacuauggguuuggaguguucacaaccaauaucuggcugaaacuuaaggaacggcaagaugucuuuugugacagcaaacugaugucugccgcuauuaaggacaacagagccgugcacgcggauaugggcuacuggaucgaguccgcccucaacgacacauggaugauugaaaaagcuagcuucaucgaggugaagucuugccacuggccuaagagccauacccugugguccaauggcguccuggagagcgaaaugaucauucccaaaaacuucgccgggccgguuucucagcacaauuaucgcccuggauaccauacgcagacagcuggccccuggcagcuugggaagcucgagauggauuuugacuucugugaaggaaccaccgugguggucacagaggauugcggcaaccgggggcccucccugagaaccacgacagccagcggaaaacugaucaccgaauggugcugucgguccugcacacucccuccgcugcgcuacagaggcgaggacggcuguugguaugggauggagauucggccccuuaaggaaaaagaggaaaaucuggugaacucucucguuaccgccggacacggccaaaucgauaauuuuagccugggggugcugggaauggcucuuuuccucgaggaaaugcugagaacacgcgucggcaccaagcaugcgauucugcucguggccguuuccuuugugacgcugaucaccgggaacaugucuuuccgggaccuuggaagagucauggugaugguuggcgcuacaaugaccgaugacauuggcaugggggugacauaccuggcccuccuggccgcuuuuaagguccgcccuaccuucgccgcgggacugcuucugagaaaacucacgagcaaggagcugaugaugacaaccaucggcaucgugcuccugucccagucuacaauucccgagaccauccuugaacugaccgaugcucucgcccuggggaugauggugcugaaaauuguccggaauauggagaaguaucagcuugccguuacaaucauggcuauucugugcgugccuaacgccgugauccuccaaaaugcguggaaagucagcuguacgacccuggcugugguuuccgugagcccccuccugcuuacaucuucccagcagaaggccgacuggaucccucuggcccucaccauuaagggacugaaccccacagcuaucuuucugaccacgcuuagccgcacaucuaaaaagagauccuggccgcugaaugaagccauuauggcugucggcauggugagcauccucgccucuucccugcucaaaaacgauauuccuaugaccgggccccugguugcgggaggccuucugaccgugugcuacguccugacaggccggagcgccgaccucgagcuggaacgcgcugccgacgugagaugggaggaucaggcugagaucuccgggagcucuccuauccuuagcauuaccaucuccgaagacggaucuaugagcauuaagaaugaggaagaggagcaaacacugacgauccucauucggaccggccugcucgucaucuccgggcuguuccccgugucuauuccgaucacagccgccgcuugguaucuuugggaaguuaaaaagcagcgcgcgggagugcugugggaugucccuucucccccucccgugggcaaagccgagcuggaagacggggcuuacagaaucaagcagaagggcauucucggcuauucccagaucggcgccgggguuuacaaagagggaaccuuucacacaauguggcacgugacccggggcgccguccugaugcauaaggggaaacgcauugaacccuccugggcugaugugagaaaggaccuuaucagcuacggaggcggguggaaacuggagggagaguggaaggaaggcgaggaagugcaaguucucgcccuggagccuggcaagaacccgcgggcgguccagacgaaacccggacucuucaagaccaacacaggaaccauuggcgcugugucccuggauuuuagcccugggacaucuggaucccccaucguggacaaaaagggcaaagucguggggcuuuauggaaauggcguugugaccagaagcggcacauacgucucugccaucgcccagacggaaaaguccauugaggauaacccugagaucgaagacgauauuuuccgcaagaaacggcugaccaucauggaccugcaccccggggcuggaaagacaaaaagauaucucccugccauugugcgcgaggcgaucaagcggggccugagaacccuuauccuggcuccgacccgcguuguggccgccgaaauggaggaagcucuccgggggcugcccauuagauaccagaccccugccauccgcgcugagcauacgggacgggagauugucgaucucaugugucacgccaccuucacaaugagacugcuuagccccgugcggguuccuaauuauaaccugaucauuauggacgaagcgcauuuuaccgaccccgccuccaucgcugcccgcggcuacauuucuacaagaguggagaugggggaagcugccggcaucuucaugaccgccacgccgccuggaagccgggaucccuuuccccaauccaaugcuccuaucauggacgaggagcgcgaaauucccgagagaagcuggaacucuggccacgaaugggucacagauuucaaagggaagaccgugugguuugugccuuccaucaaggcgggaaaugacauugccgcuugccugcggaaaaacggcaagaaagucauccagcucagcagaaagaccuucgauucugaguauauuaaaacacgcaccaaugacugggauuuuguugugacaaccgacaucagcgaaaugggggccaacuucaaggccgagcgggugaucgauccgagacgcuguaugaagcccgucauucugacggacggagaggaacgggugauccuugcuggcccuaugcccguuacacacuccucugccgcgcagagacgcgggcgggugggcagaaauccuaaaaacgagaaugaucaauacauuuacaugggagaaccccuggagaacgacgaagacugcgcucauuggaaggaggccaaaaugcuccuggauaauaucaacaccccggagggcauuaucccuagcauguuugaacccgagcgcgaaaaggucgacgccaucgauggggaguauagacugcggggagaagcucgcaaaacauucguggaccucaugagacggggcgaucuuccuguuuggcuggccuaccgcguggcggccgaggggauuaacuaugcugacagacggugguguuuugauggagucaagaauaaccagauccuggaggaaaauguggaggucgaaauuuggaccaaagagggcgagagaaagaagcucaaaccccgcuggcuggacgcccggaucuacuccgauccucuugcucugaaggaguucaaagaguucgccgcugggagaaagucucucacgcugaaccugauuaccgaaaugggccgccuccccacauuuaugacccagaaagcccggaaugcgcuugacaaccuggccgugcugcacacagcugaggccggaggcagagcuuauaaucaugcccucagcgaacugccggagacccuugagacacugcuccugcugacccuccuugccacgguuacagggggaaucuuccuguuucugauguccggcaaggggauuggaaagaugacccucggcaugugcugcaucaucaccgcuagcauucugcuuugguacgcgcagauccaaccucacuggauugccgcuucuaucauucuggaguucuuucucaucgugcugcugauccccgagcccgaaaaacagcggacaccucaggauaaccagcucaccuauguggucauugccauccuuacaguuguggccgcuacgauggccaaugagaugggcuuccuggaaaagaccaaaaaggacuuugggcugggauccacagcgacccaacagccggagagcaacauucucgauaucgaccugcgccccgccuccgcuuggacacuuuacgccguggcuaccacguucauuaccccuaugcugagacacucuaucgagaauagcuccgucaacgugucucucacagccaucgcgaaucaggccaccguucugaugggccuggggaaaggauggccccucagcaagauggacauuggcgugccucuucuggcuaucggguguuacucccaggucaaccccauuacacugaccgccgcucuccugcuucugguggcccauuaugcuaucauuggaccuggccuccaagccaaggcgacgcgggaagcccagaaacgcgcugccgcuggcaucaugaagaauccgacagucgaugggauuaccgugaucgaccuggaucccaucccuuacgaccccaaauuugagaagcagcugggacagguuaugcuccuugugcugugcgucacacaagugcugaugaugagaaccaccugggcccucugugaagcccugacacuugcgacgggcccuauuagcacccugugggaggggaaccccggacgguucuggaauacaaccaucgcuguuucuauggccaacauuuuucgcggcuccuaucucgcuggggccggacugcuguucagcaucaugaaaaacacagccaauaccagacggggcacgggcaacacaggggaaacccucggagagaaguggaagaaucgccuuaacgcucugggcaaaucugaguuucagauuuacaagaaauccgggauccaggaaguggauagaacccuggccaaggagggaaucaaacggggcgaaacagaccaccaugcggucagcagagggucugccaagcuccgcugguucguggagcggaaucuggugaccccggagggaaaaguugucgaucuuggcugcggcagagggggauggagcuauuacuguggcgggcugaagaacgugaaggaagugaaaggacucacaaagggcgggccuggacacgaggaacccauucccauguccacguauggcuggaaucugguccgccugcaaucuggcguugacguguucuuuaccccucccgagaaaugcgauacacuccuuugugacaucggggaaagcuccccuaacccgaccguggaggcuggacggacacugagaguccugaaucucguggagaacuggcugaauaacaauacccaguucugcauuaagguucuuaaccccuacaugccuagcgugaucgagaaaauggaggcccugcagcgcaaguacggcggggcucucguccggaauccccuguccagaaacucuacgcaugaaauguauugggugagcaacgccuccggaaauauuguuucuagcgugaacaugaucucccgcaugcugaucaaucgguuuaccaugagacacaagaaagcgacauacgagccugaugucgaccucggcucugggacccgcaacauuggaaucgaaagcgagacacccaaucuugauauuaucggcaagcggauugagaaaaucaagcaggaacacgagaccuccuggcauuaugaccaagaccacccguacaaaacaugggccuaucauggcagcuacgaaaccaagcagacggggucugcuuccagcauggugaacggaguggucagacugcugacaaagccuugggauguuauccccauggugacccagauggccaugaccgacacaacgccuuucggccagcaacgcguguuuaaagagaaggucgauaccagaacacaggaacccaaagaggggaccaagaaacucaugaagauuacagcugaguggcuguggaaggaacuuggcaaaaagaaaaccccucggauguguacacgcgaggaguucaccagaaaggugcggucuaaugccgcucugggcgccaucuuuacggacgagaacaaauggaaguccgcgagagaggccguugaagauagcggguucugggagcucguggacaaagaacggaaucugcaccuggagggaaagugcgaaaccugugucuauaacaugaugggcaagcgcgagaaaaagcucggcgaguuugggaaagcuaagggaucuagagccauuugguacauguggcugggcgcucgguuccuugaauuugaggcccugggguuccucaaugaagaucacugguuuucccgcgagaacagccuguccggaguggaaggcgaggggcuucauaaacugggcuacauccucagagacguuagcaagaaggagggaggcgccauguaugcggaugacacagcugggugggauacccggauuacacuggaagaccugaaaaaugaggaaauggugaccaaccacauggagggagaacauaagaaacucgccgaggccaucuucaagcugacguaccagaauaaagucgugcgcguucagagacccacaccgcggggcaccgugauggacauuaucucucgcagagaucaacgggggagcggacaggucgugacauauggccuuaacaccuucacgaacauggaggcucagcugauccgccaaauggaaggggagggcgucuuuaaguccauucagcaccucaccgugacagaagagaucgccguuaagaauuggcuggcuagagugggacgggagcgccuuucuagaauggccauuagcggcgacgauugcgucgugaaaccucuggacgaucgguucgcguccgcccucaccgcucugaacgacauggggaaggugagaaaagauauccagcagugggaacccucucgcggauggaaugacuggacacaaguucccuuuugcagccaucacuuccacgagcugauuaugaaggauggccgggugcucgucgugccuuguagaaaccaggacgaacugaucgggcgcgcccggaucucccagggagcuggcuggucucuuagagagaccgccugccuggggaaaagcuacgcgcagauguggucccucauguauuuucaucgccgggaucugagacuugccgcuaaugccauuuguagcgcuguuccgucucacugggugcccacaucccgcaccacguggagcauccaugccacacacgaauggaugaccaccgaggacaugcugacagucuggaaccggguguggauucaagagaauccuuggauggaagauaagacccccgucgagucuugggaagagaucccuuaccucggcaagagagaagaccaguggugcggaucccugauuggccugacaagccgcgcuacgugggccaaaaacauccagaccgcgaucaaucaggugcggucccucauugggaacgaggaguauacagacuacaugcccucuaugaagagauuccggagagaagaggaagaggccggaguucugugguga

SEQ ID NO: 20278 - RNA, 9876 nt, Artificial Sequence
  derived and/or modified CDS sequence (opt5) from DENV-2__GQ398260__SS-prME
accgccggaaugaucauuaugcugauccccaccgugauggcuuuccaccucacgaccagaaauggggaaccucauaugauugucagccggcaggaaaagggaaaaucccugcuuuuuaagacggaagacggcguuaauaugugcacccugauggccauggaucucggggaacugugugaggacacaaucaccuacaacugcccgcuucugagacaaaaugaacccgaggauauugacuguuggugcaacucuacaagcaccugggugacguauggaaccuguacagcgaccggcgagcaccggcgggaaaaacgcuccguggcucucgucccucauguggggaugggacuggagacaagaaccgaaacguggaugucuagcgagggcgccuggaagcacgcccagcggaucgagacauggauccugcgccaucccggcuucaccauuauggcugccauccucgcuuacacaauugggaccaccuauuuucagagaguucugaucuucauucuucugacagccguggcgccuuccaugacgaugcggugcaucggaauuucuaaucgcgauuuugucgaaggcgugagcgggggauccuggguugacaucgugcucgagcacggcagcugugucaccacaauggccaaaaacaagcccacccuggauuucgaacuuaucaagacagaggcuaaacagccugccacccugagaaaguacugcauugaagcuaaacucacgaauacaaccaccgccucucgguguccgacacaaggggagcccucccugaacgaggaacaggacaagcgcuuugugugcaaacacagcaugguggauagaggauggggcaauggcugugggcuguucggaaagggcgggaucgugacaugcgcgauguuuacaugcaagaaaaacauggagggaaagguugugcagccugaaaaucucgaguauacgauugugaucacaccccauucuggcgaagagaacgccgucgggaaugacacaggaaaacacggcaaggagauuaaaaucaccccucaguccagcaucacagaagcugagcugauuggcuacgggaccgugacgauggaauguucuccccggaccggacuugauuucaacgagaugguucugcuccaaauggaaaauaaggccuggcuggugcaucgccagugguuucuugaccugccgcucccuuggcugcccggcgcugauacacagggguccaacuggauccagaaagagacccuggucacauucaagaacccucacgccaagaaacaagacgugguugugcucggaagccaggagggcgccaugcacaccgcucugacgggggcgacagaaauucagauguccucuggcaaucuucuguuuaccggacaucucaagugcagacugcggauggacaaacuucaacugaagggcaugagcuauuccauguguacagggaaauucaaggucgugaaggagaucgccgaaacccagcacggaaccauugucaucagagugcaguacgagggcgaugggagccccugcaaaauccccuucgagauuauggaccucgaaaagcgccauguucugggacggcugaucacagugaacccuauugucacggagaaagauucuccggugaauaucgaagcugagcccccuuuuggcgacuccuacauuaucauugggguugaacccggccagcucaagcugaacugguucaaaaagggaagcucuaucggccaaauguuugagaccacaaugagaggggccaagcgcauggccauccuuggagauaccgcuugggacuucggcagccucggcgggguguuuacauccauugggaaagcccuccaccaggucuucggggcgaucuauggcgcugccuuuucuggagugagcuggaccaugaagauucugaucggcgugguuauuacguggaucgggaugaacucccggagcacaucucuguccgucagccuugugcucgugggagucgugacccuguaccugggcguuauggugcaggccgauucugggugugucguguccuggaaaaacaaggagcucaaaugcggaagcggcaucuucguuaccgacaaugugcauacauggaccgaacaguauaaguuucaaccugagucccccucuaagcuggcuagcgccauucagaaagcucacgaagaggggaucuguggcauuagauccgucacacgccuugaaaaccugauguggaagcagaucacgccggagcucaaucacauucugucugagaacgaagugaaacugaccaucaugacaggagauaucaagggcauuaugcaggccgggaaacggagccuuagaccucaacccaccgagcucaaguacuccuggaaaacauggggaaaggcgaagaugcugagcaccgaacugcauaaucagacguuccucaucgacggcccugagaccgccgaaugccccaacacaaaucgcgcuuggaacucucuggagguugaggauuauggguuuggaguguucaccacaaauauuuggcuuaaacugaaggaacggcaggacgucuuuugugacuccaaacucaugagcgccgcuaucaaggauaacagagccgugcacgcggacaugggcuacuggauugagucugcccugaacgauaccuggaaaaucgaaaaggcuuccuucaucgaggugaaguccugccauuggccuaaaucucacacacuguggagcaauggcguccuugaguccgaaaugauuauccccaagaacuucgccgggccgguuagccagcacaauuaucgcccuggauaccauacccaaacggcuggccccuggcaccucgggaaacuggagauggacuuuaacuucugugaaggaacaaccgugguggucaccgaggauugcggcaaucgggggcccucucugagaacaaccacggccuccggaaagcucauuacagaauggugcugucggagcugcacccugccuccgcuucgcuacagaggcgaggacggcuguugguaugggauggagauccggccccugaaagaaaaggaggaaaaccucgucaauucccugguuacagccggacauggccagauugauaacuuuucucugggggugcuuggaauggcucucuuccuggaggaaaugcugagaacccgcgucggcacaaagcacgcgauccuccugguggccguuagcuuugugacccuuauuacggggaauauguccuuccgggaccugggaagagucauggugaugguuggcgcuaccaugacagaugacaucggcaugggggugaccuaccucgcccugcuggccgcuuuuaaaguccgcccuacauucgccgcgggacuucugcucagaaagcugaccucuaaagagcucaugaugacgacaaucggcauugugcugcuuagccaguccaccauccccgagacaauucuggaacucaccgaugcucuggcccuggggaugauggugcuuaagaucguccggaacauggagaaauaucaacuggccguuaccauuauggcuauccucugcgugccuaaugccgugauccugcagaacgcguggaaggucucuuguacaauucucgcugugguuagcgugagcccccugcuucugacgagcucucagcagaaggccgacuggaucccucucgcccugaccauuaaaggacugaaucccacagcuaucuuucuuaccacacugucccgcaccagcaagaaaagaucuuggccgcucaacgaagccauuauggcugucggcaugguguccauccuggccagcucucuccugaagaaugauaucccuaugacggggccccuuguugcgggaggccugcugacagugugcuacguccucaccggccgguccgccgaccuggagcuugaacgcgcugccgacgugagaugggaggaucaagcugagauuagcggguccagcccuauccugucuauuaccaucagcgaagacggauccaugucuauuaaaaacgaggaagaggagcagacacucaccauccugauucggacaggccuccuggucaucagcgggcuuuuccccguguccaucccgauuacggccgccgcuugguaucugugggaaguuaagaaacagcgcgcgggagugcugugggaugucccuucucccccucccgugggcaaggccgagcucgaagacggggcuuacagaaucaagcagaaaggcauucugggcuauagccaaaucggcgccgggguuuacaaggagggaaccuuucauacaauguggcacgugacccggggcgccguccuuaugcacaaagggaagcgcauugaacccuccugggcugaugugaaaaaggaccugaucucuuacggaggcggguggaagcucgagggagaguggaaagaaggcgaggaagugcagguucuggcccucgagccuggcaagaacccgagagcgguccagacaaaacccgggcuguucaagaccaauacgggaaccaucggcgcugugagccuugauuuuuccccugggacaagcggaucucccauuguggacaaaaagggcaaggucguggggcuguauggaaacggcguugugacccgguccggcacauacgucagcgccaucgcccagaccgaaaaaucuauugaggauaauccugagaucgaagacgauauuuucagaaagaaacgccugacaaucauggaccuccaucccggggcuggaaagacgaaacgguaucugccugccaucgugagagaggcgauuaagcgcggccuucggacccugauccucgcuccgacaagaguuguggccgccgaaauggaggaagcucugcgcgggcuccccauucgguaccaaaccccugccaucagagcugagcacaccggacgcgagauugucgaucugaugugucaugccacauucacgaugcggcuucugucccccgugagaguuccuaacuauaaucugaucauuauggacgaagcgcacuuuaccgaccccgccagcaucgcugcccggggcuacaucuccacacgcguggagaugggggaagcugccggcauuuucaugaccgccacaccgccuggaucuagagaucccuuuccccagagcaacgcuccuaucauggacgaggagcgggaaauucccgagcgcuccuggaauagcggccaugaaugggucaccgauuucaaggggaaaacggugugguuugugccuucuaucaaggcgggaaacgacauugccgcuugccuccgcaaaaauggcaagaaagucauccagcugucccggaagacauucgauagcgaguauaucaagaccagaaccaacgacugggauuuuguugugacaaccgacauuucugaaaugggggccaauuucaaagccgagcgcgugaucgauccgcggagauguaugaagcccgucauucuuacagacggagaggaacgcgugauccuggcuggcccuaugcccguuacccacagcuccgccgcgcaacggagagggcgcauuggccggaacccuaaaaaugagaacgaucaguacaucuacaugggagaaccccucgagaaugacgaagacugcgcucacuggaaggaggccaaaaugcugcuggauaacaucaacacgccggagggcauuaucccuucuauguuugaacccgagagagaaaagguggacgccauugauggggaguaucgccucagaggagaagcucggaaaacauucgucgaccuuaugcgcagaggcgaucugccuguguggcuggccuaccggguugcggccgaggggaucaauuaugcugaccgcagaugguguuuugauggaauuaagaacaaucagauccucgaggaaaacguggaggucgaaauuuggaccaaggagggcgagcggaaaaagcugaaacccagauggcuugacgcccgcaucuacagcgauccucuggcucucaaggaguucaaagaguucgccgcugggcggaagucccugacacugaaucucaucaccgaaauuggcagacuucccacguuuaugacccagaaggcccgcaacgcgcuggacaaucuggccgugcuccauacagcugaggccggaggccgggcuuauaaccacgcccugucugaacuuccggagacccuggagacacuccugcugcucacccuucuggccacagucaccgggggaaucuuccuguuucucaugagcggcaaagggauuggaaagaugacgcugggcaugugcugcaucauuacagcuuccauccuucugugguacgcgcaaauccagccucauuggauugccgcuagcaucauucucgaguucuuucugaucgugcugcucauucccgagcccgaaaaacagagaaccccucaggauaaucaacuuaccuauguugugaucgccauccugacaguggucgccgcuaccauggccaacgagaugggcuuccuggaaaagaccaaaaaggacuuugggcucggaucuauugcgacgcagcagccggaguccaauauccuggauauugaccuucggcccgccagcgcuuggacccuguacgccguugcuacaaccuucaucacaccuaugcuccgccacuccauugagaacucuagcgugaaugugucccugaccgccaucgcgaaccaggccacgguccugaugggccucgggaagggauggccccuuucuaaaauggacauuggcgugccucugcuggcuaucggguguuacagccaaguuaaucccaucacccucacagccgcucugcuucugcucguggcccacuaugcuauuaucggaccuggccugcaggccaaggcgaccagagaagcccagaaacgggcugccgcuggcauuaugaagaacccgacagucgaugggaucaccgugauugaccuggaucccaucccuuacgaccccaaauuugagaagcagcucggacaagucaugcuucuggugcugugcguuacacaggugcucaugaugcgcacaaccugggcccugugugaagcccuuacacuggcgaccggcccuaucuccacccucugggaggggaaucccggaagauucuggaacacaacgauugcugucagcauggccaacaucuuucggggcucuuaucuggcuggggccggacugcuguucuccauuaugaagaauaccgccaacacacgcagaggcaccggcaauacaggggaaacccuuggagagaaauggaagaaccggcugaaugcucugggcaaaagcgaguuucagaucuacaagaaaucugggauucaagaaguggaucgcacgcucgccaaggagggaaucaaaagaggcgaaacagaccaucacgcgguuucccgggggagcgccaagcugagaugguucguggagcgcaaccuugucaccccggagggaaaggugguggaucugggcugcggcagagggggauggucuuauuacuguggcgggcucaaaaauguuagagaagucaagggacugaccaaaggcgggccuggacaugaggaacccauccccaugagcacauauggcuggaaccuggugcgccuccaguccggcguggacgucuucuuuaccccucccgagaagugcgauacacuucugugugacauuggggaaucuagcccuaauccgacgaucgaggcuggacggacccugagaguucucaaccugguggagaauuggcuuaacaauaacacacaguucugcauuaaagugcugaaucccuacaugccuuccgucaucgaaaagauggaggcccuccagcgcaaguacggcggggcucuggugcggaacccccugagcagaaacuccacccacgaaauguauuggguuucuaaugccagcggaaacauuguguccucugucaauaugaucagccgcaugcucaucaaccgguuuacaaugagacauaaaaaggcgaccuacgagccugauguggaccuuggcuccgggacgcgcaauauuggaaucgaaucugagacccccaaccuggauauuaucggcaaacggauugagaagaucaaacaagaacacgagacaagcuggcacuaugaccaggaccauccguacaagaccugggccuaucacggcuccuacgaaacaaagcagaccgggagcgcuucuuccaugguuaauggaguggucagacugcucacaaaaccuugggaugugauucccaccgugacgcagauggccaugacagacaccaccccuuucggccaacagcgcgucuuuaaggagaaaguugauacaagaacgcaggaacccaaggaggggaccaaaaagcugaugaagaucacagcugaguggcuuuggaaagaacugggaaagaaaaagaccccucggauguguacacgcgaggaguucaccagaaaagugcggagcaacgccgcucucggcgccaucuuuacagacgagaauaaguggaaaucugcgagagaggccguggaagauucccgguucugggagcuggucgacaaggaacgcaaccugcaucucgaggggaagugcgaaaccuguguguauaauaugaugggaaaaagagagaagaaacugggcgaguuuggcaaggcuaaagggagccgggccauuugguacauguggcuuggagcucgcuuccuggaauuugaggcccucggcuuccugaacgaagaucacugguuuucuagagaaaauucccuuagcgggguugaaggagagggccugcacaagcucggguacauccugcgggacguguccaagaaagagggcggagccauguaugcggaugacacggcuggcugggauacccgcauuacacuggaagaccucaagaacgaggaaauggucaccaaucauauggagggggaacacaaaaagcuggccgaggccaucuucaaacuuacauaccagaacaaggugguuagagugcaacggcccaccccgcgcggaacggucauggacauuaucagcagacgggaucagcgcggcucuggacaggugggaacauauggccugaacaccuucacaaauauggaggcucaacucaucagacagauggaaggggagggcguuuuuaagagcauucagcaucugaccgugacggaagagaucgccguccagaacuggcuugcucgggugggacgcgagagacugucccggauggccauuucuggcgacgauugcgucgugaaaccucucgacgauagauucgcgagcgcccugaccgcucugaaugacauggggaagguucgcaaagauauccaacagugggaacccucccggggauggaacgacuggacacaggugcccuuuugcucucaccauuuccacgagcucauuaugaaggauggcagaguccugguggugccuugucgcaaucaggacgaacuuaucgggcgggccagaaucagccaaggagcuggcuggucccugcgcgagaccgccugccucgggaaaucuuacgcgcagauguggagccugauguauuuucaccggagagaucuucgccuggccgcuaacgccauuuguuccgcuguuccgagccauugggugcccacaucucggaccacaugguccauccacgccagacaugaauggaugaccacggaggacaugcucacagucuggaaucgcguguggauucaggagaacccuuggauggaagauaagacccccguugagagcugggaagagaucccuuaccugggcaagcgggaagaccaguggugcggaucucugauuggccucaccuccagagcuacaugggccaaaaauauccaaaccgcgauuaaccaggugcggagccugaucgggaaugaggaguauacagacuacaugcccuccaugaagagauuccgccgggaagaggaagaggccggaguccuuugguga

SEQ ID NO: 20279 - RNA, 9876 nt, Artificial Sequence
  derived and/or modified CDS sequence (opt5) from DENV-2__GQ398262__SS-prME
accgccggaaugaucauuaugcugauccccaccgugauggcuuuccaccucacgaccagaaauggggaaccucauaugauugugagccggcaggaaaagggaaaaucccugcuuuuuaagacggaagacggaguuaauaugugcacccugauggccauggaucucggggaacugugugaagacacaaucaccuacaacugcccgcuucugcgccaaaaugaacccgaagauauugacuguuggugcaacucuacaagcaccugggugacguauggaaccuguacagcgaccggcgagcacagacgggaaaaacgcuccguggcucucgucccucauguggggaugggacuggagacaagaaccgaaacguggaugucuagcgagggcgccuggaagcacgcccagcggaucgagacauggauccugcgccaucccggcuucaccauuauggcugccauccucgcuuacacaauugggaccaccuauuuucagagaguucugaucuucauucuucugacagccguggcgccuuccaugacgaugcggugcaucggaauuucuaaucgcgauuuugucgaaggcgugagcgggggauccuggguugacaucgugcucgagcacggcagcugugucaccacaauggccaaaaacaagcccacccuggauuucgaacuuaucaagacagaggcuaaacagccugccacccugagaaaguacugcauugaagcuaaacucacgaauacaaccaccgccucucgguguccgacacaaggggagcccucccugaacgaggaacaggacaagcgcuuugugugcaaacacagcaugguggauagaggauggggcaauggcugugggcuguucggaaagggcgggaucgugaccugcgcgauguuuacaugcaagaaaaacauggagggaaagguugugcagccugaaaaucucgaguauacgauugugaucacaccccauucuggcgaagagaacgccgucgggaaugacacaggaaaacacggcaaggagauuaaaaucaccccucaguccagcaucacagaagcugagcugaccggcuacgggacggugaccauggaauguucuccccggacaggacuugauuucaacgagaugguucugcuccaaauggaaaauaaggccuggcuggugcaucgccagugguuucuugaccugccgcucccuuggcugcccggcgcugauacccagggguccaacuggauucagaaagagacacuggucaccuucaagaacccucacgccaagaaacaagacgugguugugcucggaagccaggagggcgccaugcacacggcucugacaggggcgaccgaaauccagauguccucuggcaaucuucuguuuacaggacaucucaagugcagacugcggauggacaaacuucaacugaagggcaugagcuauuccauguguaccgggaaauucaaggucgugaaggagauugccgaaacccagcacggaacaaucgucauuagagugcaguacgagggcgaugggagccccugcaaaauccccuucgagaucauggaccucgaaaagcgccauguucugggacggcugauuacggugaacccuaucgucaccgagaaagauucuccggugaauauugaagcugagcccccuuuuggcgacuccuacaucauuaucgggguugaacccggccagcucaagcugaacugguucaaaaagggaagcucuauuggccaaauguuugagacaaccaugagaggggccaagcgcauggccauccuuggagauacagcuugggacuucggcagccucggcgggguguuuaccuccaucgggaaagcccuccaccaggucuucggggcgauuuauggcgcugccuuuucuggagugagcuggacgaugaagauccugauuggcgugguuaucacauggauugggaugaacucccggagcaccucucuguccgucagccuugugcucgugggagucgugacccuguaccugggcguuauggugcaggccgauucugggugugucguguccuggaaaaacaaggagcucaaaugcggaagcggcaucuucaucacagacaauguucauaccuggacagaacaguauaaguuucaaccugagucccccucuaagcuggcuagcgccauucagaaagcucacgaagaggggaucuguggcauuagauccgugacgcgccuugaaaaccugauguggaagcagaucaccccggagcucaaucacauucugucugagaacgaaguccggcugacaaucaugaccggagauaucaaaggcauuaugcaggccgggaagagaagccuucgcccucaacccacagagcucaaauacuccuggaagaccuggggaaaagcgaagaugcugagcacggaacugcauaaucagaccuuccucaucgacggcccugagacagccgaaugccccaacaccaaucgggcuuggaacucucuggagguggaggauuauggguuuggaguuuucacaaccaauauuuggcuuaagcugaaagaaagacaggacguguuuugugacuccaagcucaugagcgccgcuaucaaagauaaccgcgccguccacgcggacaugggcuacuggauugagucugcccugaacgauacauggaagaucgaaaaggcuuccuucaucgaggucaaauccugccauuggccuaagucucacacccuguggagcaauggcgugcuugaguccgaaaugauuauccccaaaaacuucgccgggccggucagccagcacaauuaucggccuggauaccauacgcaaacagcuggccccuggcaccucgggaagcuggagauggacuuuaacuucugugaaggaaccaccguuguggugacagaggauugcggcaauagagggcccucucugcggaccacgacagccuccggaaaacucauuaccgaauggugcugucgcagcugcacacugccuccgcuuagauaccggggcgaggacggcuguugguaugggauggagaucagaccccugaaggaaaaagaggaaaaccucgucaauucccuggugaccgccggacauggccagauugauaacuuuucucuggggguucuuggaauggcucucuuccuggaggaaaugcugcgcacacgggugggcaccaagcacgcgauccuccuggucgccgugagcuuuguuacgcuuauuaccgggaauauguccuucagagaccugggacgcgugauggucauggugggcgcuacaaugaccgaugacaucggcauggggguuacauaccucgcccugcuggccgcuuuuaaggugagaccuaccuucgccgcgggacuucugcuccggaaacugacgucuaaggagcucaugaugacaaccaucggcauuguccugcuuagccaguccacaauccccgagaccauucuggaacucaccgaugcucuggcccuggggaugauggugcuuaaaaucgugcgcaacauggagaaguaucaacuggccgucacaauuauggcuauccucugcguuccuaaugccgugauccugcagaacgcguggaaagugucuuguacgauucucgcugucgugagcguuagcccccugcuucugaccagcucucagcagaaggccgacuggaucccucucgcccugacaauuaagggacugaaucccaccgcuaucuuucuuacaacccuguccagaacgagcaaaaagcggucuuggccgcucaacgaagccauuauggcugugggcauggucuccauccuggccagcucucuccugaaaaaugauaucccuaugacagggccccuuguggcgggaggccugcugaccguuugcuacgugcucaccggccgcuccgccgaccuggagcuugaaagagcugccgacguccggugggaggaucaagcugagauuagcggguccagcccuauccugucuauuacaaucagcgaagacggauccaugucuauuaagaacgaggaagaggagcagacccucacaauccugauucgcacgggccuccuggugaucagcgggcuuuuccccgucuccaucccgauuaccgccgccgcuugguaucugugggaagugaaaaagcagagagcgggaguucugugggaugugccuucucccccucccgucggcaaagccgagcucgaagacggggcuuaccggaucaagcagaagggcauucugggcuauagccaaaucggcgccgggguguacaaagagggaacauuucauaccauguggcacguuacacgcggcgccgugcuuaugcacaaggggaaaagaauugaacccuccugggcugaugucaagaaagaccugaucucuuacggaggcggguggaagcucgagggagaguggaaggaaggcgaggaaguccaggugcuggcccucgagccuggcaaaaacccgcgggcgguucagaccaagcccgggcuguucaaaacgaauaccggaacaaucggcgcugucagccuugauuuuuccccugggaccagcggaucucccauuguggacaagaaaggcaagguggucgggcuguauggaaacggcgugguuacaagauccggcaccuacgugagcgccaucgcccagacagaaaagucuauugaggauaauccugagaucgaagacgauauuuuccgcaaaaagcggcugacgaucauggaccuccaucccggggcuggaaaaaccaagagauaucugccugccaucguccgcgaggcgauuaaacggggccuuagaacacugauccucgcuccgacccgcgugguugccgccgaaauggaggaagcucugcgggggcuccccauuagauaccaaaccccugccauccgcgcugagcacacaggacgggagauuguggaucugaugugucaugccacguucaccaugagacuucugucccccguccgggugccuaacuauaaucugaucauuauggacgaagcgcacuuuacagaccccgccagcaucgcugcccgcggcuacaucuccaccagaguugagaugggggaagcugccggcauuuucaugacagccaccccgccuggaucucgggaucccuuuccccagagcaacgcuccuaucauggacgaggagcgcgaaauucccgagagauccuggaauagcggccaugaaugggugacggauuucaaggggaagacagucugguuugugccuucuaucaaagcgggaaacgacauugccgcuugccuccggaagaauggcaaaaaggugauccagcuguccagaaaaaccuucgauagcgaguauaucaagacccgcacaaacgacugggauuuugucguuaccacagacauuucugaaaugggggccaauuucaaggccgagcgggugaucgauccgagacgcuguaugaaacccgugauucuuaccgacggagaggaacgggucauccuggcuggcccuaugcccgugacgcacagcuccgccgcgcaaagacgcgggcggauuggcagaaacccuaagaaugagaacgaucaguacaucuacaugggagaaccccucgagaaugacgaagacugcgcucacuggaaagaggccaagaugcugcuggauaacaucaacacaccggagggcauuaucccuucuauguuugaacccgagcgcgaaaaaguugacgccauugauggggaguauagacuccggggagaagcucgcaagaccuucguggaccuuaugagacggggcgaucugccugucuggcuggccuaccgcguggcggccgaggggaucaauuaugcugacagacggugguguuuugauggaauuaaaaacaaucagauccucgaggaaaacguugagguggaaauuuggacaaaggagggcgagagaaagaaacugaagccccgcuggcuugacgcccggaucuacagcgauccucuggcucucaaagaguucaaggaguucgccgcugggagaaaaucccugacccugaaucucaucacggaaaugggccgccuucccaccuuuaugacacagaaggcccggaacgcgcuggacaaucuggccguccuccauaccgcugaggccggaggcagagcuuauaaccacgcccugucugaacuuccggagacacuggagacccuccugcugcucacacuucuggccaccgugacagggggaauuuuccuguuucucaugagcggcaaggggaucggaaaaaugacacugggcaugugcugcauuaucaccgcuuccauucuucugugguacgcgcaaauccagccucauuggaucgccgcuagcauuauccucgaguucuuucugauuguccugcucauccccgagcccgaaaagcagcggaccccucaggauaaucaacuuacauaugugguuauugccauccugaccgugguggccgcuacaauggccaacgagaugggcuuccuggagaagacgaagaaagacuuugggcucggaucuaucgcgacccagcagccggaguccaauauucuggauaucgaccuucgccccgccagcgcuuggacacuguacgccgucgcuaccacauucauuaccccuaugcucagacacuccaucgagaacucuagcguuaaugugucccugacggccauugcgaaccaggccaccgugcugaugggccucgggaagggauggccccuuucuaagauggacaucggcgucccucugcuggcuauuggguguuacagccaagugaaucccaucacacucaccgccgcucugcuucugcucguugcccacuaugcuaucauuggaccuggccugcaggccaaagcgacacgggaagcccagaagcgcgcugccgcuggcaucaugaaaaacccgaccguggaugggauuacggucaucgaccuggaucccauuccuuacgaccccaaguuugagaaacagcucggacaagugaugcuucugguccugugcgugacacagguucucaugaugagaaccacaugggcccugugugaagcccuuacccuggcgaccggcccuaucuccacacucugggaggggaaucccggacgguucuggaacacgaccaucgcugugagcauggccaacauuuuucgcggcucuuaucuggcuggggccggacugcuguucuccaucaugaagaauacagccaacaccagacggggcacaggcaauaccggggaaacgcuuggagagaaguggaaaaaccgccugaaugcucugggcaagagcgaguuucagauuuacaaaaagucugggauccaagaagucgauagaacacucgccaaagagggaauuaagcggggcgaaaccgaccaucacgcgguguccagagggagcgccaaacugcgcugguucguugagcggaaccuugugaccccggagggaaaggucguggaucugggcugcggcagagggggauggucuuauuacuguggcgggcucaagaaugugcgcgaaguuaaaggacugacaaagggcgggccuggacaugaggaacccauccccaugagcaccuauggcuggaaccugguccggcuccaguccggcguggacguguucuuuacaccucccgagaaaugcgauacgcuucugugugacaucggggaaucuagcccuaauccgaccgucgaggcuggaagaacacugcgcguucucaaccugguggagaauuggcuuaacaauaacacccaguucugcauuaaggugcugaaucccuacaugccuuccgucaucgagaaaauggaggcccuccagcggaaguacggcggggcucuggugagaaacccccugagccgcaacuccacacacgaaauguauuggguuucuaaugccagcggaaacauuguguccucugucaauaugaucagccggaugcucauuaacagauuuaccaugcgccauaagaaagcgacguacgagccugauguggaccuuggcuccgggacccggaauaucggaaucgaaucugagacacccaaccuggauauuaucggcaagagaauugagaaaaucaagcaagaacacgagaccagcuggcacuaugaccaggaccauccguacaaaacaugggccuaucacggcuccuacgaaaccaagcagacagggagcgcuucuuccaugguuaauggagugguccgccugcucaccaagccuugggaugugauucccauggugacgcagauggccaugacagacaccaccccuuucggccaacagagagucuuuaaagagaagguugauacacggacgcaggaacccaaagaggggaccaagaaacugaugaagaucacagcugaguggcuuuggaaggaacugggcaaaaagaaaaccccucgcauguguacaagagaggaguucacccggaaggugagaagcaacgccgcucucggcgccauuuuuacagacgagaauaaauggaagucugcgcgggaggccguggaagauucccgcuucugggagcuggucgacaaagaaagaaaccugcaucucgaggggaagugcgaaaccuguguguauaauaugaugggaaagcgggagaaaaagcugggcgaguuuggcaaagcuaaggggagccgcgccaucugguacauguggcuuggagcuagauuccuggaauuugaggcccucggcuuccugaacgaagaucacugguuuucucgggaaaauucccuuagcgggguugaaggagagggccugcacaaacucggguacauccugcgcgacguguccaagaaggagggcggagccauguaugcggaugacacggcuggcugggauaccagaauuacacuggaagaccucaaaaacgaggaaauggucaccaaucauauggagggggaacacaagaaacuggccgaggccaucuucaaacuuacauaccagaacaaagugguucgggugcaacgccccaccccgagaggaacggucauggacauuaucagccggcgcgaucagagaggcucuggacaggugggaacauauggccugaacaccuucacaaauauggaggcucaacucauucggcagauggaaggggagggcguuuuuaagagcauccagcaucugaccgugacggaagagaucgccguccagaacuggcuugcucgcgugggaagagagcggcuguccagaauggccauuucuggcgacgauugcgucgugaagccucucgacgaucgcuucgcgagcgcccugaccgcucugaaugacauggggaaaguucggaaggauauccaacagugggaacccuccagaggauggaacgacuggacacaggugcccuuuugcucucaccauuuccacgagcucauuaugaaagauggccgcguccugguggugccuugucggaaucaggacgaacuuaucgggagagcccgcauuagccaaggagcuggcuggucccugcgggagaccgccugccucgggaagucuuacgcgcagauguggagccugauguauuuucacagacgcgaucuucggcuggccgcuaacgccaucuguuccgcuguuccgagccauugggugcccacaucuagaaccacaugguccauccacgcccgccaugaauggaugaccacggaggacaugcucacagucuggaaucggguguggauucaggagaacccuuggauggaagauaaaacccccguugagagcugggaagagaucccuuaccugggcaagagagaagaccaguggugcggaucucugauuggccucaccucccgggcuacaugggccaagaauauccaaaccgcgauuaaccaggugagaagccugaucgggaaugaggaguauacagacuacaugcccuccaugaaacgcuuccggagagaagaggaagaggccggaguccuuugguga

SEQ ID NO: 20280 - RNA, 9876 nt, Artificial Sequence
  derived and/or modified CDS sequence (opt5) from DENV-2__GQ398261__SS-prME
accgccggcaugaucauuaugcugauccccacagugauggcuuuccaccucacgacccggaauggggagccucauaugauugucagccggcaggaaaagggaaaaucccugcuuuuuaagacagaggacggcguuaauaugugcacccugauggccauggaucucggggaacugugugaggacacaaucaccuacaauugcccgcuucugagacaaaaugaacccgaggauauugacuguuggugcaacucuacaagcaccuggaucacguauggaaccuguacagcgaccggcgagcacagacgggaaaaacgcuccguggcucucgugccucaugucgggaugggacuggagacaagaaccgaaacguggaugucuagcgagggcgccuggaagcacgcccagcggaucgagacauggauucugcgccaucccggcuucaccaucauggcugccauucucgcuuacacaaucgggaccaccuauuuucagagagugcugauuuucauccuucugacagccguugcgccuuccaugacgaugcggugcauuggaaucucuaaucgcgauuuuguggaaggcgucagcgggggauccuggguggacaucguucucgagcacggcagcugugugaccacaauggccaaaaacaagcccacccuggauuucgaacuuauuaagacagaggcuaaacagccugccacccugagaaaguacugcaucgaagcuaaacucacgaauacaaccaccgccucucgguguccgacacaaggggagcccucccugaacgaggaacaggacaagcgcuuugucugcaaacacagcaugguggauagaggauggggcaauggcugugggcuguucggaaagggcgggauugugaccugcgcgauguuuacaugcaagaaaaacauggagggaaaggucguucagccugaaaaucucgaguauacgaucgugauuacaccccauucuggcgaagagaacgccguggggaaugacacaggaaaacacggcaaggagaucaaaaucaccccucaguccagcauuacagaagcugagcugaccggcuacgggacggucaccauggaauguucuccccggacaggacuugauuucaacgagauggugcugcuccaaauggaaaauaaggccuggcugguucaucgccagugguuucuugaccugccgcucccuuggcugcccggcgcugauacccagggguccaacuggauccagaaagagacacuggugaccuucaagaacccucacgccaagaaacaagacgucgugguucucggaagccaggagggcgccaugcacacggcucugacaggggcgaccgaaauucagauguccucuggcaaucuucuguuuacaggacaucucaagugcagacugcggauggacaaacuucaacugaagggcaugagcuauuccauguguaccgggaaauucaagguggucaaggagaucgccgaaacccagcacggaacaauuguggucagagugcaguacgagggcgaugggagccccugcaaaauccccuucgagaucauggaccucgaaaagcgccauguucugggacggcugauuacggugaacccuaucgucaccgagaaagauucuccggugaauauugaagcugagcccccuuuuggcgacuccuacaucauuaucgggguugaacccggccagcucaagcugaacugguucaaaaagggaagcucuauuggccaaauguuugagacaaccaugagaggggccaagcgcauggccauccuuggagauacagcuugggacuucggcagccucgggggaguguuuaccuccaucggcaaagcccuccaccaggucuucggggcgauuuauggcgcugccuuuucuggagugagcuggacgaugaagauccugauuggcgugguuaucacauggauugggaugaacucccggagcaccucucuguccgucagccuugugcucgugggagucgugacccuguaccugggcguuauggugcaggccgauucugggugugucguguccuggaaaaacaaggagcucaaaugcggaagcggcaucuucguuacagacaaugugcauaccuggacagaacaguauaaguuucaaccugagucccccucuaagcuggcuagcgccauccagaaagcucacgaagaggggauuuguggcaucagauccgucacgcgccuugaaaaccugauguggaagcagauuaccccggagcucaaucacauccugucugagaacgaagugaaacugacaauuaugaccggagauaucaagggcaucaugcaggccgggaaacggagccuuagaccucaacccacagagcucaaguacuccuggaaaaccuggggaaaggcgaagaugcugagcacggaacugcauaaucagaccuuccucauugacggcccugagacagccgaaugccccaacaccaaucgcgcuuggaacucucuggagguugaggauuauggguuuggaguguucacaaccaauaucuggcuuaaacugaaggaacggcaggacgucuuuugugacuccaaacucaugagcgccgcuauuaaggauaacagagccgugcacgcggacaugggcuacuggaucgagucugcccugaacgauacauggaaaauugaaaaggcuuccuucaucgaggucaagagcugccauuggccuaaaucucacacccuguggagcaauggcgugcuugaguccgaaaugaucauucccaagaacuucgccgggccgguuagccagcacaauuaucgcccuggauaccauacgcaaacagcuggccccuggcaccucgggaaacuggagauggacuuuaacuucugugaaggaaccaccgugguggucacaggcgauugcgggaaucggggacccgcccugagaaccacgacagccucuggcaagcucaucaccgaguggugcugucgguccugcacacugccuccgcuucgcuacagaggcgaagacggguguugguauggaauggagauucggccccugaaagagaaggaagagaaccucgugaauagccugguuaccgcuggccaugggcagaucgauaacuuuucccugggagugcuuggcauggcgcuguuccuggaagagaugcugagaacacgcgucgggaccaagcacgccauucuccugguggcuguuucuuuugugacgcuuaucaccggaaauaugagcuuccgggaccugggcagagucauggugaugguuggcgccacaaugaccgaugacauugggaugggagugacauaccucgcccugcuggcugccuuuaaaguccgcccuaccuucgcggcuggccuucugcucagaaagcugacguccaaagaacucaugaugacaaccaucgggaucgugcugcuuucucagagcacaauucccgagaccauccuggagcucaccgaugcccuggcccugggaaugauggugcuuaagauuguccggaacauggaaaaauaucaacuggcuguuacaaucauggccauucucugcgugccuaaugcggugauccugcagaacgcuuggaaggucuccuguacgauccucgccgugguuucugugagcccccugcuucugaccuccagccagcagaaggccgacuggauuccucucgcucugacaaucaaaggccugaaucccaccgccauuuuucuuacaacccugucucgcacguccaagaaaagaagcuggccgcucaacgaggcuaucauggccgucgggauggugucuauucuggcguccagccuccugaagaaugauaucccuaugacaggaccccuuguugccggcggccugcugaccgugugcuacguccucaccgggcggucugcugaccuggaacuugagcgcgccgcugacgugagaugggaagaucaagccgagaucuccggaagcuccccuauucugagcaucacaauuucugaggacggcagcauguccaucaaaaacgaagaggaagaacagacccucacaauucugauccggacggggcuccuggucauuucuggacuuuuccccgugagcaucccgaucaccgccgcugcgugguaucugugggagguuaagaaacagcgcgccggcgugcugugggaugucccuucucccccucccguggggaaggcugaacucgaggacggagccuacagaauuaagcagaaaggcauccugggcuauagccaaauuggggccggaguuuacaaggaaggcacauuucauaccauguggcacgugacaagaggggcuguccuuaugcacaaaggaaagcgcaucgagcccagcugggccgaugugaaaaaggaccugauuuccuacggcgggggauggaagcucgaaggcgaguggaaagagggcgaagaggugcagguucuggcgcucgaaccugggaagaacccgagagcuguccagaccaaacccggacuguucaagacgaauaccggcacaaucggggccgugucucuugauuuuagcccuggaaccuccggcagccccaucguggacaaaaaggggaaggucgugggacuguauggcaacggcguugugacacggucugggaccuacgucuccgccauugcucagacagagaaaagcaucgaagauaauccugagauugaggacgauaucuucagaaagaaacgccugacgauuauggaccuccaucccggagccggcaagaccaaacgguaucugccugcgaucgugagagaagcuaucaagcgcgggcuucggacacugauucucgccccgaccagaguuguggccgcugagauggaagaggcccugcgcggacuccccauccgguaccaaaccccugcuauuagagccgaacacacaggccgcgagaucgucgaucugaugugucaugcgacguucaccaugcggcuucugucucccgugagaguuccuaacuauaaucugauuaucauggacgaggcccacuuuacagaccccgcuuccauugccgcucggggguacaucagcacccgcguggaaaugggcgaggccgccggaaucuucaugacagcuaccccgccuggcuccagagaucccuuuccccagucuaacgcgccuauuauggacgaggaacgggagauccccgaacgcagcuggaacuccgggcaugagugggucacggauuucaagggaaaaacagugugguuugugccuagcauuaaggccggcaacgacaucgcugccugccuccgcaaaaaugggaagaaagucauucagcugucucggaagaccuucgauuccgaauauaucaagaccagaacaaacgacugggauuuuguugugaccacagacaucagcgagaugggagccaauuucaaagcugaacgcgugauugauccgcggagauguaugaagcccgucauccuuaccgacggcgaggagcgcgugauucuggccgggccuaugcccguuacgcacucuagcgcggcucaacggagaggccgcaucggacggaacccuaaaaaugaaaacgaucaguacauuuacaugggcgagccccucgaaaaugacgaggacugcgcccacuggaaggaagccaaaaugcugcuggauaacaucaacacaccggaggggaucauuccuuccauguuugagcccgaaagagagaagguggacgcuaucgauggagaauaucgccucagaggcgaggcccggaaaaccuucgucgaccuuaugcgcagaggggaucugccuguguggcuggcguaccggguugccgcugaaggaauuaauuaugccgaccgcagaugguguuuugauggcaucaagaacaaucagauucucgaggagaacguggaagucgagaucuggacaaaggaaggggagcggaaaaagcugaaacccagauggcuugacgcucgcauuuacucugauccucuggcccucaaggaguucaaagaguucgcugccggccggaagucccugacccugaaucucaucacggagaucggaagacuucccaccuuuaugacacagaaggcgcgcaacgcccuggacaaucuggcugugcuccauaccgccgaagcuggcgggcgggccuauaaccacgcccuguccgagcuuccggaaacacuggagacccuccugcugcucacacuucuggcuaccgucacgggaggcauuuuccuguuucucaugucugggaaaggaaucggcaagaugacacugggcaugugcugcauuaucaccgcgagcauucuucugugguacgcccaaauccagccucauuggaucgcugccuccauuauccucgaguucuuucugauugugcugcucauccccgaacccgagaaacagagaaccccucaggauaaucaacuuacauauguugugauugccauccugaccguggucgcugccacaauggcgaacgaaaugggguuccuggagaagacgaaaaaggacuuuggacucggcagcaucgccacccagcagccggaaucuaauauucuggauaucgaccuucggcccgcuuccgccuggacacuguacgcuguugccaccacauucauuaccccuaugcuccgccacagcaucgagaacuccucugugaaugugagccugacggcgauugccaaccaggcuaccguccugauggggcucggaaagggcuggccccuuuccaaaauggacaucggggugccucugcuggccauuggauguuacucucaaguuaaucccaucacacucaccgcugcccugcuucugcucguggcucacuaugccaucauuggcccuggccugcaggcgaaggccacaagagaggcucagaaacgggccgcugccgggaucaugaagaacccgaccgucgauggaauuacggugaucgaccuggaucccauuccuuacgaccccaaauuugaaaagcagcucggccaagucaugcuucuggugcugugcguuacacaggugcucaugaugcgcaccacaugggcccugugugaggcgcuuacccuggcuaccgggccuaucagcacacucugggaaggaaaucccggcagauucuggaacacgaccaucgccgucuccauggcuaacauuuuucgggggagcuaucuggccggagccggccuccuguucucuaucaugaagaauacagcuaacacccgcagaggcacagggaauaccggagagacgcuuggcgaaaaauggaagaaccggcugaaugcccuggggaaauccgaguuucagauuuacaagaaaagcggaauccaagagguggaucgcacacucgcgaaggaaggcauuaaaagaggggagaccgaccaucacgccguuucucggggauccgcuaagcugagaugguucguggaacgcaaccuugucaccccggagggcaaggugguggaucugggcugcgggcggggaggcuggagcuauuacugugggggacucaaaaauguuagagaggucaagggccugacaaaagggggaccuggccaugaggaacccauccccaugucuaccuauggcuggaaccuggugcgccuccagagcgggguggacgucuucuuuacaccucccgaaaagugcgauacgcuucugugugacaucggagaguccucuccuaauccgaccauugaagccggccggacacugagaguucucaaccugguggagaauuggcuuaacaauaacacccaguucugcaucaaagugcugaaucccuacaugccuagcgucauugagaagauggaagcucuccagcgcaaguacgggggagcccuggugcggaacccccuguccagaaacagcacacacgagauguauuggguuuccaaugcgucuggcaacaucgugagcuccgucaauaugauuucucgcaugcucaucaaccgguuuaccaugagacauaaaaaggccacguacgaaccugauguggaccuugggagcggaacccgcaauaucggcauugaguccgaaacacccaaccuggauaucauuggcaaacggaucgagaagauuaaacaagagcacgaaaccucuuggcacuaugaccaggaccauccguacaagacaugggcuuaucacgggagcuacgagaccaagcagacaggauccgccagcucuaugguuaauggcguggucagacugcucaccaaaccuugggaugugauccccacggugacacagauggcuaugaccgacaccacaccuuucgggcaacagcgcgucuuuaaggaaaaaguugauacgagaacccaggagcccaaggaaggaaccaaaaagcugaugaagauuaccgccgaguggcuuuggaaagagcugggcaagaaaaagacaccucggauguguacccgcgaagaguucacaagaaaagugcgguccaacgcugcccucggggcgaucuuuaccgacgaaaauaaguggaaaagcgccagagaggcuguggaggauucucgguucugggaacuggucgacaaggagcgcaaccugcaucucgaaggaaagugcgagacguguguguauaauaugaugggcaaaagagaaaagaaacugggcgaguuugggaaggccaaaggaucccgggcuaucugguacauguggcuuggcgcccgcuuccuggaguuugaagcccucggguuccugaacgaggaucacugguuuagcagagaaaauucucuuuccggaguugagggcgaagggcugcacaagcucggcuacauucugcgggacgugagcaagaaagagggaggcgcgauguaugcugaugacaccgccgggugggauacacgcaucacccuggaggaccucaagaacgaagagauggucacaaaucauauggaaggagagcacaaaaagcuggccgaagcuauuuucaaacuuaccuaccagaacaaggugguuagagugcaacggcccacgccgcgcggcacagucauggacaucauuuccagacgggaucagcgcgggagcggacaggugggcaccuaugggcugaacacauucaccaauauggaggcccaacucaucagacagauggagggcgaaggaguuuuuaagucuauccagcaucugacggugaccgaggaaauugcuguccagaacuggcuugcccgggugggccgcgagagacugagccggauggcgaucuccggggacgauugcgucgugaaaccucucgacgauagauucgccucugcucugacagcccugaaugacaugggaaagguucgcaaagauauucaacagugggagcccagccggggcuggaacgacuggacccaggugcccuuuugcucccaccauuuccacgaacucaucaugaaggaugggagaguccugguggugccuugucgcaaucaggacgagcuuauuggacgggcuagaaucucucaaggcgccggguggagccugcgcgaaacagcgugccucggcaaauccuacgcccagauguggucucugauguauuuucaccggagagaucuucgccuggcugccaacgcuaucuguagcgccguuccgucccauugggugcccaccagccggacaaccuggucuauucacgcuagacaugaguggaugacgacagaagacaugcucaccgucuggaaucgcguguggauccaggagaacccuuggauggaggauaagacccccguugaauccugggaggaaauuccuuaccugggaaagcgggaggaccaguggugcggcagccugaucgggcucacaucuagagccaccugggcgaaaaauauucaaacagccaucaaccaggugcggucccugauuggaaaugaagaguauacggacuacaugcccagcaugaagagauuccgccgggaggaagaggaagcuggcguccuuugguga

SEQ ID NO: 20281 - RNA, 9876 nt, Artificial Sequence
  derived and/or modified CDS sequence (opt5) from DENV-2__GQ398313__SS-prME
accgcgggagugaucauuaugcugauccccaccgcuauggccuuccaccucacgacccggaacggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccugguggcuguuuccuuugugacgcuuaucaccggaaacaugucuuuccgggaccugggcagagucauggugaugguuggcgccacaaugaccgaugacaucgggaugggaauuacauaucucgcccugcuggcugccuuuaaggugcgcccuaccuucgcggcuggccuucugcucagaaaacugacgagcaaggagcucaugauggccacaaucgggauugcccugcuuucccagucuaccauccccgaaacaauucuggagcucaccgaugcucuggcccugggaaugaugguccuuaaaaucgugcggaauauggaaaaguaccagcuggcgguuaccaucauggcuauuagcugcgugccuaacgccgucauccuccaaaaugccuggaagguguccuguacaauucuggcugccgugagcgucucuccccuccugcuuacguccagccagcagaaagcugacuggaucccucuggcccucaccauuaagggccugaaccccacagcgaucuuucugaccacacuuucucgcaccuccaaaaagagaagcuggccgcugaaugaggccguuauggcuguggggauggugucuauccucgccuccagccugcucaaaaacgacauuccuaugacgggaccccuggucgcuggcggccuucugacagugugcuauguucugaccgggcgguccgccgaucucgaacuggagcgcgccgcugacgugaagugggaggaucaggcggaaaucagcggaucuagcccuauucuuuccaucaccauuucugaggacggcagcauguccaucaaaaaugaagaggaggaacaaacacugaccauucucaucagaacagggcugcucgucaucucuggaguguuccccguuagcauuccgaucacggccgcugccugguaccugugggaggugaagaagcagcgggccggcguccuuugggaugugccuucucccccucccgucgggaaagcugaacuggaggacggagccuaucgcauuaagcagagaggcauccugggcuacagccagauuggggcgggaguguauaaagaaggcaccuuucacacaauguggcauguuaccagaggggcugugcucaugcaccgcggaaagagaaucgagcccagcugggccgaugucaaaaaggaccugaucuccuacggcgggggauggaaacuugagggcgaauggaaagagggcgaagaggugcaaguucuggcccucgaaccugggaagaacccgcgggcugugcagacaaaacccggacuguucaagaccaauacgggcaccauuggggccgucagccucgauuuuucuccuggaacauccggcagccccaucguggacagaaaagggaaggugguuggacuguacggcaacggcgucgugacccgcucuggggcguauguguccgcuauugcccagacagaaaagagcaucgaggauaauccugaaauugaggacgauaucuuccggaaaaagagacuuaccaucauggaccugcaucccggagccggcaaaacaaagcgcuaccugccugcuauuguccgggaagccaucaaaagagggcuccgcacgcugauucuugcuccgacccgggugguugccgcggagauggaagaggcccugagaggacuccccauccgcuaucagaccccugcuauucgggccgagcacaccggcagagaaaucguggaccugaugugucaugcuaccuucacaaugcggcuccugucccccguccgcgugccuaacuacaaccuuauuaucauggaugaggcccacuuuacggaccccgccucuaucgcugcgagaggguauauuagcacccggguugaaaugggcgaggccgcuggaaucuucaugacagccaccccgccuggcucccgcgaucccuuuccccaaagcaaugccccuauuauggacgaggaaagagagauccccgaacggucuuggaacuccgggcacgagugggugacagauuucaagggaaagaccgucugguuugugccuagcauuaaagcuggcaaugacaucgccgcgugccugagaaagaacgggaaaaagguuauccagcugucucgcaaaacguucgauagcgaauacgugaagacacgggcuaaugacugggauuuugucgugaccaccgacauuuccgagaugggagccaacuucaaggccgagagagugaucgauccgcgccgguguaugaaacccgucauucucacagacggcgaagagagaguuauccuggcugggccuaugcccgugacccauucuagcgccgcgcagcgccggggcagaauuggacgcaauccuaagaacgaaaaugaccaauauaucuacaugggcgagccccuugaaaacgaugaggacugcgcccacuggaaagaggcuaagaugcugcucgauaauaucaacacaccggaagggauuaucccuuccauguuugagcccgaaagagagaaaguggacgccauugauggagaauaccggcugcgcggcgaggcuagaaagaccuucgucgaccugaugcggcgcggggaucucccuguguggcuugccuauagaguugcugccgagggaaucaauuacgcggaccggagaugguguuuugauggcauuaaaaacaaucagauccuggaagagaacguggaagucgagauuuggacgaaggagggggaacgcaagaaacugaagccccgguggcucgacgccagaaucuauucugauccucuggcucuuaaagaguucaaggaguucgccgcuggccgcaaaagccugacacucaaccugaucaccgagaugggacggcugcccacauuuaugacccagaaggccagagacgcccucgauaaucuugcugugcugcauacggcggaagccggcgggcgggcuuacaaccacgcccuguccgagcucccggagacccuggaaacacuucugcuccugacccugcucgccacaguuaccggaggcauuuuccuuuuucugaugagcgggaagggaaucggcaaaaugacacugggcaugugcugcauuaucaccgcuucuauucuccugugguaugcccagauccaaccucacuggaucgcggccuccauuauccuugaguucuuucugauugugcuccugauccccgaacccgagaagcagcgcacgccucaggacaaucagcugacauacgucgugauugcuauccucaccgucguggccgcuaccauggccaacgaaaugggguuccuugagaaaacaaagaaagaccugggacugggcagcaucgcgacccaagaguccgaaucuaauauucucgauaucgaccugagaccggccagcgcuuggacacuuuaugccguugcuacgaccuuugugacacccaugcugcggcauuccauugagaacucuagcgugaaugucucccucaccgccaucgcuaaccaggccacaguucugauggggcugggaaagggcuggccucucagcaagauggauauuggggugccccuucuggcgaucggauguuacucucaggugaauccuauuacccugacggccgcucuccugcuucuggucgcccacuacgcuaucaucggccccggccuccaggccaaagccacccgcgaagcgcaaaagagagcugccgcugggauuaugaaaaacccuacaguggacggaaucaccguuauugaucuggagccgauccccuaugacccuaaguucgaaaaacagcugggccaggugaugcuccuuauucugugcgucacacaggugcugaugaugcggaccacgugggcccucugugaggcccugacacuugcuaccgggcccaucuccacacugugggagggaaauccuggccgcuuuuggaacaccaccaucgccgucagcauggcgaauauuuucagagggucuuaccucgccggagcuggccugcuguuuuccaucaugaagaacacaacgaauacccggcgcggcacagggaacauuggagaaacccucggcgagaaguggaaaagcagacuuaaugcccuggggaagucugaguuccaaaucuauaaaaagagcggcauucaggagguggaucggacacuggcuaaagagggcaucaagagaggggaaaccgaccaucacgccguuucccgcggaucugcgaaacuccggugguuuguggagagaaacauggucacgcccgaaggcaaggugguugaucugggcugcgggcgcggaggcuggagcuacuauugugggggacuuaagaacgugcgggaggucaaaggccugacaaaagggggaccgggccaugaagaaccuauccccauguccaccuacggcuggaaucucgugagacugcagagcgggguggacguuuucuucacacccccugagaaaugcgauacacugcucugugacauuggagaauccucucccaacccuaccaucgaggccggccgcacacuucggguccugaaucugguggaaaacuggcucaauaacaauacgcaauuuugcauuaaggugcugaacccguauaugcccagcgucaucgagaaaauggaaacccuucagagaaaguacgggggagcucugguucgcaauccucucucccggaacucuacacacgagauguacugggugagcaaugccaccggcaacauuguguccucugucaauaugaucagcagaaugcugaucaaccgcuucacaaugaagcacaaaaaggcuaccuaugagcccgauguggaccugggguccggaacgcggaauauuggcaucgaaagcgagauuccuaaccucgacaucauuggcaaaagaaucgaaaagauuaaacaggagcaugaaaccucuuggcacuacgaucaggaccaucccuauaagacaugggccuaccacggguccuaugagaccaagcaaacaggaagcgcuucuuccaugguuaacggcgugguccgccuucugaccaaaccgugggaugugguuccuauggugacacagauggccaugaccgacacgacacccuuugggcagcagagagucuucaaggagaaaguggauacccggacccaagaaccuaaggagggaaccaagaagcugaugaagaucacggcggaauggcucuggaaagagcugggcaagaaaaagacaccccgcauguguacaagagaggaauuuacccggaaagugagaagcaaugccgcucuuggggccaucuucacagacgagaacaaguggaaaucugcucgggaagccgucgaggauucccgcuuuugggaacugauugacagagagcggaaucuccaccuggagggaaagugcgaaaccuguguuuacaacaugaugggcaagcgcgagaaaaagcugggcgaguucgggaaagccaagggaagcagagcgaucugguauauguggcucggcgcucgguuucuggaguucgaagcccuuggguuucugaaugaggaucauugguucucccgcggaaacagccucucuggcguggagggggaaggccugcacagacuuggauacauucugcgggacgugagcaaaaaggagggcggggccauguacgcugaugacacagccggaugggacacccgcaucacgcucgaagaucugaagaaugaggaaauggucaccaaccauaugaaaggcgagcacaagaaacuggcugaggccauuuuuaagcucacauaucagaauaaagugguuagagugcagcggccuacaccccgcgggacagucauggacaucaucuccagacgggaucagcgcggaucuggccaaguggggaccuacggccugaacacguucacaaauauggaagcgcagcuuauuagacagauggagggagaaggcaucuucaagagcauucaacaucugaccguuacagaggagaucgccgugcagaacuggcucgcucgggucgggagagaacgccugucccggauggccauuucuggagacgauugcgugguuaagccgcuugacgauagauuugcuagcgcccugaccgcgcucaaugacaugggcaaagugcgcaaggauauccagcagugggagccuucccggggguggaacgacuggacgcaaguccccuucugcucucaccacuuucaugaacuggugaugaaagauggaagaguccuggugguucccugucgcaaucaggacgagcucaucggccgggccagaauuagccagggggcuggcuggucccugaaggaaaccgccugccuuggaaaaagcuaugcucagauguggacacugauguacuuccaccgccgggaucucagacuggccgcuaacgccaucuguucugcggugccuucccauugggucccgaccagccgcacaaccuggucuauucacgccaagcacgaguggaugacaaccgaggacaugcuugcuguguggaaccggguguggauccaagaaaaucccuggauggaggacaagacgccuguugaauccugggaggaagugcccuaucugggcaaaagagaggaucaguggugcgggagccucauuggacugacaucccgggccaccugggccaagaacauccagaccgcuauuaaucaggucagaucucugaucggcaacgaggaauacacagacuauaugccuagcaugaaacgcuuucggagagaggaagaggaagccggggugcucugguga

SEQ ID NO: 20282 - RNA, 9876 nt, Artificial Sequence
  derived and/or modified CDS sequence (opt5) from DENV-2__GQ398285__SS-prME
accgcuggagugaucauuaugcugauccccaccgcuauggccuuccaccucacgacccggaacggggagccucauaugauugucggacggcaggaaaagggcaaaucccugcuuuuuaagaccgaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaugggccuggauuucaacgaaaugguucuccugcagauggaggacaaggcuuggcuugugcaccgccaaugguuucuggaucucccgcugccuuggcugcccggggccgacacccagggaucuaauuggauccagaaggagacacucgucaccuucaagaacccucaugcuaaaaagcaggacgugguugugcugggcucccaagaaggggccaugcacacggcccuuacaggcgcuaccgagauucagaugagcuccggaaaucugcucuuuacaggccaucugaaaugcagacuucggauggauaagcugcagcucaaagggaugucuuacagcauguguaccggaaaguucaagaucgucaaagaaauugcggagacccaacacggcacaaucgugaucagaguccaguaugagggggacggaucccccugcaagauucccuucgaaaucauggaucuggagaaacgccaugugcugggccggcucauuacgguuaacccuaucgugaccgaaaaggacagcccggucaacauugaggccgaacccccuuuuggggauucuuacaucauuaucggcguggagcccggacagcugaaacuuaauugguucaagaagggcuccagcaucgggcagauguuugagacaaccaugagaggagcuaaacgcauggccauucugggcgacacagccugggauuucgggucucucggaggcguuuuuaccagcaucgggaaggcucugcaccaaguguucggcacgauuuacggagccgcguuuuccggcgucucuuggacaaugaaaauccugauuggggugaucaucaccuggauuggaaugaacagccgguccaccagccuuucugugucccucguucuggucggcguggugacacuguaucucggggcuaugguccaggccgacagcggaugugugguuucuuggaaguccaaagaacugaagugcggcagcgggaucuucauuaccgauaaugugcacacauggacggagcaguacaaguuucagccugaaucccccucuaaacuugccagcgcuauccaaaaggcccaugaggaaggcauuuguggaaucagauccgucacccgccuggagaaccucauguggaaacagaucacaccggagcugaaucacauucugucugaaaacgaggugaaacuuaccaucaugacaggcgggauuaaaggaaucaugcaggcuggcaagcggagccucagaccucagcccaccgaacugaaauauuccuggaagacgugggggaaggccaaaaugcugagcaccgagucucauaaucaaacauuccucauugacggaccugaaaccgcggagugccccaacacaaaucgcgccuggaacucccuggagguugaagauuacggcuuuggcguguucaccacaaauaucuggcuuaagcugcgggagaaacaggacgucuuuugugacagcaagcucaugucugcugccaucaaagauaacagagcugugcacgccgacaugggguauuggauugaauccgcgcugaaugauaccuggaagauggagaaggccagcuucaucgagguuaaaucuugccacuggccuaagagccauacgcugugguccaacggagugcuugaaagcgagaugauuauccccaaaaaucucgcuggcccggucucucagcacaacuaccgcccuggguaucauacacagaccgccggacccuggcaccugggcaagcuggaaauggacuucgauuuuugugaggggaccacagugguggucaccgaagacugcggaaaccggggccccucccucagaacgacaaccgcuagcggcaaacugguuacagaguggugcugucgguccugcacccuuccuccgcugcgcuacagaggggaggauggauguugguacggcauggaaauucggccccucaaggagaaggaagagaaucuggugaacucucuggugacagccgggcauggacaaaucgacaauuucagccuuggcguccucgggauggcccuguuucuggaagagaugcucagaacccgcgugggaacgaaacacgcuauucugcuuguugcgguguccuucgucacccugaucacaggcaacaugucuuuucgggaucucggcagagugaugguuauggugggggccaccaugacagacgauaucggaaugggcgucaccuaucuggcucugcuugccgccuucaaggugcgcccuacguuugcugccgggcugcuccugagaaaacucacaagcaaggagcugaugauggcgaccauuggaaucgcccuucugucccagucuacaauucccgaaaccauccucgagcugaccgacgcccuggcccuuggcaugaugguucugaaaauugugcggaauauggaaaaguaccagcucgcugucacaaucauggccaucagcugcgugccuaacgcggugauucugcaaaaugcuuggaaggucuccuguacgauccucgccgccguuagcgugucuccccugcuucugaccuccagccagcagaaagcugauuggauuccucucgcccugacaaucaaggggcugaaccccaccgcuauuuuccuuacaacccugucucgcacguccaaaaagagaagcuggccgcucaaugaggccaucauggcggugggaauggucucuauccuggccuccagccuccugaaaaacgacauuccuaugacaggcccccuuguggcuggcgggcugcugaccguuugcuaugugcucaccggacgguccgccgaccuggaacuugagcgcgcugccgaugucaagugggaggaccaggccgaaaucagcggcucuagcccuauucuguccaucacaauuucugaggaugggagcauguccaucaaaaaugaagaggaggaacaaacccucacaauucugaucagaacgggacuccuggugaucucuggcguuuuucccgugagcauuccgaucaccgcugcggccugguaccuuugggaggucaagaagcagcgggcuggggugcugugggacgucccuucucccccucccgugggaaaagccgaacuggaggauggcgccuaucgcauuaagcagagaggcauccucggguacagccagauuggagcuggcguuuauaaagaagggacauuccacaccauguggcaugugacacggggagccguccugaugcaccgcggcaagagaaucgagcccagcugggcggacgugaaaaaggaucuuaucuccuacgggggaggcuggaagcuggagggcgaauggaaagagggggaagagguucaagugcucgcucuggaaccuggaaagaacccgcgggccguccagaccaaacccggccucuuuaagacgaauaccgggacaauuggagccgugagccuggacuucucuccuggcaccuccgggagccccaucguggauagaaaaggaaagguugucggccuuuacggcaacgggguggugacacgcucuggagcuuaugucuccgccauugcgcagaccgaaaagagcaucgaggacaauccugaaauugaggaugacaucuuucggaaaaagagacugacaaucauggaucugcaucccggcgcugggaaaacgaagcgcuaccucccugccauugugcgggaagccaucaaaagaggacugcgcacccuuauucuggcuccgacacggguuguggccgcugagauggaagaggcccucagaggccugcccauccgcuaucagaccccugcgauucgggccgagcacaccgggagagaaaucgucgaccucaugugucaugcuacauucacgaugcggcugcuuucccccgugcgcguuccuaacuacaaccugauuaucauggacgaggcccacuucaccgaucccgcuucuaucgccgccagaggcuauauuagcacacggguggaaaugggagaggcugcgggcaucuuuaugaccgccacaccgccugggucccgcgaccccuucccccaaagcaaugcuccuauuauggaugaggaaagagagauccccgaacggucuuggaacuccggacacgagugggucaccgacuuuaagggcaagacggugugguucguuccuagcauuaaagccgggaaugauaucgccgcuugccugagaaagaacggcaagaaggugauccagcucucucgcaaaacauuugacagcgaauacgucaagacccgggccaaugauugggacuucguggugaccacagauauuuccgagaugggcgcgaacuuuaaggcugagagagucaucgacccgcgccgguguaugaaacccguuauucugaccgauggggaagagagagugauccuugccggcccuaugcccgugacacauucuagcgccgcucagcgccggggaagaauuggccgcaauccuaagaacgaaaaugaccaauauaucuacaugggggagccccuggaaaacgacgaggauugcgcccacuggaaagaggcgaagaugcuccuggacaauaucaacaccccggaaggaauuaucccuuccauguucgagcccgaaagagagaaagucgaugccauugacggcgaauaccggcugcgcggggaggcuagaaagacguuuguggaucucaugcggcgcggagaccuuccuguuuggcuggccuauagaguggcugccgagggcaucaauuacgcugaucggagaugguguuucgacgggauuaaaaacaaucagauccuggaagagaacgucgaaguggagauuuggacaaaggagggcgaacgcaagaaacucaagccccgguggcuggaugccagaaucuauucugacccucuugcgcugaaagaguuuaaggaguucgccgcuggacgcaaaagccucacccugaaccugaucacagagaugggccggcuccccaccuucaugacgcagaaggccagaaaugcucuugauaaccuggccguucugcauaccgccgaagcugggggacgggcguacaaucacgcccucuccgagcugccggagacacuugaaacccugcuccugcugacacuccuugcuaccgugacaggcgggauuuuucuguuccugaugagcggaaagggcaucggcaaaaugacccucgggaugugcugcauuaucacggccucuauucugcuuugguaugcccagauccaaccucacuggaucgcugccuccauuauccuggaguuuuuccucauuguccugcugauccccgaacccgagaagcagcgcacaccucaggacaaccagcucaccuacguggucauugcgauccuuaccgugguugccgcuacaauggccaaugaaaugggauuucuggagaaaaccaagaaagaucugggccucgggagcaucacaacgcaagaguccgaaucuaacauucuggacaucgaccuuagaccggcuagcgccuggacccuguaugcgguggccacaaccuucgugacacccaugcuccggcauuccauugaaaauucuagcgucaacguuucccugaccgcuaucgccaaucaggcuacggugcugaugggacucggcaagggguggccucuuagcaagauggauauuggagugccccugcuggccaucggcuguuacucucaggucaacccuauuacccucacagcugcccugcuucugcucguggcgcacuacgccaucaucggccccgggcugcaggcuaaagccacccgcgaagcucaaaagagagccgccgcgggaauuaugaaaaauccuacaguugacggcaucaccgugauugaucuggagccgauccccuaugacccuaaguuugaaaaacagcucgggcaggucaugcuucugauucugugcgugacgcagguccucaugaugcggacaaccugggcucugugugaggcccuuacacuggcuaccggacccaucuccacccucugggagggcaacccugggcgcuucuggaauacaacgaucgccgugagcauggccaacauuuuuagaggaucuuaccuggcuggcgccggccuccuguucuccaucaugaagaauaccacaaacacccggcgcgggacaggaaauauuggcgaaacccuuggggagaaguggaaaagcagacugaacgcgcugggaaagucugaauuucaaaucuauaaaaagagcggcauucaggagguugaucggacgcucgccaaagaggggaucaagagaggagaaacagaccaucacgcugugucccgcggcucugccaaacugcggugguucgucgagagaaacauggugacccccgaaggcaagguuguggaucuugggugcggacgcggcggguggagcuacuauuguggaggccugaagaauguccgggaggugaaagggcucaccaagggaggcccgggccaugaggagccuauccccauguccacauacggguggaaccuggugagacugcagagcggaguugacgucuuuuucacacccccugagaaaugcgauacacuccuuugugacauuggcgaauccucucccaauccuacgaucgaggcugggcgcacccugcgggugcugaaccucguggaaaauuggcugaacaauaacacacaauucugcauuaagguccuuaauccguauaugcccagcguuaucgagaaaauggaaacccugcagagaaaguacggaggcgcccucgugcgcaacccucuguccagaaauucuacacacgagauguacugggugagcaacgcgaccgggaauauugucuccucugugaacaugaucagcagaaugcugaucaaucgcuuuacgaugaagcacaaaaaggccaccuaugagcccgauguugaccucggauccggcacacggaacauuggcaucgaaagcgagauuccuaaccuugauaucauugggaaaagaaucgaaaagauuaaacaggagcaugaaaccucuuggcacuacgaccaggaccaucccuauaagacaugggcuuaccacggauccuaugagaccaagcaaacaggcagcgccucuuccauggugaauggggucgugcgccugcugaccaaaccgugggauguugugccuauggucacgcagauggcuaugacagacaccacccccuucggacagcagagaguguuuaaggagaaaguggauacacggacgcaagaaccuaaggagggcaccaaaaagcucaugaagaucacagccgaauggcuguggaaagagcuugggaaggagaaaacaccccgcauguguacaagagaagaguucgcucggaaggucagaagcaacgccgcgcugggagccaucuuuaccgacgaaaauaaauggaagucugcucgggaggccguugaagauucccgcuucugggagcucauugacagagagcggaaccugcaccuggaaggcaaaugcgagacauguguguacaauaugaugggcaagcgcgaaaagaaacucggggaguuuggaaaggcuaaaggcagcagagccaucugguauauguggcugggggcccgguuccuugaauuugaggcgcugggauuccucaacgaggaucauugguuuucccgcgaaaauagccugucuggcguggagggggaaggccuucacagacugggauacauucuccgggacgucagcaagaaagagggcggggcuauguacgccgaugacaccgccggaugggauacgcgcaucacccuggaagaccugaagaacgaggagauggugacaaaucauaugaagggcgaacacaaaaagcucgcugaggccauuuucaaacugaccuaucagaacaagguugugagaguccagcggccuacaccccgcgggaccgugauggacaucaucuccagacgggaucagcgcggaucuggccaaguugggacguacggccuuaauacauuuaccaacauggaagcucagcugauuagacagauggagggagagggcaucuucaaaagcauucaacaucucacagccaccgaagagaucgcggugcagaauuggcuggcccgggucgggagagaacgccuuucccggauggcuauuucuggagacgauugcgugguuaagccgcuggacgauagauucgccagcgcucucacggcccugaacgacaugggcaaggugcgcaaagauauccagcagugggagccuucccggggguggaaugacuggacccaaguccccuuuugcucucaccacuuccaugaacuggugaugaaggauggaagaguccucgugguucccugucgcaaccaggacgagcugaucggccgggcgagaauuagccagggggccggcuggucccuuaaagagacagcuugccugggaaagagcuaugcccagauguggacccucauguacuuucaccgccgggaucugagacuugcugccaacgcuaucuguucugccgugccuucccauugggucccgacaagccgcaccacauggucuauucacgcgaaacacgaauggaugaccacggaggacaugcuggccguguggaaucggguguggauccaagaaaaccccuggauggaggauaagacaccuguugaauccugggaggaggugcccuaucucggcaagagagaagaccaguggugcgggagccugauuggacugaccucccgggcuaccugggccaaaaauauccagacagccauuaaccaggucagaucucucaucggcaaugaggaauacaccgacuauaugccuagcaugaagcgcuuccggagagaggaagaggaggcuggggugcugugguga

SEQ ID NO: 20283 - RNA, 9876 nt, Artificial Sequence
  derived and/or modified CDS sequence (opt5) from DENV-2__GQ398298__SS-prME
accgccggcgugaucauuaugcugauccccacagcuauggccuuccaccucacgacccggaacggggaaccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggacuucucggcauggcgcuguuccuggaagagaugcucagaacacgcguggggaccaaacacgccaugcugcuugucgugguuuccuuugugacgcugaucaccggaaacaugucuuuccgggaccucggcagagucauggugaugguuggcgcuacaaugaccgaugacaucgggaugggaauuacauaucuggcccugcuugccgcuuuuaaggugcgcccuaccuucgccgcgggccugcuccugagaaaacucacgagcaaggagcugaugauggcuacaaucgggauugcccuucugucccagucuaccauccccgaaacaauucucgagcugaccgaugcccuggcucuuggaaugaugguccugaaaaucgugcggaauauggaaaaguaccagcucgccguuaccaucauggcgauuagcugcgugccuaacgcugucauccugcaaaaugccuggaagguguccuguacaauucucgccgcugugagcgucucuccccugcuucugacguccagccagcagaaagccgacuggaucccucucgcucugaccauuaagggccugaaccccacagccaucuuucuuaccacacugucucgcaccuccaaaaagagaagcuggccgcucaaugaggcgaucauggccguugggauggugucuauucuggcuuccagccuccugaaaaacgacaucccuaugacgggaccccuuguggccggcggccugcugacagucugcuaugugcucaccgggcgguccgcugaucuggaacuugagcgcgccgccgacguuaagugggaggaucaggcugaaauuagcggaucuagcccuauccuguccauuaccaucucugaggacggcagcauguccauuaaaaaugaagaggaggaacaaacacucaccauccugaucagaacagggcuccuggugauuucuggagucuuccccgugagcaucccgauuacggcggccgcuugguaccuuugggagguuaagaagcagcgggccggcgugcugugggaugucccuucucccccucccguggggaaagccgaacuggaggacggagcuuaucgcaucaagcagagaggcauucucggcuacagccagaucggggccggagucuauaaagaaggcaccuuucacacaauguggcaugugaccagaggggcgguucugaugcaccgcggaaagagaaucgagcccagcugggcugauauuaaaaaggaccuuaucuccuacggcgggggauggaagcuggagggcgaauggaaagagggcgaagaggugcaaguccucgcccuggaaccugggaagaacccgcgggccgugcagacaaaacccggacucuucaagaccaauacgggcaccauuggggcuguuagccuggauuuuucuccuggaacauccggcagccccaucguggacagaaaagggaaggucgugggacuuuacggcaacggcgugguuacccgcucuggggccuaugucuccgcgauugcucagacagaaaagagcaucgaggauaauccugaaaucgaggacgauauuuuccggaaaaagagacugaccaucauggaccugcaucccggagccggcaaaacaaagcgcuaccucccugccauugugcgggaagcuaucaaaagagggcugcgcacgcuuauucuggccccgacccggguggucgcugccgagauggaagaggcgcucagaggacugcccauccgcuaucagaccccugccauucgggcugagcacaccggcagagaaaucguggaccucaugugucaugccaccuucacaaugcggcugcuuucccccguucgcgugccuaacuacaaccugaucauuauggaugaggcucacuuuacggaccccgccucuaucgccgcuagaggguauauuagcacccgggucgaaaugggcgaggcggccggaaucuucaugacagcuaccccgccuggcucccgcgaucccuuuccccaaagcaaugccccuauuauggacgaggaaagagagauccccgaacggucuuggaacuccgggcacgagugggugacagauuucaagggaaagaccguuugguuugugccuagcaucaaagccggcaaugacauugcugccugccugagaaagaacgggaaaaaggucauccagcucucucgcaaaacguucgauagcgaauacgugaagacacgggcgaaugacugggauuuuguugugaccaccgacauuuccgagaugggagcuaacuucaaggccgagagagucaucgauccgcgccgguguaugaaacccgugauucugacagacggcgaagagagagugauccuugccgggccuaugcccgucacccauucuagcgcugcccagcgccggggcagaaucggacgcaauccuaagaacgaaaaugaccaauauauuuacaugggcgagccccuggaaaacgaugaggacugcgcgcacuggaaagaggccaagaugcuccuggauaauaucaacacaccggaagggauuaucccuuccauguuugagcccgaaagagagaaaguugacgcuauugauggagaauaccggcugcgcggcgaggccagaaagaccuucguggaccucaugcggcgcggggaucuuccuguguggcuggcuuauagagucgccgcugagggaaucaauuacgccgaccggagaugguguuuugauggcauucgcaacaaucagauccuggaagagaacguggaaguugagaucuggacgaaagagggggaacggaagaagcucaaacccagauggcuggacgcgcgcauuuauucugauccucuugcccugaaggaguucaaagaguucgcugccggccggaagucccucacacugaaccugaucaccgagaugggaagacuccccacauuuaugacccagaaagcucgggacgcccuugauaaucuggccgugcugcauacggcugaagcgggcgggcgcgccuacaaccacgcucucuccgagcugccggagacccuugaaacacugcuccugcugacccuccuugccacagucaccggaggcauuuuccuguuucugaugagcgggaagggaaucggcaagaugacacucggcaugugcugcauuaucaccgccucuauccugcuuugguaugcucagauucaaccucacuggaucgccgcguccauuauccuggaguucuuucucauugugcugcugauccccgaacccgagaaacagagaacgccucaggacaaucagcucacauacguugugaucgccauucuuaccgucguggcugccaccauggcuaacgaaaugggguuccuggagaagaccaagaaggaccugggacucggcagcaucgccacccaagaguccgaaucuaauauucuggauaucgaccuucggccggcgagcgccuggacacuguaugcugucgccacgaccuuugugacacccaugcuccgccauuccauugagaacucuagcguuaaugugucccugaccgcuaucgccaaccaggcuacagugcugauggggcucggaaaaggcuggccucuuagcaagauggauauuggggucccccugcuggccaucggauguuacucucagguuaauccuaucacccucacggcggcccugcuucugcucguggcucacuacgccauuaucggccccggccugcaggcuaaggccaccagagaagcccaaaaacgggcggcugccgggauuaugaagaacccuacaguggacggaaucaccgucauugaucuggagccgauccccuaugacccuaaauucgaaaagcagcucggccaggugaugcuucugauccugugcguuacacaggugcucaugaugcgcaccacgugggcucugugugaggcccuuacacuggccaccgggcccauuuccacacucugggagggaaauccuggcagauuuuggaacaccaccaucgcugucagcauggccaauauuuuccgggggucuuaccuggcgggagccggccugcucuuuuccaucaugaaaaacacaacgaauacccgcagaggcacagggaacauuggagaaacccuuggcgagaaguggaaaagccggcugaaugcucuggggaaaucugaguuccaaaucuauaagaaaagcggaauccaggagguggauagaacacucgccaaggagggcauuaaacgcggggaaaccgaccaucacgcugucucccggggaucugccaagcugagaugguuuguggagcgcaacaugguuacgcccgaaggcaaaguggucgaucuuggcugcgggcggggaggcuggagcuacuauugugggggacugaagaacgugagagagguuaagggccucacaaaagggggaccgggccaugaagaaccuauccccauguccaccuacggcuggaaucuggugcgccugcagagcggggucgacguguucuucacacccccugagaagugcgauacacuccuuugugacauuggagaauccucucccaacccuaccaucgaggcgggccggacacugagagugcugaaucucguugaaaacuggcugaauaacaauacgcaauuuugcauuaaaguccuuaacccguauaugcccagcgugaucgagaagauggaaacccugcagcgcaaauacgggggagcccucgugcggaauccucuguccagaaacucuacacacgagauguacugggucagcaaugcuaccggcaacaucguuuccucugugaauaugauuagccgcaugcugaucaaccgguucacaaugaagcacaagaaagccaccuaugagcccgauguggaccucggguccggaacgagaaauauuggcaucgaaagcgagauuccuaaccuugacaucauuggcaagcgcaucgagaagaucaagcaggagcaugaaaccucuuggcacuacgaucaggaccaucccuauaaaacaugggcuuaccacggguccuaugagaccaagcaaacaggaagcgccucuuccauggucaacggcgugguuagacugcugaccaagccgugggauguggucccuauggugacacagauggcuaugaccgacacgacacccuuugggcagcagcggguuuucaaagagaagguggauacccgcacccaagaaccuaaagagggaacaaagaaacucaugaagauuacggccgaauggcuguggaaggagcuuggcaaaaagaaaacccccagaauguguacacgggaggaauuuaccagaaagguccggagcaaugcggcccugggggcuaucuucacagacgagaacaaauggaagucugcccgcgaagcuguggaggauuccagauuuugggaacucauugaccgggagcgcaaucugcaccuggagggaaaaugcgaaaccuguguguacaacaugaugggcaagagagagaagaaacucggcgaguucgggaaggccaaaggaagccgggccaucugguauauguggcugggcgcgcgcuuucuugaguucgaagcucugggguuucucaaugaggaucauugguucuccagaggaaacagccugucuggcgucgagggggaaggccuucaccggcugggauacauucuccgcgacguuagcaagaaagagggcggggccauguacgccgaugacacagcuggaugggacaccagaaucacgcuggaagaucugaagaaugaggaaauggugaccaaccauaugaagggcgagcacaaaaagcucgccgaggcuaucuuuaaacugacauaucagaauaaggugguccgggugcagcgcccuacccccagagggacaguuauggacauuaucucccggcgcgaucagagaggaucuggccaaguggggaccuacggccuuaacacguucacaaauauggaagcccagcugauucggcagauggagggagaaggcaucuucaaaagcauucaacaucucaccgucacagaggagaucgcggugcagaacuggcuggccagaguugggcgcgaacggcuuuccagaauggcuaucucuggagacgauugcguggucaagccgcuggacgaucgcuuugccagcgcucucaccgcccugaaugacaugggcaaggugcggaaagauauucagcagugggagccuuccagaggguggaacgacuggacgcaaguucccuucugcucucaccacuuucaugaacuggugaugaaggauggacgcguccucgugguccccugucggaaucaggacgagcugaucggcagagcgcgcauuagccagggggccggcuggucccuuaaagaaaccgcuugccugggaaagagcuaugcccagauguggacacucauguacuuccaccggagagaucugcgccuugcugccaacgcuaucuguucugccgugccuucccauuggguuccgaccagccggacaaccuggucuauucacgcgaaacacgaguggaugacaaccgaggacaugcuggccguguggaacagagucuggauccaagaaaaucccuggauggaggacaagacgccuguggaauccugggaggaagugcccuaucucggcaagcgggaggaucaguggugcgggagccugauuggacugacauccagagcuaccugggccaaaaacauccagaccgccaucaaucagguucgcucucucauuggcaacgaggaauacacagacuauaugccuagcaugaagcgguuuagacgcgaggaagaggaagcuggggugcugugguga

SEQ ID NO: 20284 - RNA, 9876 nt, Artificial Sequence
  derived and/or modified CDS sequence (opt5) from DENV-2__GQ398301__SS-prME
accgccggcgugaucauuaugcugauccccaccgcuauggccuuccaccucacgacccggaacggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccugguggcugccuccuuuguuacgcuuaucaccggaaacaugucuuuccgggaccugggcagagugauggucauggugggcgccacaaugaccgaugacaucgggaugggaauuacauaucucgcucugcuggccgcguuuaagguucgcccuaccuucgcugccggccuucugcucagaaaacugacgagcaaggagcucaugauggccacaaucgggauugcucugcuuucccagucuaccauccccgaaacaauucuggagcucaccgaugcccuggcgcugggaaugauggugcuuaaaaucguccggaauauggaaaaguaccagcuggcugugaccaucauggccauuagcugcguuccuaacgccgugauccuccaaaaugcuuggaaggucuccuguacaauucuggccgcugugagcgugucuccccuccugcuuacguccagccagcagaaagccgacuggaucccucuggcgcucaccauuaagggccugaaccccacagccaucuuucugaccacacuuucucgcaccuccaaaaagagaagcuggccgcugaaugaggcuaucauggccgucgggaugguuucuauucucgcuuccagccugcucaaaaacgacaucccuaugacgggaccccugguggccggcggccuucugacagugugcuauguccugaccgggcgguccgccgaucucgaacuggagcgcgcugcggacgugaagugggaggaucaggccgaaauuagcggaucuagcccuauccuuuccauuaccaucucugaggacggcagcauguccauuaaaaaugaagaggaggaacaaacacugaccauccucaucagaacagggcugcucguuauuucuggaguguuccccgucagcaucccgauuacggcugccgccugguaccugugggaggugaagaagcagcgggcuggcguucuuugggaugugccuucucccccucccgucgggaaagccgaacuggaggacggagcguaucgcaucaagcagagaggcauucugggcuacagccagaucggggcuggaguguauaaagaaggcaccuuucacacaauguggcaugucaccagaggggcggugcucaugcaccgcggaaagagaaucgagcccagcugggccgauguuaaaaaggaccugauuuccuacggcgggggauggaaacuugagggcgaauggaaagagggcgaagaggugcaaguccuggcucucgaaccugggaagaacccgcgggccgugcagacaaaacccggacuguucaagaccaauacgggcaccaucggggcgguuagccucgauuuuucuccuggaacauccggcagccccauuguggacagaaaagggaaggucgugggacuguacggcaacggcgugguuacccgcucuggggcuuaugucuccgccaucgcccagacagaaaagagcauugaggauaauccugaaaucgaggacgauaucuuccggaaaaagagacuuaccauuauggaccugcaucccggagcuggcaaaacaaagcgcuaccugccugccaucgugcgggaagcuauuaaaagagggcuccgcacgcugauccuugccccgacccggguggucgcggccgagauggaagaggcucugagaggacuccccauucgcuaucagaccccugccauccgggcugagcacaccggcagagaaauuguggaccugaugugucaugccaccuucacaaugcggcuccugucccccguucgcgugccuaacuacaaccuuaucaucauggaugaggcccacuuuacggaccccgcuucuauugcggccagaggguauaucagcacccgggucgaaaugggcgaggcugccggaauuuucaugacagccaccccgccuggcucccgcgaucccuuuccccaaagcaaugcuccuaucauggacgaggaaagagagauucccgaacggucuuggaacuccgggcacgagugggugacagauuucaagggaaagaccguuugguuugugccuagcaucaaagccggcaaugacaucgcggcuugccugagaaagaacgggaaaaaggucauucagcugucucgcaaaacguucgauagcgaauacgugaagacacgggccaaugacugggauuuuguugugaccaccgacaucuccgagaugggagccaacuucaaggcugagagagucauugauccgcgccgguguaugaaacccgugauccucacagacggcgaagagagagugauucuggccgggccuaugcccgucacccauucuagcgcggcccagcgccggggcagaaucggacgcaauccuaagaacgaaaaugaccaauauaucuacaugggcgagccccuugaaaacgaugaggacugcgcucacuggaaagaggccaagaugcugcucgauaauauuaacacaccggaagggaucauuccuuccauguuugagcccgaaagagagaaaguugacgcuaucgauggagaauaccggcugcgcggcgaggccagaaagaccuucguggaccugaugcggcgcggggaucucccuguguggcuugcuuauagagucgccgcggagggaauuaauuacgccgaccggagaugguguuuugauggcaucaaaaacaaucagauucuggaagagaacguggaaguugagaucuggacgaaggagggggaacgcaagaaacugaagccccgguggcucgacgcuagaaucuauucugauccucuggcccuuaaagaguucaaggaguucgcugccggccgcaaaagccugacacucaaccugauuaccgagaugggacggcugcccacauuuaugacccagaaggccagagacgcucucgauaaucuugcggugcugcauacggccgaagcuggcgggcgggccuacaaccacgcccuguccgagcucccggagacccuggaaacacuucugcuccugacccugcucgcuacagucaccggaggcaucuuccuuuuucugaugagcgggaagggaauuggcaaaaugacacugggcaugugcugcaucauuaccgccucuauccuccugugguaugcgcagauccaaccucacuggauugccgcuuccaucauucuugaguucuuucugaucgugcuccugauucccgaacccgagaagcagcgcacgccucaggacaaucagcugacauacguugugaucgccauccucaccgucguggcugccaccauggcgaacgaaaugggguuccuugagaaaacaaagaaagaccugggacugggcagcauugccacccaagaguccgaaucuaauauccucgauauugaccugagaccggcuagcgccuggacacuuuaugcugucgccacgaccuuugugacacccaugcugcggcauuccaucgagaacucuagcguuaaugugucccucaccgcuauugccaaccaggcgacagugcugauggggcugggaaagggcuggccucucagcaagauggauaucggggucccccuucuggccauuggauguuacucucagguuaauccuaucacccugacggcugcccuccugcuucugguggcucacuacgccaucauuggccccggccuccaggccaaagcgacccgcgaagcucaaaagagagccgcugccgggaucaugaaaaacccuacaguggacggaauuaccgucaucgaucuggagccgauucccuaugacccuaaguucgaaaaacagcugggccaggugaugcuccuuauccugugcguuacacaggugcugaugaugcggaccacgugggcccucugugaggcucugacacuugccaccgggcccaucuccacacugugggagggaaauccuggccgcuuuuggaacaccaccauugcggucagcauggccaauaucuucagagggucuuaccucgcuggagccggccugcuguuuuccauuaugaagaacacaacgaauacccggcgcggcacagggaacaucggagaaacccucggcgagaaguggaaaagcagacuuaaugcucuggggaagucugaguuccaaauuuauaaaaagagcggaauccaggagguggaucggacacuggccaaagagggcaucaagagaggggaaaccgaccaucacgcggucucccgcggaucugccaaacuccggugguuuguggagagaaacaugguuacgcccgaaggcaagguggucgaucugggcugcgggcgcggaggcuggagcuacuauugugggggacuuaagaacgugcgggagguuaaaggccugacaaaagggggaccgggccaugaagaaccuauucccauguccaccuacggcuggaaucucgugagacugcagagcggggucgacguguucuucacacccccugagaaaugcgauacacugcucugugacaucggagaauccucucccaacccuaccauugaggcuggccgcacacuucgggugcugaaucugguugaaaacuggcucaauaacaauacgcaauuuugcaucaagguccugaacccguauaugcccagcgugauugagaaaauggaaacccuucagagaaaguacgggggagcccuggugcgcaauccucucucccggaacucuacacacgagauguacugggucagcaaugcuaccggcaacaucguuuccucugugaauaugaucagcagaaugcugauuaaccgcuucacaaugaagcacaaaaaggccaccuaugagcccgauguggaccugggguccggaacgcggaauaucggcauugaaagcgagaucccuaaccucgacauuaucggcaaaagaauugaaaagaucaaacaggagcaugaaaccucuuggcacuacgaucaggaccaucccuauaagacaugggcuuaccacggguccuaugagaccaagcaaacaggaagcgccucuuccauggucaacggcgugguucgccuucugaccaaaccgugggauguggucccuauggugacacagauggcgaugaccgacacgacacccuuugggcagcagagaguuuucaaggagaaaguggauacccggacccaagaaccuaaggagggaaccaagaagcugaugaagaucacggccgaauggcucuggaaagagcugggcaaggagaaaacaccccgcauguguacaagagaagaguuuacccggaaggucagaagcaaugcugcccuuggggcuauuuucacagacgaaaacaaauggaagucugcccgggaggccguggaagauucccgcuuuugggagcugaucgacagagagcggaaucuccaccuggaaggaaaaugcgagaccuguguguacaacaugaugggcaagcgcgaaaagaaacugggcgaguucgggaaggcgaaaggaagcagagcuauuugguauauguggcucggcgcccgguuucuggaguucgaggcccuuggguuucugaaugaggaucauugguucucccgcggaaacagccucucuggcgucgaaggggagggccugcacagacuuggauacauccugcgggacguuagcaagaaagaaggcggggcuauguacgccgaugacacagcuggaugggacacccgcauuacgcucgaggaucugaagaaugaagagauggugaccaaccauaugaagggcgagcacaaaaagcuggccgaagcgaucuuuaaacucacauaucagaauaagguggucagagugcagcggccuacaccccgcgggacaguuauggacaucauuuccagacgggaucagcgcggaucuggccaaguggggaccuacggccugaacacguucacaaauauggaggcccagcuuaucagacagauggaaggagagggcauuuucaaaagcauccaacaucugaccgucacagaggaaauugcugugcagaacuggcucgcccggguugggagagagcgccugucccggauggcuaucucuggagacgauugcguggucaagccgcuugacgauagauuugccagcgcgcugaccgcccucaaugacaugggcaaggugcgcaaagauauccagcagugggaaccuucccggggguggaacgacuggacgcaaguucccuucugcucucaccacuuucaugagcuggugaugaaggauggaagaguccuggugguccccugucgcaaucaggacgaacucauuggccgggcuagaaucagccagggggccggcuggucccugaaagagaccgcuugccuuggaaagagcuaugcccagauguggacacugauguacuuccaccgccgggaucucagacuggcugccaacgcgauuuguucugccgugccuucccauuggguuccgaccagccgcacaaccuggucuauccacgcuaaacacgaguggaugacaaccgaagacaugcuugccguguggaaccgggucuggauucaagagaaucccuggauggaagacaagacgccuguggaguccugggaagaggugcccuaucugggcaagagagaggaucaguggugcgggagccucaucggacugacaucccgggccaccugggcuaaaaacauucagaccgccaucaaucagguuagaucucugaucggcaacgaagaguacacagacuauaugccuagcaugaagcgcuuucggagagaagaggaagaggcgggggugcucugguga

SEQ ID NO: 20285 - RNA, 9876 nt, Artificial Sequence
  derived and/or modified CDS sequence (opt5) from DENV-2__GQ398312__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaagcuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucagcacaaauaucuggcuuaagcugcgggagaaacaggacgucuuuugugauucuaagcucauguccgcugccaucaaagacaacagagcggugcacgccgauaugggcuauuggauugaaagcgcucugaaugacaccuggaagauggagaaggccucuuucaucgagguuaaaagcugccacuggccuaagucccauacacuguggagcaacggggugcuugaaucugagaugauuauccccaaaaauuucgcuggaccggucucccagcacaacuaccgcccuggcuaucauacccagacggccgggcccuggcaccucggaaagcuggaaauggauuuugacuucugugagggcacaaccgugguggucaccgaagauugcgggaaccggggacccagccugagaacaaccacggccuccggcaaacucauuacagaguggugcugucggucuugcacccugccuccgcuucgcuacagaggcgaggacggguguugguacggaauggaaauccggccccugaaggagaaggaagagaaucucguuaacagccuggugacagcuggccaugggcaaauugauaauuuuucccugggagugcuuggcauggcgcucuuccuggaagagaugcugagaacccgcgucgggacaaaacacgccaugcuccugguggcuguuucuuuugugacccuuaucacgggaaacaugagcuuccgggaccugggcagagucauggugaugguuggcgccaccaugacagaugacaucgggaugggaauuaccuaucucgcccugcuggcugccuuuaaggugcgcccuacauucgcggcuggccuucugcucagaaaacugaccuccaaggagcucaugauggccacgaucgggauugcccugcuuucucagagcacaauccccgaaaccauucuggagcucacagaugcucuggcccugggaaugaugguccuuaaaaucgugcggaauauggaaaaguaccagcuggcgguuaccaucauggcuauuuccugcgugccuaacgccgucauccuccaaaaugccuggaaggugagcuguaccauucuggcugccgugucugucuccccccuccugcuuacaagcucucagcagaaagcugacuggaucccucuggcccucacgauuaagggccugaaccccaccgcgaucuuucugacaacccuuucccgcacaagcaaaaagagaucuuggccgcugaaugaggccaucauggcuguugggaugguguccauucucgccagcucccugcucaaaaacgacaucccuaugaccggaccccugguggcuggcggccuucugacggucugcuaugugcugacagggcggagcgccgaucucgaacuggagcgcgccgcugacguuaagugggaggaucaggcggaaauuucuggaagcuccccuauccuuucuauuaccaucagcgaggacggcuccaugucuauuaaaaaugaagaggaggaacaaacccugacaauccucaucagaaccgggcugcucgugauuagcggagucuuccccguguccaucccgauuacagccgcugccugguaccugugggagguuaagaagcagcgggccggcgugcuuugggaugucccuucucccccucccguggggaaagcugaacuggaggacggagccuaucgcaucaagcagagaggcauucugggcuacagccagaucggggcgggagucuauaaagaaggcacguuucacaccauguggcaugugacacggggggcuguucucaugcaccgcggaaagagaaucgagcccuccugggccgaugugaaaaaggaccugauuagcuacggcgggggauggaagcuugagggcgaauggaaagagggcgaagagguccaagugcuggcccucgaaccugggaagaacccgcgggcuguucagaccaaacccggacuguucaagacaaauaccggcacgaucggggccgugucucucgauuuuuccccuggaaccagcggcucucccauugucgacagaaaagggaagguggugggacuguacggcaacggcguugucacacgcuccggggcguaugugagcgcuaucgcccagaccgagaaguccauugaggauaauccugaaaucgaggacgauaucuuccggaaaaagagacuuacaauuauggaccugcaucccggagccggcaaaaccaagcgcuaccugccugcuaucgugcgggaagccauuaaaagagggcuccgcacacugauccuugcuccgacgcgggucguggccgcggagauggaagaggcccugagaggacuccccauucgcuaucagaccccugcuauccgggccgagcacacaggcagagaaauuguugaccugaugugucaugcuaccuucaccaugcggcuccugucucccgugcgcgucccuaacuacaaccuuaucaucauggaugaggcccacuuuacagaccccgccagcauugcugcgagaggguauaucuccacgcggguggaaaugggcgaggccgcuggaauuuucaugaccgccacaccgccuggcagccgcgaucccuuuccccaaucuaaugccccuaucauggacgaggaaagagagauucccgaacgguccuggaacagcgggcacgaguggguuaccgauuucaagggaaagacagugugguuugucccuucuaucaaagcuggcaaugacaucgccgcgugccugagaaagaacgggaaaaaggugauucagcugagccgcaaaaccuucgauuccgaauacguuaagacgcgggcuaaugacugggauuuuguggucacaaccgacaucucugagaugggagccaacuucaaggccgagagagugauugauccgcgccgguguaugaaacccgugauccucaccgacggcgaagagagagucauucuggcugggccuaugcccguuacacauagcuccgccgcgcagcgccggggcagaaucggacgcaauccuaagaacgaaaaugaccaauauaucuacaugggcgagccccuugaaaacgaugaggacugcgcccacuggaaagaggcuaagaugcugcucgauaauauuaacaccccggaagggaucauuccuucuauguuugagcccgaaagagagaaaguggacgccaucgauggagaauaccggcugcgcggcgaggcuagaaagacauucguggaccugaugcggcgcggggaucucccugucuggcuugccuauagaguggcugccgagggaauuaauuacgcggaccggagaugguguuuugauggcaucaaaaacaaucagauucuggaagagaacguugaaguggagaucuggaccaaggagggggaacgcaagaaacugaagccccgguggcucgacgccagaaucuauagcgauccucuggcucuuaaagaguucaaggaauucgccgcuggccgcaaaucccugacgcucaaccugauuacagagaugggacggcugcccaccuuuaugacacagaaggccagagacgcccucgauaaucuugcuguccugcauaccgcggaagccggcgggcgggcuuacaaccacgcccugagcgagcucccggagacgcuggaaacccuucugcuccugacacugcucgccaccgugacaggaggcaucuuccuuuuucugaugucugggaagggaauuggcaaaaugacccugggcaugugcugcaucauuacagcuuccauccuccugugguaugcccagauccaaccucacuggauugcggccagcaucauucuugaguucuuucugaucguucuccugauucccgaacccgagaagcagcgcaccccucaggacaaucagcugacguacguggucaucgcuauccucacaguggucgccgcuaccauggccaacgaaaugggguuccuugagaaaaccaagaaagaccugggacugggcuccauugcgacacaagagucugaaagcaauauccucgauauugaccugagaccggccuccgcuuggacccuuuaugccguggcuacaacguuuguuacccccaugcugcggcauucuaucgagaacagcuccgugaaugugagccucacagccauugcuaaccaggccaccguccugauggggcugggaaagggcuggccucucucuaagauggauaucgggguuccccuucuggcgauuggauguuacucccaggugaauccuaucacacugaucgccgcucuccugcuucugguggcccacuacgcuauuaucggccccggccuccaggccaaagccacccgcgaagcgcaaaagagagcugccgcugggauuaugaaaaacccuacggucgacggaaucaccgugauugaucuggagccgauccccuaugacccuaaguucgaaaaacagcugggccagguuaugcuccuuauccugugcgugacacagguccugaugaugcggaccacaugggcccucugugaggcccugacccuugcuacggggcccauuagcacacugugggagggaaauccuggccgcuuuuggaacaccacaaucgccgugucuauggcgaauauuuucagaggguccuaccucgccggagcuggccugcuguuuagcaucaugaagaacaccaccaauacacggcgcggcacggggaacauuggagaaacccucggcgagaaguggaaaucuagacuuaaugcccuggggaagagcgaauuccaaaucuauaaaaaguccggaauccaggaggucgaucggacacuggcuaaagagggcauuaagagaggggaaaccgaccaucacgccgugucucgcggaagcgcgaaacuccggugguuuguugagagaaacauggugacacccgaaggcaaggucguggaucugggcugcgggcgcggaggcugguccuacuauugugggggacuuaagaacguucgggaggugaaaggccugaccaaggggggaccgggccaugaagagccuauccccaugagcacguacggcuggaaucucgucagacugcaguccgggguggacguguucuucacacccccugagaaaugcgauacccugcucugugacauuggagaaucuagccccaacccuaccaucgaggccggccgcacacuucggguucugaaucuggucgaaaacuggcucaauaacaauacccaauuuugcauuaaggugcugaacccguauaugcccuccgugaucgagaaaauggaaacacuucagagaaaguacgggggagcucugguccgcaauccucucucucggaacagcacgcacgagauguacuggguuuccaaugccaccggcaacaucgugucuagcgugaauaugauuuccagaaugcugaucaaccgcuucacaaugaagcacaaaaaggcuaccuaugagcccgaugucgaccuggggagcggaacacggaauauuggcaucgaaucugagauuccuaaccucgacaucauuggcaaaagaaucgaaaagaucaaacaggagcaugaaaccuccuggcacuacgaucaggaccaucccuauaagacgugggccuaccacgggagcuaugagaccaagcaaacaggaucugcuuccagcauggugaacggcguugugcgccuucugaccaaaccgugggaugucgugccuaugguuacacagauggccaugaccgacacaacccccuuugggcagcagagaguguucaaggagaaagucgauacgcggacacaagaaccuaaggagggaaccaaaaagcugaugaagauuaccgcggaauggcucuggaaagagcugggcaagaaaaagacaccccgcauguguacgagagaggaauuuacccggaaagugagaucuaaugccgcucuuggggccaucuucacagacgagaacaaguggaaauccgcucgggaagccguggaggauagccgcuuuugggaacugauugacagagagcggaaucuccaccuggagggaaagugcgaaaccugugucuacaacaugaugggcaagcgcgagaaaaagcugggcgaauucgggaaagccaagggauccagagcgaucugguauauguggcucggcgcucgguuucuggaguucgaagcccuuggguuucugaaugaggaucauugguucagccgcggaaacucucucagcggcguugagggggaaggccugcacagacuuggauacauucugcgggacguguccaaaaaggagggcggggccauguacgcugaugacacagccggaugggacacccgcaucacacucgaagaucugaagaaugaggaaauggugaccaaccauaugaaaggcgagcacaagaaacuggcugaggccaucuuuaagcucacguaucagaauaaagucgugagaguucagcggccuaccccccgcgggacagugauggacauuaucucuagacgggaucagcgcggaagcggccaagucgggaccuacggccugaacacauucaccaauauggaagcgcagcuuauuagacagauggagggagaaggcaucuucaaguccauucaacaucugacggugacagaggagaucgccguucagaacuggcucgcucggguggggagagaacgccugucucggauggccaucagcggagacgauugcgucgugaagccgcuugacgauagauuugcuuccgcccugaccgcgcucaaugacaugggcaaaguucgcaaggauauucagcagugggagccuucucggggguggaacgacuggacacaagugcccuucugcagccaccacuuucaugaacuggucaugaaagauggaagagugcuggucgugcccugucgcaaucaggacgagcucaucggccgggccagaauuucccagggggcuggcuggagccugaaggaaaccgccugccuuggaaaaucuuaugcucagauguggacgcugauguacuuccaccgccgggaucucagacuggccgcuaacgccaucuguuccgcgguuccuagccauugggugccgaccucucgcacaaccugguccauucacgccaagcacgaguggaugacaaccgaggacaugcuugcugucuggaaccggguguggauccaagaaaaucccuggauggaggacaagacaccuguggaaagcugggaggaaguucccuaucugggcaaaagagaggaucaguggugcgggucccucauuggacugaccucucgggccacgugggccaagaacauccagacagcuaucaaucaggugagaagccugauuggcaacgaggaauacaccgacuauaugccuuccaugaaacgcuuucggagagaggaagaggaagccgggguccucugguga

SEQ ID NO: 20286 - RNA, 9876 nt, Artificial Sequence
  derived and/or modified CDS sequence (opt5) from DENV-2__GQ398289__SS-prME
accgcgggcgucaucauuaugcugauccccaccgcuauggccuuccaccucacgacccggaacggggaaccucauaugauugucggacggcaggaaaagggcaagagccugcuuuuuaagaccgaggacgggguuaauaugugcacccugauggcgaucgaucucggagaacugugugaggacaccauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuugugugcaagcauuccaugguggauagaggcuggggcaacggguguggacuguucggcaaagggggaauugugaccugcgcgauguuuacaugcaaaaagaauauggaaggcaaaguugugcucccugagaaccuggaauacacgaucgugauuacaccccacagcggggaggagcaugccgucggaaaugacacaggcaagcacggcaaagaaaucaagaucaccccucagucuuccauuacagaggcugaacuuaccggguauggaacggugaccauggaguguagcccccggacaggccuggauuucaacgaaaugguucuccugcagauggaggacaaagccuggcuugugcaccgccaaugguuucuggaucucccgcugccuuggcugcccggggcugacacccagggaucuaauuggauccagaaggagacacucgucaccuucaagaacccucaugccaaaaagcaggacgugguugugcugggcucccaagaaggggccaugcacacggcucuuacaggcgcgaccgagauucagaugagcuccggaaaucugcucuuuacaggccaucugaaaugcagacuucggauggauaagcugcagcucaaagggaugucuuacagcauguguaccggaaaguucaagaucgucaaagaaauugccgagacccaacacggcacaaucgugaucagaguccaguaugagggggacggaucccccugcaagauucccuucgaaaucauggaucuggagaaacgccaugugcugggccggcucauuacgguuaacccuaucgugaccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacacaaaagggauuaugcaggcgggaaagcggagccucagaccucagcccaccgaacugaaauauuccuggaagacguggggcaaggccaaaaugcugagcaccgagucucauaaucaaacauuccucaucgaugggccugaaaccgcugagugccccaacacaaaucgcgccuggaacucccuggagguugaagacuacggauuuggcguguucaccacaaauauuuggcuuaagcugcgggagaaacaggacgucuuuugugauagcaagcucaugucugcugccaucaaagacaacagagcggugcacgccgauaugggcuauuggaucgaauccgcucugaaugacaccuggaagauggagaaggccagcuucauugagguuaaaucuugccacuggccuaagagccauacgcugugguccaacggggugcuugaaagcgagaugaucauucccaaaaauuucgcuggaccggucucucagcacaacuaccgcccuggcuaucauacacagaccgccgggcccuggcaccucggaaagcuggaaauggauuuugacuucugugagggcaccacagugguggucaccgaagauugcgggaaccggggacccucccugagaacgacaaccgccagcggcaaacucaucacagaguggugcugucgguccugcacccugccuccgcuucgcuacagaggcgaggacggguguugguacggaauggaaauucggccccugaaggagaaggaagagaaucucguuaacucucuggugacagcuggccaugggcaaaucgauaauuuuagccugggagugcuuggcauggcccucuuccuggaagagaugcugagaacccgcgucgggacgaaacacgccauucuccugaucgcuguguccuuuguuacccuuaucacaggaaacaugucuuuccgggaccugggcagagugauggucauggugggcgccaccaugacagaugacauugggaugggaguuaccuaucucgcccugcuggcugccuuuaaggugcgcccuacguucgcggcuggccuucugcucagaaaacugacaagcaaggagcucaugauggccaccaucgggauugcccugcuuucccagucuacaauccccgaaaccauucuggagcucaccgaugcucuggcccugggaaugaugguccuuaaaaucgugcggaauauggaaaaguaccagcuggcgguuacaaucauggcuauuagcugcgugccuaacgccgucauccuccaaaaugccuggaagguguccuguacgauucuggcugccgugagcgucucuccccuccugcuuaccuccagccagcagaaagcugacuggaucccucuggcccucacaauuaagggccugaaccccaccgcgaucuuucugacaacccuuucucgcacguccaaaaagagaagcuggccgcugaaugaggccaucauggcuguugggauggugucuauucucgccuccagccugcucaaaaacgacaucccuaugacaggaccccugguggcuggcggccuucugaccgucugcuaugugcugaccgggcgguccgccgaucucgaacuggagcgcgccgcugacguuaagugggaggaucaggcggaaauuagcggaucuagcccuauccuuuccauuacaaucucugaggacggcagcauguccauuaaaaaugaagaggaggaacaaacccugacaauccucaucagaacggggcugcucgugauuucuggagucuuccccgugagcaucccgauuaccgccgcugccugguaccugugggagguuaagaagcagcgggccggcgugcuuugggaugucccuucucccccucccguggggaaagcugaacuggaggacggagccuaucgcaucaagcagagaggcauucugggcuacagccagaucggggcgggagucuauaaagaaggcacauuucacaccauguggcaugugacaagaggggcuguucucaugcaccgcggaaagagaaucgagcccagcugggccgaugugaaaaaggaccugauuuccuacggcgggggauggaaacuugagggcgaauggaaagagggcgaagagguccaagugcuggcccucgaaccugggaagaacccgcgggcuguucagaccaaacccggacuguucaagacgaauaccggcacaaucggggccgugagccucgauuuuucuccuggaaccuccggcagccccauugucgacagaaaagggaagguggugggacuguacggcaacggcguugucacacgcucuggggcguauguguccgcuaucgcccagaccgaaaagagcauugaggauaauccugaaaucgaggacgauaucuuccggaaaaagagacuuacaauuauggaccugcaucccggagccggcaaaacgaagcgcuaccugccugcuaucgugcgggaagccauuaaaagagggcuccgcacccugauccuugcuccgacacgggucguggccgcggagauggaagaggcccugagaggacuccccauucgcuaucagaccccugcuauccgggccgagcacaccggcagagaaauuguugaccugaugugucaugcuacauucacgaugcggcuccugucccccgugcgcgucccuaacuacaaccuuaucaucauggaugaggcccacuuuaccgaccccgccucuauugcugcgagaggguauaucagcacacggguggaaaugggcgaggccgcuggaauuuucaugaccgccacaccgccuggcucccgcgaucccuuuccccaaagcaaugccccuaucauggacgaggaaagagagauucccgaacggucuuggaacuccgggcacgaguggguuaccgauuucaagggaaagacggugugguuugucccuagcaucaaagcuggcaaugacaucgccgcgugccugagaaagaacgggaaaaaggugauucagcugucucgcaaaacauucgauagcgaauacguuaagacccgggcuaaugacugggauuuuguggucaccacagacaucuccgagaugggagccaacuucaaggccgagagagugauugauccgcgccgguguaugaaacccgugauccucaccgacggcgaagagagagucauucuggcugggccuaugcccguuacacauucuagcgccgcgcagcgccggggcagaaucggacgcaauccuaagaacgaaaaugaccaauauaucuacaugggcgagccccuugaaaacgaugaggacugcgcccacuggaaagaggcuaagaugcugcucgauaauauuaacaccccggaagggaucauuccuucccuguuugagcccgaaagagagaaaguggacgccaucgauggagaauaccggcugcgcggcgaggcuagaaagacguucguggaccucaugcggcgcggggaucuuccugucuggcuggccuauagaguggcugccgagggaauuaauuacgcggaccggagaugguguuuugauggcaucaaaaacaaucagauucuggaagagaacguugaaguggagaucuggacaaaggagggggaacgcaagaaacucaagccccgguggcuggacgccagaaucuauucugauccucuugcucugaaagaguucaaggaguucgccgcuggccgcaaaagccucacccugaaccugauuacagagaugggacggcuccccaccuuuaugacgcagaaggccagagacgcccuugauaaucuggcuguccugcauaccgcggaagccggcgggcgggcuuacaaccacgcccucuccgagcugccggagacacuugaaacccugcuccugcugacacuccuugccaccgugacaggaggcaucuuccuguuucugaugagcgggcgcggaauuggcaagaugacccucggcaugugcugcaucauuacggcuucuauccugcuuugguaugcccagauccaaccucacuggauugcggccuccaucauucuggaguucuuucucaucguucugcugauucccgaacccgagaaacagagaacaccucaggacaaucagcucaccuacguggucaucgcuauccuuaccguggucgccgcuacaauggccaacgaaaugggguuccuggagaagaccaaaaaggaccugggacucggcagcauuacaacgcaagaguccgaaucuaauauccuggauauugaccuucggccggcgagcgccuggacccuguaugcuguggccacaaccuuuguuacacccaugcuccgccauuccaucgagaacucuagcgugaaugugucccugaccgcuauugccaaccaggcuacgguccugauggggcucggaaaaggcuggccucuuagcaagauggauaucgggguuccccugcuggccauuggauguuacucucaggugaauccuaucacccucacagcggcccugcuucugcucguggcucacuacgccaucauuggccccggccugcaggcuaaggccaccagagaagcccaaaaacgggcggcugccgggaucaugaagaacccuacagucgacggaauuaccgugaucgaucuggagccgauucccuaugacccuaaauucgaaaagcagcucggccagguuaugcuucugauccugugcgugacgcagguccucaugaugcgcacaaccugggcucugugugaggcccuuacacuggccaccgggcccaucuccacccucugggagggaaauccuggcagauuuuggaacacaacgauugcugugagcauggccaauaucuuccgggggucuuaccuggcgggagccggccugcucuuuuccauuaugaaaaacaccacaaauacccgcagaggcacagggaacaucggagaaacccuuggcgagaaguggaagucccggcugaaugcucuggggaaaucugaguuccaaauuuauaagaaaagcggaauccaggaggucgauagaacgcucgccaaggagggcaucaaacgcggggaaacagaccaucacgcugugucccggggaucugccaagcugagaugguuuguugagcgcaacauggugacccccgaaggcaaagucguggaucuuggcugcgggcggggaggcuggagcuacuauugugggggacugaagaacguuagagaggugaagggccucaccaaagggggaccgggccaugaagaaccuauucccauguccacauacggcuggaaucugguccgccugcagagcgggguggacguguucuucacacccccugagaagugcgauacacuccuuugugacaucggagaauccucucccaacccuacgauugaggcgggccggacccugagaguucugaaucucgucgaaaacuggcugaauaacaauacacaauuuugcaucaaagugcuuaacccguauaugcccagcgugauugagaagauggaaacccugcagcgcaaauacgggggagcccucguccggaauccucuguccagaaacucuacacacgagauguacuggguuagcaaugcuaccggcaacaucguguccucugugaauaugaucagccgcaugcugauuaaccgguucacgaugaagcacaagaaagccaccuaugagcccgaugucgaccucggguccggaacaagaaauaucggcauugaaagcgagaucccuaaccuugacauuaucggcaagcgcauugagaagaucaagcaggagcaugaaaccucuuggcacuacgaucaggaccaucccuauaaaacaugggcuuaccacggguccuaugagaccaagcaaacaggaagcgccucuuccauggugaacggcguugugagacugcugaccaagccgugggaugucgugccuaugguuacgcagauggcuaugacagacaccacccccuuugggcagcagcggguguucaaagagaaggucgauacacgcacgcaagaaccuaaagagggaaccaagaaacucaugaagaucacagccgaauggcuguggaaggagcuuggcaaaaagaaaacccccagaauguguacacgggaggaauuuaccagaaaggugcggagcaaugcggcccugggggcuauuuucacagacgagaacaaauggaagucugcccgcgaagcuguggaggauuccagauuuugggaacucaucgaccgggagcgcaaucugcaccuggagggaaaaugcgaaaccugugucuacaacaugaugggcaagagagagaagaaacucggcgaguucgggaaggccaaaggaagccgggccauuugguauauguggcugggcgcgcgcuuucuugaguucgaagcucugggguuucucaaugaggaucauugguucuccagacggaacagccugucuggaguugagggcgaagggcuucaccgccugggcuacauccucagagacgugagcaagaaagagggaggcgccauguacgccgaugacacggcugggugggacacccggauuacacuggaagaucugaagaaugaggaaauggugaccaaccauaugaagggagagcacaaaaagcucgccgaggcuaucuuuaaacugacauaucagaauaaggucgugcgcguucagagaccuacaccccggggcacggugauggacaucauuucccgcagagaucagcgggggucuggacaagucggcacauacgggcuuaacaccuucacaaauauggaagcccagcugaucagacagauggagggcgaaggaauuuucaaaagcauccaacaucucaccgugacggaggagauugcgguucagaacuggcuggcccgcgugggccgggaaagacuuucccgcauggcuaucucuggggacgauugcgucgugaagccgcuggacgaucgguuugccagcgcucucaccgcccugaaugacaugggaaagguuagaaaagauauccagcagugggagccuucccgcggcuggaacgacuggacacaagugcccuucugcucucaccacuuucaugaacuggucaugaaggaugggcgggugcucgucgugcccuguagaaaucaggacgagcugauuggacgcgcgcggaucagccagggcgccggguggucccuuaaagaaaccgcuugccugggcaagagcuaugcccagauguggacacucauguacuuccacagacgcgaucugcggcuugcugccaacgcuauuuguucugccguuccuucccauugggugccgaccagcagaacaaccuggucuauccacgcgaaacacgaguggaugacgacagaggacaugcuggccgucuggaaccggguguggauucaagaaaaucccuggauggaggacaagaccccuguggaauccugggaggaaguucccuaucucggaaagagagaggaucaguggugcggcagccugaucgggcugaccucccgcgcuacaugggccaaaaacauucagaccgccaucaaucaggugcggucucucaucggaaacgaggaauacacagacuauaugccuagcaugaagagauuucgcagagaggaagaggaagcuggcguccugugguga

SEQ ID NO: 20287 - RNA, 9876 nt, Artificial Sequence
  derived and/or modified CDS sequence (opt5) from DENV-2__GQ398290__SS-prME
accgccggcgugaucauuaugcugauccccacggcuauggccuuccaccucacgacccggaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaacuucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuuuaacgaaaugguucugcuccagauggaggacaaggcuuggcuggugcaccgccaaugguuccuugaucugccgcucccuuggcugcccggggccgacacacagggaucuaauuggauccagaaggagacccuggucacguuuaagaacccucaugcuaaaaagcaggacgugguugugcucggcucccaagaaggggccaugcacacagcccugaccggcgcuacagagauucagaugagcuccggaaaucuucuguucaccggccaucucaaaugcagacugcggauggauaaacuucagcugaaagggaugucuuacagcauguguaccggaaaguucaagaucgucaaagaaauugcggagacacaacacggcacgaucgugaucagaguccaguaugagggggacggaucccccugcaagauucccuuugaaaucauggaucucgagaaacgccaugugcugggccggcugauuaccguuaacccuaucgugacagaaaaggacagcccggucaacauugaggccgaacccccuuucggggauucuuacaucauuaucggcguggagcccggacagcucaaacugaauugguuuaagaagggcuccagcaucgggcagauguucgagaccacaaugagaggagcuaaacgcauggccauucuuggcgacaccgccugggauuuugggucucugggaggcguuuucacgagcaucgggaaggcucuccaccaaguguuuggcgccauuuacggagcggcuuucuccggcgucucuuggacaaugaaaauccugauuggggugaucaucaccuggauuggaaugaacagccgguccaccagccugucugugucccuuguucucgucggcguggugacacuguaucugggggccaugguccaggccgacagcggaugugugguuucuuggaaguccaaagaacucaagugcggcagcgggaucuuuauuaccgauaaugugcacacauggacggagcaguacaaguuccagccugaaucccccucuaaacuggcuagcgccauccaaaaggcucaugaggaaggcauuuguggaaucagauccgucacccgccuugagaaccugauguggaaacagaucacaccggagcucaaucacauucugucugaaaacgaggugaagcugaccaucaugacaggcgacauuaaagggaucaugcaggccggaaagcggagccuuagaccucagcccaccgaacucaaauauuccuggaagacguggggcaaggcgaaaaugcugagcaccgagucucauaaucaaacauuucugauugaugggccugaaaccgccgagugccccaacacaaaucgcgcuuggaacucccucgagguugaagacuacggauucggcguguuuaccacaaauaucuggcugaaacuucgggagaaacaggacgucuucugugauagcaagcugaugucugccgcuaucaaagacaacagagccgugcacgcggauaugggcuauuggauugaauccgcccucaaugacaccuggaagauggagaaggcuagcuucaucgagguuaaaucuugccacuggccuaagagccauacgcugugguccaacggggugcuggaaagcgagaugauuauccccaaaaauuuugccggaccggucucucagcacaacuaccgcccuggcuaucauacacagaccgcugggcccuggcaccuuggaaagcucgaaauggauuucgaccugugugagggcaccacagugguggucaccgaaaacugcgggaaucggggacccucccugagaacgacaaccgccagcggcaaacucauuacagaguggugcugucgguccugcacccugccuccgcuucgcuacagaggcgaggauggguguugguacggaauggaaauccggccccugaaggagaaggaagagaaccucguuaauucucuggugacagccggccaugggcaaauugacaacuuuagccugggagugcuuggcauggcucucuuccuggaagagaugcugagaacccgcgucgggacgaaacacgcgauccuccugguggccguuuccuuugugacccuuaucacaggaaauaugucuuuccgggaucugggcagagucauggugaugguuggcgcuaccaugacagacgauauugggaugggagugaccuaucucgcccugcuggccgcuuuuaagguccgcccuacguucgccgcgggccuucugcucagaaaacugacaagcaaggagcucaugauggcuaccaucgggauugcccugcuuucccagucuacaauccccgaaaccauucuggagcucaccgacgcccuggcucugggaaugauggugcuuaaaaucguucggaacauggaaaaguaccagcuggccgugacaaucauggcgauuagcugcgucccuaaugcugugauccuccaaaacgccuggaagguguccuguacgauucuggccgcugucagcguuucuccccuccugcuuaccuccagccagcagaaagccgauuggaucccucuggcucucacaauuaagggccugaaucccaccgccaucuuucugacaacccuuucucgcacguccaaaaagagaagcuggccgcugaacgaggcgaucauggccguggggauggugucuauucucgcuuccagccugcucaaaaaugacaucccuaugacaggaccccuggucgccggcggccuucugaccgugugcuauguucugaccgggcgguccgcugaccucgaacuggagcgcgccgccgaugugaagugggaggaccaggcugaaauuagcggaucuagcccuauccuuuccauuacaaucucugaggauggcagcauguccauuaaaaacgaagaggaggaacaaacccugacaauccucaucagaacggggcugcucgucauuucuggaguguuccccguuagcaucccgauuaccgcggccgcuugguaccugugggaggugaagaagcagcgggccggcguccuuugggacgugccuucucccccucccgucgggaaagccgaacuggaggauggagcuuaucgcaucaagcagagaggcauucugggcuacagccagaucggggccggaguguauaaagaaggcacauuucacaccauguggcauguuacaagaggggcggugcucaugcaccgcggaaagagaaucgagcccagcugggcugacgucaaaaaggaucugauuuccuacggcgggggauggaaacuugagggcgaauggaaagagggcgaagaggugcaaguucuggcccucgaaccugggaagaauccgcgggccgugcagaccaaacccggacuguucaagacgaacaccggcacaaucggggcugucagccucgacuuuucuccuggaaccuccggcagccccauuguggauagaaaagggaaggugguuggacuguacggcaauggcgucgugacacgcucuggggccuauguguccgcgaucgcucagaccgaaaagagcauugaggacaacccugaaaucgaggaugacaucuuccggaaaaagagacuuacaauuauggaucugcaucccggagccggcaaaacgaagcgcuaccugccugccaucguccgggaagcuauuaaaagagggcuccgcacccugauccuugccccgacacgggugguugcugccgagauggaagaggcgcugagaggacuccccauucgcuaucagaccccugccauccgggcugagcacaccggcagagaaauuguggaccugaugugucaugccacauucacgaugcggcuccugucccccguccgcgugccuaacuacaaucuuaucaucauggacgaggcucacuuuaccgaucccgccucuauugccgcuagaggguauaucagcacacggguugaaaugggcgaggcggccggaauuuucaugaccgcuacaccgccuggcucccgcgaccccuuuccccaaagcaacgccccuaucauggaugaggaaagagagauucccgaacggucuuggaacuccgggcacgagugggugaccgacuucaagggaaagacggucugguuugugccuagcaucaaagccggcaacgauaucgcugccugccugagaaagaaugggaaaaagguuauucagcugucucgcaaaacauucgacagcgaauacgugaagacccgggcgaacgauugggacuuugucgugaccacagauaucuccgagaugggagcuaauuucaaggccgagagagugauugacccgcgccgguguaugaaacccgucauccucaccgauggcgaagagagaguuauucuggccgggccuaugcccgugacacauucuagcgcugcccagcgccggggcagaaucggacgcaacccuaagaaugaaaacgaccaauauaucuacaugggcgagccccuugaaaaugacgaggauugcgcgcacuggaaagaggccaagaugcugcucgacaacauuaauaccccggaagggaucauuccuuccauguuugagcccgaaagagagaaaguggaugcuaucgacggagaauaccggcugcgcggcgaggccagaaagacguucgucgaucugaugcggcgcggggaccucccuguguggcuugcuuauagaguugccgcugagggaauuaacuacgccgaucggagaugguguuuugacggcaucaaaaauaaccagauucuggaagagaacguggaagucgagaucuggacaaaggagggggaacgcaagaaacugaagccccgguggcucgaugcgagaaucuauucugacccucuggcccuuaaagaguucaaggaguucgcugccggccgcaaaagccugacccucaaucugauuacagagaugggacggcugcccaccuuuaugacgcagaaggcuagagaugcccucgacaaccuugccgugcugcauaccgcugaagcgggcgggcgggccuacaaucacgcucuguccgagcucccggagacacuggaaacccuucugcuccugacacugcucgccaccguuacaggaggcaucuuccuuuuucugaugagcgggcgcggaauuggcaagaugacccugggcaugugcugcaucauuacggccucuauccuccugugguaugcucagauccaaccucacuggauugccgcguccaucauucuugaguucuuucugaucgugcuccugauucccgaacccgagaaacagagaacaccucaggauaaccagcugaccuacgucgugaucgccauccucaccgucguggcugccacaauggcuaaugaaaugggguuccuugagaagaccaaaaaggaccugggacugggcagcauuacaacgcaagaguccgaaucuaacauccucgacauugaucugcggccggccagcgcguggacccuuuaugccguugcuacaaccuuugugacacccaugcugcgccauuccaucgaaaauucuagcgugaacgucucccucaccgccauugcuaaucaggccacgguucugauggggcugggaaaaggcuggccucucagcaagauggacaucggggugccccuucuggcuauuggauguuacucucaggugaacccuaucacccugacagccgcgcuccugcuucuggucgcccacuacgcuaucauuggccccggccuccaggccaaggcuaccagagaagcccaaaaacgggccgcggcugggaucaugaagaauccuacaguggauggaauuaccguuaucgaccuggagccgauucccuaugauccuaaauucgaaaagcagcugggccaggugaugcuccuuauccugugcgucacacaggugcugaugaugcgcacaaccugggcccucugugaggcucugacacuugccaccgggcccaucuccacccugugggagggaaacccuggcagauuuuggaauacaacgauugccgucagcauggcuaacaucuuccgggggucuuaccucgccggagcgggccugcuguuuuccauuaugaaaaauaccacaaacacccgcagaggcacagggaauaucggagaaacccucggcgagaaguggaagucccggcuuaacacgcuggggaaaucugaguuccaaauuuauaagaaaagcggaauccaggagguggacagaacacuggccaaggagggcaucaaacgcggggaaaccgaucaucacgcuguuucccggggaucugccaagcucagaugguuuguggagcgcaacauggucacccccgaaggcaaagugguugaccugggcugcgggcggggaggcuggagcuacuauugugggggacuuaagaaugugagagaggucaagggccugacaaaagggggaccgggccaugaagaaccuauucccauguccaccuacggcuggaaccucgugcgccugcagagcgggguggauguuuucuucacacccccugagaagugcgacacgcugcucugugauaucggagaauccucucccaauccuaccauugaggcuggccggacacuuagaguccugaaccugguggaaaauuggcucaacaauaacacccaauuuugcaucaaagugcugaauccguauaugcccagcgucauugagaagauggaaacacuucagcgcaaauacgggggagcccugguucggaacccucucuccagaaauucuacccacgagauguacugggugagcaacgcgacgggcaauaucguguccucugucaacaugaucagccgcaugcugauuaaucgguucaccaugaagcacaagaaagccacauaugagcccgacguggaucugggguccggaaccagaaacaucggcauugaaagcgagaucccuaaccucgacauuaucggcaagcgcauugagaagaucaagcaggagcaugaaacaucuuggcacuacgaccaggaucaucccuauaaaaccugggcuuaccacggguccuaugagacaaagcaaaccggaagcgccucuuccaugguuaauggcguggucagacuucugacgaagccgugggacgugguuccuauggugacacagauggcuaugaccgauaccacacccuuugggcagcagcgggucuucaaagagaagguggacacgcgcacccaagaaccuaaagagggaacaaagaaacugaugaagaucaccgccgaauggcucuggaaggagcugggcaaaaagaaaacacccagaauguguacccgggaggaauuuacaagaaaggugcggagcaacgcugcccuuggggcgauuuucaccgaugagaauaaauggaagucugcccgcgaagcugucgaggacuccagauuuugggaacugaucgaucgggagcgcaaccuccaccuggagggaaaaugcgaaacguguguuuacaauaugaugggcaagagagagaagaaacugggcgaguucgggaaggccaaaggaagccgggcuauuugguauauguggcucggcgcccgcuuucuggaguucgaagcccuuggguuucugaacgaggaccauugguucuccagaggaaauagccucucuggcguggagggggaaggccugcaccggcuuggauacauccugcgcgaugugagcaagaaagagggcggggcgauguacgcugacgauaccgccggaugggacacaagaauuacccucgaagaccugaagaacgaggaaauggucacaaaucauaugaagggcgagcacaaaaagcuggccgaggcuaucuuuaaacucaccuaucagaacaaggugguucgggugcagcgcccuacgcccagagggacagucauggauaucauuucccggcgcgaccagagaggaucuggccaaguggggaccuacggccugaauacauucaccaacauggaagcccagcuuauccggcagauggagggagaaggcauuuucaaaagcauccaacaucugacggcuaccgaggagauugccguucagaauuggcucgcgagaguggggcgcgaacggcuguccagaauggccaucucuggagaugacugcgucgugaagccgcuugaugaccgcuuugcuagcgcccugacagcucucaacgauaugggcaagguucggaaagacauccagcagugggagccuuccagaggguggaaugauuggacccaagugcccuucugcucucaccacuuucaugaacuggucaugaaggacggacgcgugcuggucgugcccugucggaaccaggaugagcucauuggcagagcccgcaucagccagggggcgggcuggucccugaaagaaacagccugccuuggaaagagcuaugcucagauguggacccugauguacuuccaccggagagaccuccgccuggccgcuaacgccauuuguucugcuguuccuucccauugggugccgacaagccggaccacguggucuauccacgccaaacacgaguggaugacaaccgaggauaugcuugcggucuggaauagaguguggauucaagaaaaccccuggauggaggacaagaccccuguggaauccugggaggaaguucccuaucugggcaagcgggaggaccaguggugcgggagccucaucggacugacauccagagccaccugggcuaaaaauauucagacagccaucaaccaggugcgcucucugaucggcaaugaggaauacacggauuauaugccuagcaugaagcgguuuagacgcgaggaagaggaagccgggguccucugguga

SEQ ID NO: 20288 - RNA, 9876 nt, Artificial Sequence
  derived and/or modified CDS sequence (opt5) from DENV-2__GQ398284__SS-prME
accgcgggagugaucauuaugcugauccccacagcuauggccuuccaccucacgaccagaaauggggaaccucauaugauuguugggaagcaggaaaagggcaagagccugcuuuuuaaaacagaggacgggguuaauaugugcacccugauggcgaucgaucucggagaacugugugaggacacaauuaccuacaagugcccgcuucugcggcaaaaugaacccgaggauaucgacuguuggugcaauuccacaucuaccugggugacguauggcaccuguacaaccacaggggagcacagaagagaaaaacggagcguggcucucgucccucaugugggaaugggccuggagacccgcacggaaacauggauguccucugagggcgccuggaagcacguucagagaaucgagaccuggauucugcggcaucccggguucacaaucauggccgcuauucucgccuacaccaucggaaccacacacuuucagcgcgcucugauuuucauccuucugacggccguggcgccuagcaugaccaugagaugcauuggcaucuccaaccgggauuuugucgaaggggugucuggaggcagcuggguugacaucgugcucgagcacggguccugugucacaaccauggccaagaauaaacccacacuggauuucgaacuuauuaagaccgaggcuaaacagccugccacgcugcgcaaguauugcaucgaagcuaaacucacaaacaccaccacagagagcagauguccgacccaaggagagcccucucugaaugaggaacaggacaagcgguuucugugcaagcauuccaugguggaucgcggcuggggcaacggguguggacucuucggcaaagggggaauugugacaugcgccauguuuacgugcaagaaaaauauggaaggcaaggucguucagccugagaaccuggaauacaccaucgugauuacaccccacagcggggaggagcaugcggugggaaaugacaccggcaaacacggcaaggaaaucaaaaucacaccucagucuuccauuaccgaggccgaacuuacgggguauggaaccgucacaauggaguguagccccagaaccggccuggauuucaacgaaauggugcuccugcaaauggaggacaaggcuuggcuuguucaccggcagugguuucuggaucucccgcugccuuggcugcccggggccgacacacagggaucuaauuggauccagaaggagacccucgugacguucaaaaacccucaugcuaagaaacaagacgucguggcccugggcucccaggaaggggccaugcacacagcucuuaccggcgcgacagagauucagaugagcuccggaaaucugcucuuuaccggccaucugaagugccgccuuagaauggauaaacugcaacucaaggggaugucuuacagcauguguaccggaaaguucaaaaucguuaaggaaauugccgagacacagcacggcacgaucgugauccggguccaguaugagggggacggaucccccugcaaaauucccuucgaaaucauggaucuggagaagagacaugugcugggccgccucauuaccgucaacccuaucgugacagaaaaagacagcccgguuaacauugaggcugaacccccuuuuggggauucuuacaucauuaucggcguggagcccggacagcugaaacuuaauugguucaagaaaggcuccagcaucgggcaaauguuugagaccacaaugcggggagccaagagaauggccauucugggcgacaccgcuugggauuucgggucucucggaggcgucuuuacgagcaucgggaaagcccugcaccagguguucggcgcgauuuaccgcgcugccuuuuccggaguuucuuggacaaugaagauccugauuggcgugaucaucaccuggauugggaugaacagccgguccaccagccuuucugucucccucgugcuggugggaguugucacacuguaucucggcgccauggugcaggcugacagcggguguguggucucuuggaaaaauaaggaacugaagugcggauccggcaucuucauuaccgauaacgugcacacauggacggagcaguacaaauuucaaccugaaagccccuccaaacuugccucugcuauccagaaagcccaugaggaagggauuuguggcaucagaagcguuacccgccuggagaaucucauguggaagcagaucacaccggagcugaaccacauucuguccgaaaaugaggugaaacuuaccaucaugacaggagacauuaagggcaucaugcaggcggggaaacggucucucagaccucaacccaccgaacugaaguauagcuggaagacguggggaaaagccaagaugcuguccaccgagagccauaaccagacauuccucauugauggcccugaaaccgcugagugccccaauacaaaccgcgccuggaacucucuggaggucgaagacuacggguuuggaguguucaccacaaacaucuggcuuaaacugcgggagaagcaggacgucuuuugugauuccaaacucaugagcgcugccaucaaggacaauagagcggugcacgccgauaugggcuauuggauugaaucugcucugaacgacaccuggaagauggagaaagccuccuucaucgaggucaagagcugccacuggccuaaaucucauacgcuguggagcaauggcgugcuugaauccgagaugauuauccccaagaacuucgcugggccgguuagccagcacaacuaccgcccuggauaucauacacaaaccgccggccccuggcaccucgggaaacuggaaauggauuuugacuucugugagggaaccacaguggucgugaccgaagauugcggcaaucgggggcccucucugagaacgacaaccgccuccggaaagcucauuacagaguggugcugucggagcugcacccugccuccgcuucgcuacagaggcgaggacggcuguugguacgggauggaaauccggccccugaaggagaaagaagagaaccucgugaauagccuggucacagcuggacauggccagauugauaacuuuucucuggggguucuuggaauggcccucuuccuggaagagaugcugagaacccgcgugggcacgaagcacgccauccuccugguggcugucagcuuugugacccuuaucacagggaauauguccuuccgggaccugggaagaguuauggugauggucggcgccaccaugacagaugacauuggcaugggggugaccuaucucgcccugcuggcugccuuuaaaguucgcccuacguucgcggcuggacuucugcucagaaagcugacaucuaaagagcucaugauggccaccaucggcauugcccugcuuagccaguccacaauccccgaaaccauucuggagcucaccgaugcucuggcccuggggaugauggugcuuaagaucguccggaacauggaaaaguaccaacuggcggugacaaucauggcuauuucuugcguuccuaaugccgugauccuccagaacgccuggaaagucagcuguacgauucuggcugccguguccgugagcccccuccugcuuaccucuucccagcagaaggcugacuggaucccucuggcccucacaauuaaaggacugaaucccaccgcgaucuuucugacaacccuuagccgcacgucuaagaaaagauccuggccgcugaacgaggccaucauggcugucggcaugguuagcauucucgccucuucccugcucaagaaugacaucccuaugacagggccccugguggcuggaggccuucugaccgugugcuauguccugaccggccggagcgccgaucucgaacuggagcgcgccgcugacgugaaaugggaggaucaagcggaaauuuccgggagcucuccuauccuuagcauuacaaucuccgaggacggaucuaugagcauuaagaacgaagaggaggaacagacccugacaauccucaucagaacgggccugcucguuauuuccgggguguuccccgucucuaucccgauuaccgccgcugccugguaccugugggaggugaagaaacagcgggccggaguucuuugggaugugccuucucccccucccgucggcaaggcugaacuggaggacggggccuaucgcaucaaacagagaggcauucugggcuacucccaaaucggcgcggggguguauaaggaaggaacauuucacaccauguggcaugucacacggggcgcugugcucaugcaccgcgggaaaagaaucgagcccuccugggccgauguuaagaaggaccugauuagcuacggaggcggguggaaacuugagggagaauggaaggagggcgaagaggugcagguccuggcccucgaaccuggcaaaaauccgcgggcugugcagaccaagcccgggcuguucaaaacgaacaccggaacaaucggcgccguuucccucgauuuuagcccugggaccucuggaucccccauuguggacagaaagggcaaggucguggggcuguacggaaauggcgugguuacacgcagcggcgcguaugucucugcuaucgcccagaccgagaaauccauugaggauaacccugaaaucgaggacgauaucuuccggaagaaaagacuuacaauuauggaccugcaucccggggccggaaagacgaaacgcuaccugccugcuaucgugcgggaagccauuaagagaggccuccgcacccugauccuugcuccgacacggguggucgccgcggagauggaagaggcccugagagggcuccccauucgcuaucaaaccccugcuauccgggccgagcacaccggaagagaaauuguggaccugaugugucaugcuacauucacgaugcggcuccugagccccguucgcgugccuaacuacaaucuuaucaucauggaugaggcccacuuuaccgaccccgccuccauugcugcgagaggcuauaucucuacacgggucgaaaugggggaggccgcuggcauuuucaugaccgccacaccgccuggaagccgcgaucccuuuccccaguccaacgccccuaucauggacgaggaaagagagauucccgaacggagcuggaacucuggccacgagugggugaccgauuucaaggggaaaacgguuugguuugugccuuccaucaaggcuggaaacgacaucgccgcgugccugcgcaagaauggcaagaaagucauucagcugagccgcaagacauucgauucugaauacgugaagacccgggcuaacgacugggauuuuguugugaccacagacaucagcgagaugggggccaauuucaaagccgagagagucauugauccgcgccgguguaugaagcccgugauccucaccgacggagaagagagagugauucuggcuggcccuaugcccgucacacauuccucugccgcgcaacgccgggggagaaucggccgcaacccuaaaaaugaaaacgaccaguauaucuacaugggagagccccuugaaaaugaugaggacugcgcccacuggaaggaggcuaaaaugcugcucgauaacauuaauaccccggaaggcaucauuccuagcauguuugagcccgaaagagagaagguugacgccaucgauggggaauaccggcugcgcggagaggcuagaaaaacguucguggaccugaugcggcgcggcgaucucccuguguggcuugccuauagagucgcugccgaggggauuaacuacgcggaccggagaugguguuuugauggaaucaagaauaaccagauucuggaagagaacguggaaguugagaucuggacaaaggagggcgaacgcaaaaagcugaaaccccgguggcucgacgccagaaucuauuccgauccucuggcucuuaaggaguucaaagaguucgccgcugggcgcaagucucugacccucaaucugauuacagagaugggccggcugcccaccuuuaugacgcagaaggccagagacgcccucgauaaccuugcugugcugcauaccgcggaagccggaggcaaggcuuacaaucacgcccugagcgagcucccggagacacuggaaacccuucugcuccugacacugcucgccaccgucacagggggaaucuuccuuuuucugauguccggcaaggggauuggaaaaaugacccugggcaugugcugcaucauuacggcuagcauccuccugugguaugcccaaauccagccucacuggauugcggccucuaucauucuugaguucuuucugaucgugcuccugauucccgaacccgagaagcagcggacaccucaggacaaccaacugaccuacguugugaucgcuauccucaccgucguggccgcuacaauggccaaugaaaugggcuuccuugagaaaaccaagaaggaccuggggcugggauccauuaucacacaggagagcgaauccaacauucucgauaucgaccugcgcccggcgucugccuggacgcuuuaugcugucgccaccacauuugugacccccaugcugagacauagcauugaaaauuccucuguuaacgugagccucacagcuaucgccaaucaggcuaccgugcugaugggccuggggaaaggauggccucucuccaagauggauauuggcgucccccuucuggccaucggguguuacagccagguuaacccuaucacgcugaccgcggcccuccugcuucugguggcucacuacgccauuaucggacccggccuccaagcuaaagccacacgggaagcccagaagcgcgcggcugccggcauuaugaaaaauccuaccguggacgggaucacagucauugaucuggagccgauccccuaugacccuaaguucgaaaagcagcugggacaggugaugcuccuuauccugugcguuacccaagugcugaugaugagaacgacaugggcucucugugaggcccugacccuugccacaggccccauuucuacccugugggaggggaacccuggacgguuuuggaauaccacaaucgcugucuccauggccaacauuuuccgcggcagcuaccucgcgggggccggacugcuguuuucuaucaugaaaaauacgaccaacacaagacggggcaccggcaauauuggggaaacacucggagagaaguggaaaucccgccuuaacgcucugggcaagagcgaguuccagaucuauaaaaagucugggauccaggagguggauagaacccuggccaaagagggaauuaagcggggcgaaacggaccaucacgcugucagcagaggguccgccaagcuccgcugguuuguggagcggaacaugguuacacccgaaggaaaaguggucgaucugggcugcggcagagggggauggucuuacuauuguggcgggcuuaagaaugugcgcgagguuaaaggacugaccaagggcgggccgggacaugaagaaccuauccccaugagcaccuacggcuggaaccucgugcggcugcaauccggcgucgacguguucuucacacccccugagaaaugcgauacccugcucugugacauuggggaaagcucccccaauccuacaaucgaggcgggaagaacgcuucgcgugcugaaccugguugaaaauuggcucaacaauaacacccaguuuugcauuaagguccugaauccguauaugcccucugugaucgagaagauggaaacacuucagcggaaauacggcggggcccuggugagaaacccucucagccgcaauuccacccacgagauguacugggucucuaacgcuacaggaaauaucguuagcuccgugaacaugauuucucggaugcugaucaauagauucaccaugaagcacaaaaaggccacguaugagcccgauguggaccugggcagcgggacccgcaacauuggaaucgaauccgagauuccuaaccucgacaucauuggcaaacggaucgaaaagaucaagcaggagcaugaaacaagcuggcacuacgaucaagaccaucccuauaaaaccugggcuuaccacggcucuuaugagacaaagcagaccggguccgccagcucuauggucaauggagugguuagacuucugacaaaaccgugggauguggucccuauggugacccagauggcuaugacggacacaacccccuuuggccagcaacgcguuuucaaggagaaaguggauaccagaacacaggaaccuaaggaggggacgaagaaacugaugaagauuaccgccgaauggcucuggaaagagcugggaaagaaaaagacaccccggauguguacccgcgaggaauuuacaagaaaaguccgguccaacgcggcccuuggcgcuaucuucaccgacgagaauaaguggaaaagcgccagagaagcuguggaggauucucgguuuugggaacugguggaccgcgagagaaaccuccaccuggaggggaaaugcgaaacaugugucuacaauaugaugggaaagcgggagaaaaagcugggcgaguucggcaaagccaaggggucccgcgccauuugguauauguggcucggagcgagauuucuggaguucgaagcucuuggcuuucugaacgaggaucauugguucagccggggaaauucccucagcggaguugagggcgaagggcugcaccgccuuggcuacauccugagagacgugucuaagaaagagggaggcgccauguacgccgaugacaccgcugggugggacacgcggauuacccucgaagaucugaagaacgaggaaauggugacaaaucauaugaaaggagagcacaagaaacuggccgaggcuaucuuuaagcucaccuaucagaacaaggucgugcgcguucagagaccuacaccccggggcaccgugauggacaucauuagccgcagagaucaacggggguccggacaggucggcacguacgggcugaauacauucaccaacauggaagcccagcuuauccgccaaauggagggcgaaggaauuuucaaaucuauccagcaucugacagugaccgaggagauugcgguucagaauuggcucgccagagugggccgggaaagacugagccgcauggcuaucuccggggacgauugcgucgugaagccgcuugacgaucgguuugccucugcucugacggcccucaacgacaugggaaaaguuagaaaggauauccagcaaugggagccuagccgcggcuggaaugacuggacccaggugcccuucugcucccaccacuuucaugaacuggucaugaaagaugggcgggugcuggucgugcccuguagaaaccaggacgagcucauuggacgcgcgcggaucucucagggcgccggguggagccugaaggaaacagcuugccuuggcaaguccuaugcccaaauguggacccugauguacuuccacagacgcgaucuccggcuggcugccaacgcuauuuguagcgccguuccuucucauugggugccgacauccagaaccacauggagcauccacgcgaaucacgaguggaugaccacggaggacaugcuugccgucuggaaccgcguguggauucaggaaaaucccuggauggaggacaaaacaccuguggaaucuugggaggaaguucccuaucugggaaagcgggaggaucaguggugcggcucccucaucgggcugaccagcagagcuaccugggccaaaaacauucagacagccaucaaucaagugcggucccugaucggaaacgaggaauacaccgacuauaugccuucuaugaagagauuucgccgggaggaagaggaagcuggcguccucugguga

SEQ ID NO: 20289 - RNA, 9876 nt, Artificial Sequence
  derived and/or modified CDS sequence (opt5) from DENV-2__GQ398308__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaagcuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucagcacaaauaucuggcuuaagcugcgggagaaacaggacgucuuuugugauucuaagcucauguccgcugccaucaaagacaacagagcggugcacgccgauaugggcuauuggauugaaagcgcucugaaugacaccuggaagauggagaaggccucuuucaucgagguuaaaagcugccacuggccuaagucccauacacuguggagcaacggggugcuugaaucugagaugauuauccccaaaaauuucgcuggaccggucucccagcacaacuaccgcccuggcuaucauacccagacggccgggcccuggcaccucggaaagcuggaaauggauuuugacuucugugagggcacaaccgugguggucaccgaagauugcgggaaccggggacccagccugagaacaaccacggccuccggcaaacucauuacagaguggugcugucggucuugcacccugccuccgcuucgcuacagaggcgaggacggguguugguacggaauggaaauccggccccugaaggagaaggaagagaaucucguuaacagccuggugacagcuggccaugggcaaauugauaauuuuucccugggagugcuuggcauggcgcucuuccuggaagagaugcugagaacccgcgucgggacaaaacacgccaugcuccugguggcuguuucuuuugugacccuuaucacgggaaacaugagcuuccgggaccugggcagagucauggugaugguuggcgccaccaugacagaugacaucgggaugggaauuaccuaucucgcccugcuggcugccuuuaaggugcgcccuacauucgcggcuggccuucugcucagaaaacugaccuccaaggagcucaugauggccacgaucgggauugcccugcuuucucagagcacaauccccgaaaccauucuggagcucacagaugcucuggcccugggaaugaugguccuuaaaaucgugcggaauauggaaaaguaccagcuggcgguuaccaucauggcuauuuccugcgugccuaacgccgucauccuccaaaaugccuggaaggugagcuguaccauucuggcugccgugucugucuccccccuccugcuuacaagcucucagcagaaagcugacuggaucccucuggcccucacgauuaagggccugaaccccaccgcgaucuuucugacaacccuuucccgcacaagcaaaaagagaucuuggccgcugaaugaggccaucauggcuguugggaugguguccauucucgccagcucccugcucaaaaacgacaucccuaugaccggaccccugguggcuggcggccuucugacggucugcuaugugcugacagggcggagcgccgaucucgaacuggagcgcgccgcugacguuaagugggaggaucaggcggaaauuucuggaagcuccccuauccuuucuauuaccaucagcgaggacggcuccaugucuauuaaaaaugaagaggaggaacaaacccugacaauccucaucagaaccgggcugcucgugauuagcggagucuuccccguguccaucccgauuacagccgcugccugguaccugugggagguuaagaagcagcgggccggcgugcuuugggaugucccuucucccccucccguggggaaagcugaacuggaggacggagccuaucgcaucaagcagagaggcauucugggcuacagccagaucggggcgggagucuauaaagaaggcacguuucacaccauguggcaugugacacggggggcuguucucaugcaccgcggaaagagaaucgagcccuccugggccgaugugaaaaaggaccugauuagcuacggcgggggauggaagcuugagggcgaauggaaagagggcgaagagguccaagugcuggcccucgaaccugggaagaacccgcgggcuguucagaccaaacccggacuguucaagacaaauaccggcacgaucggggccgugucucucgauuuuuccccuggaaccagcggcucucccauugucgacagaaaagggaagguggugggacuguacggcaacggcguugucacacgcuccggggcguaugugagcgcuaucgcccagaccgagaaguccauugaggauaauccugaaaucgaggacgauaucuuccggaaaaagagacuuacaauuauggaccugcaucccggagccggcaaaaccaagcgcuaccugccugcuaucgugcgggaagccauuaaaagagggcuccgcacacugauccuugcuccgacgcgggucguggccgcggagauggaagaggcccugagaggacuccccauucgcuaucagaccccugcuauccgggccgagcacacaggcagagaaauuguugaccugaugugucaugcuaccuucaccaugcggcuccugucucccgugcgcgucccuaacuacaaccuuaucaucauggaugaggcccacuuuacagaccccgccagcauugcugcgagaggguauaucuccacgcggguggaaaugggcgaggccgcuggaauuuucaugaccgccacaccgccuggcagccgcgaucccuuuccccaaucuaaugccccuaucauggacgaggaaagagagauucccgaacgguccuggaacagcgggcacgaguggguuaccgauuucaagggaaagacagugugguuugucccuucuaucaaagcuggcaaugacaucgccgcgugccugagaaagaacgggaaaaaggugauucagcugagccgcaaaaccuucgauuccgaauacguuaagacgcgggcuaaugacugggauuuuguggucacaaccgacaucucugagaugggagccaacuucaaggccgagagagugauugauccgcgccgguguaugaaacccgugauccucaccgacggcgaagagagagucauucuggcugggccuaugcccguuacacauagcuccgccgcgcagcgccggggcagaaucggacgcaauccuaagaacgaaaaugaccaauauaucuacaugggcgagccccuugaaaacgaugaggacugcgcccacuggaaagaggcuaagaugcugcucgauaauauuaacaccccggaagggaucauuccuucuauguuugagcccgaaagagagaaaguggacgccaucgauggagaauaccggcugcgcggcgaggcuagaaagacauucguggaccugaugcggcgcggggaucucccugucuggcuugccuauagaguggcugccgagggaauuaauuacgcggaccggagaugguguuuugauggcaucaaaaacaaucagauucuggaagagaacguugaaguggagaucuggaccaaggagggggaacgcaagaaacugaagccccgguggcucgacgccagaaucuauagcgauccucuggcucuuaaagaguucaaggaauucgccgcuggccgcaaaucccugacgcucaaccugauuacagagaugggacggcugcccaccuuuaugacacagaaggccagagacgcccucgauaaucuugcuguccugcauaccgcggaagccggcgggcgggcuuacaaccacgcccugagcgagcucccggagacgcuggaaacccuucugcuccugacacugcucgccaccgugacaggaggcaucuuccuuuuucugaugucugggaagggaauuggcaaaaugacccugggcaugugcugcaucauuacagcuuccauccuccugugguaugcccagauccaaccucacuggauugcggccagcaucauucuugaguucuuucugaucguucuccugauucccgaacccgagaagcagcgcaccccucaggacaaucagcugacguacguggucaucgcuauccucacaguggucgccgcuaccauggccaacgaaaugggguuccuugagaaaaccaagaaagaccugggacugggcuccauugcgacacaagagucugaaagcaauauccucgauauugaccugagaccggccuccgcuuggacccuuuaugccguggcuacaacguuuguuacccccaugcugcggcauucuaucgagaacagcuccgugaaugugagccucacagccauugcuaaccaggccaccguccugauggggcugggaaagggcuggccucucucuaagauggauaucgggguuccccuucuggcgauuggauguuacucccaggugaauccuaucacacugaccgccgcucuccugcuucugguggcccacuacgcuaucauuggccccggccuccaggccaaagccacgcgcgaagcgcaaaagagagcugccgcugggaucaugaaaaacccuaccgucgacggaauuacagugaucgaucuggagccgauucccuaugacccuaaguucgaaaaacagcugggccagguuaugcuccuuauccugugcgugacccagguccugaugaugcggacaaccugggcccucugugaggcccugacgcuugcuacagggcccaucagcacccugugggagggaaauccuggccgcuuuuggaacacaaccauugccgugucuauggcgaauaucuucagaggguccuaccucgccggagcuggccugcuguuuagcauuaugaagaacaccacaaauacgcggcgcggcaccgggaacaucggagaaacacucggcgagaaguggaaaucuagacuuaaugcccuggggaagagcgaauuccaaauuuauaaaaaguccggaauccaggaggucgaucggacccuggcuaaagagggcaucaagagaggggaaacagaccaucacgccgugucucgcggaagcgcgaaacuccggugguuuguugagagaaacauggugacccccgaaggcaaggucguggaucugggcugcgggcgcggaggcugguccuacuauugugggggacuuaagaacguucgggaggugaaaggccugacgaaggggggaccgggccaugaagagccuauucccaugagcacauacggcuggaaucucgucagacugcaguccgggguggacguguucuucacccccccugagaaaugcgauacccugcucugugacaucggagaaucuagccccaacccuacaauugaggccggccgcacccuucggguucugaaucuggucgaaaacuggcucaauaacgauacacaauuuugcaucaaggugcugaauccguauaugcccuccgugauugagaaaauggaaacgcuucagagaaaguacgggggagcuaucguccgcaacccucugucucggaauagcacccacgagauguacuggguuuccaacgccacaggcaauaucgugucuagcgugaacaugauuuccagaaugcucaucaaucgcuucaccaugaagcacaaaaaggcuacauaugagcccgacgucgaccuggggagcggaacccggaacauuggcaucgaaucugagauuccuaaucuggauaucauuggcaaaagaaucgaaaagaucaaacaggagcaugaaacguccuggcacuacgaccaggaucaucccuauaagaccugggccuaccacgggagcuaugagacaaagcaaaccggaucugcuuccagcauggugaacggcguugugcgccuccuuacaaaaccgugggacgucgugccuaugguuacccagauggccaugacagauaccacgcccuuugggcagcagagaguguucaaggagaaagucgacacacggacccaagaaccuaaggagggaaccaaaaagcugaugaagauuacagcggaauggcuguggaaagagcucggcaagaaaaagacgccccgcauguguaccagagaggaauuuacacggaaagugagaucuaacgccgcucugggggccaucuucaccgaugagaauaaguggaaauccgcucgggaagccguggaggacagccgcuuuugggaacuuauugauagagagcggaaccugcaccucgagggaaagugcgaaacaugugucuacaauaugaugggcaagcgcgagaaaaagcugggcgaauucgggaaagccaagggauccagagcgaucugguauauguggcugggcgcucgguuucucgaguucgaagcccugggguuucuuaacgaggaccauugguucagccgcggaaauucucugagcggcguugagggggaaggccuccacagacugggauacauucuucgggauguguccaaaaaggagggcggggccauguacgcugacgacaccgccggaugggauacacgcaucacccuggaagaccucaagaacgaggaaauggugacgaaucauaugaaaggcgagcacaagaaacuggcugaggccaucuuuaagcugaccuaucagaacaaagucgugagaguucagcggccuacaccccgcgggaccgugauggauauuaucucuagacgggaccagcgcggaagcggccaagucgggacauacggccucaauaccuucacgaacauggaagcgcagcugauuagacagauggagggagaaggcaucuucaaguccauucaacaucuuacagugaccgaggagaucgccguucagaauuggcuggcucggguggggagagaacgccucucucggauggccaucagcggagaugacugcgucgugaagccgcuggaugacagauuugcuuccgcccuuacagcgcugaacgauaugggcaaaguucgcaaggacauucagcagugggagccuucucggggguggaaugauuggacccaagugcccuucugcagccaccacuuucaugaacucgucaugaaagacggaagagugcuggucgugcccugucgcaaccaggaugagcugaucggccgggccagaauuucccagggggcuggcuggagccucaaggaaacggccugccugggaaaaucuuaugcucagauguggacccuuauguacuuccaccgccgggaccugagacucgccgcuaaugccaucuguuccgcgguuccuagccauugggugccgacaucucgcaccacaugguccauucacgccaagcacgaguggaugaccacagaggacaugcugaccgucuggaaccggguguggauccaagaaaaccccuggauggaggauaagacgccuguggaaagcugggaggaaguucccuaucuuggcaaaagagaggaccaguggugcgggucccugauuggacucacaucucgggcuaccugggccaagaauauccagaccgccaucaaccaggugagaagccugauuggcaaugaggaauacacagauuauaugccuuccaugaaacgcuuucggagagaggaagaggaagcugggguccugugguga

SEQ ID NO: 20290 - RNA, 9876 nt, Artificial Sequence
  derived and/or modified CDS sequence (opt5) from DENV-2__GQ398287__SS-prME
accgccggagugaucauuaugcugauccccacagcuauggccuuccaccucacgaccagaaacggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaggaacaggacaaacgcuuugugugcaagcauuccaugguggauagaggcuggggcaacggguguggacuguucggcaaaggcgggauugucacaugcgcgauguuuacaugcaaaaagaauauggaagggaaaguugugcucccugagaaccuggaauacacgaucgugauuacaccccacagcggggaggagcaugccgucggaaaugacacaggcaagcacggcaaagaaaucaagaucaccccucagucuuccauuacagaggcugaacuuaccggguauggaacggugaccauggaguguagcccccggacaggccuggauuucaacgaaaugguucuccugcagauggaggacaaagccuggcuugugcaccgccaaugguuucuggaucucccgcugccuuggcugcccggggcugacacccagggaucuaauuggauccagaaggagacacucgucaccuucaagaacccucaugccaaaaagcaggacgugguugugcugggcucccaagaaggggccaugcacacggcucuuacaggcgcgaccgagauucagaugagcuccggaaaucugcucuuuacaggccaucugaaaugcagacuucggauggauaagcugcagcucaaagggaugucuuacagcauguguaccggaaaguucaagaucgucaaagaaauugccgagacccaacacggcacaaucgugaucagaguccaguaugagggggacggaucccccugcaagauucccuucgaaaucauggaucuggagaaacgccaugugcugggccggcucauuacgguuaacccuaucgugaccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaaucucgcuggaccggucucucagcacaacuaccgcccuggcuaucauacgcagacagccgggcccuggcaccugggaaagcuggaaauggauuucgacuuuugugagggcaccaccgugguggucacagaagauugcgggaaccggggacccucccucagaaccacgacagccagcggcaaacugauuaccgaguggugcugucgguccugcacacuuccuccgcugcgcuacagaggcgaggacggguguugguacggaauggaaauccggccccucaaggagaaggaagagaaucugguuaacucucuggugaccgcuggccaugggcaaauugauaauuucagccuuggagugcucggcauggcgcuguuucuggaagagaugcucagaacacgcgucgggaccaaacacgccauccugcuuaucgcuguguccuucguuacgcugauuaccggaaacaugucuuuucgggaccucggcagagugauggucauggugggcgccacaaugaccgaugacaucgggaugggaguuacauaucuggcccugcuugcugccuucaaggugcgcccuaccuuugcggcuggccugcuccugagaaaacucacgagcaaggagcugaugauggccacaauugggaucgcccuucugucccagucuaccauucccgaaacaauccucgagcugaccgaugcucuggcccuuggaaugaugguccugaaaaucgugcggaauauggaaaaguaccagcucgcgguuaccauuauggcuaucagcugcgugccuaacgccgucauucugcaaaaugccuggaagguguccuguacaauccucgcugccgugagcgucucuccccugcuucugacguccagccagcagaaagcugacuggauuccucucgcccugaccaucaagggccugaaccccacagcgaucuuccuuaccacacugucucgcaccuccaaaaagagaagcuggccgcucaaugaggccauuauggcuguugggauggugucuauccuggccuccagccuccugaaaaacgacauuccuaugacgggaccccuuguggcuggcggccugcugacagucugcuaugugcucaccgggcgguccgccgaucuggaacuugagcgcgccgcugacguuaagugggaggaucaggcggaaaucagcggaucuagcccuauucuguccaucaccauuucugaggacggcagcauguccaucaaaaaugaagaggaggaacaaacacucaccauccugauuagaacagggcuccuggugaucucuggagucuuucccgugagcauuccgaucacggccgcugccugguaccuuugggagguuaagaagcagcgggccggcgugcugugggaugucccuucucccccucccguggaaaaagcugagcuggaagacggggccuaucgcauuaagcagagaggaauccucggcuacagccagaucggcgcgggggucuauaaagagggaaccuuccacacaauguggcaugugacccggggcgcuguucugaugcaccgcgggaagagaauugagcccagcugggccgaugugaaaaaggaccuuaucuccuacggaggcggguggaagcuggaaggagaguggaaagaaggcgaggaaguccaagugcucgcccuggagccuggcaagaacccgcgggcuguucagacaaaacccgggcucuuuaagaccaauacgggaaccauuggcgccgugagccuggauuucucuccugggacauccggaagccccaucgucgacagaaaaggcaaggugguggggcuuuacggaaacggcguugucacccgcucuggcgcguauguguccgcuauugcccagacagaaaagagcaucgaggauaauccugagaucgaagacgauauuuuucggaaaaagagacugaccaucauggaccugcaucccggggccggaaaaacaaagcgcuaccucccugcuauugugcgggaggccaucaaaagaggccugcgcacgcuuauucuggcuccgacccgggucguggccgcggaaauggaggaggcccucagagggcugcccauccgcuaucagaccccugcuauucgggccgaacacaccggaagagagaucguugaccucaugugucaugcuaccuucacaaugcggcugcuuucccccgugcgcgucccuaacuacaaccugaucauuauggaugaagcccacuucacggaccccgccucuaucgcugcgagaggcuauauuagcacccggguggagaugggggaggccgcuggcaucuuuaugacagccaccccgccuggaucccgcgaucccuucccccaaagcaaugccccuauuauggacgaagagagagaaauccccgagcggucuuggaacuccggccacgaauggguuacagauuuuaaggggaagaccgugugguucgucccuagcaucaaagcuggaaaugacauugccgcgugccugagaaagaacggcaaaaaggugauccagcucucucgcaaaacguuugauagcgaguacguuaagacacgggcuaaugacugggauuucguggucaccaccgacauuuccgagaugggggccaacuuuaaggccgaaagagugaucgauccgcgccgguguaugaaacccgugauucugacagacggagaggaaagagucauccuugcuggcccuaugcccguuacccauucuagcgccgcgcagcgccgggggagaaucggccgcaauccuaagaacgagaaugaccaauauauuuacaugggagaaccccuggagaacgaugaggacugcgcccacuggaaagaagcuaagaugcuccuggauaauaucaacacaccggagggcauuaucccuucccuguucgaacccgagagagaaaaaguggacgccauugauggggaguaccggcuccgcggagaggcuagaaagaccuuuguggaccuuaugcggcgcggcgaucugccugucuggcuggccuauagaguggcugccgaagggaucaauuacgcggaccggagaugguguuucgauggaauuaaaaacaaucagauccucgaggaaaacguugagguggagaucuggacgaaggaaggcgagcgcaagaaacugaagccccgguggcuugacgccagaauuuauucugauccucuggcucucaaagaauuuaaggaguucgccgcugggcgcaaaagccugacacugaaccucaucaccgaaaugggccggcuucccacauucaugacccagaaggccagagacgcccuggauaaucuggcuguccuccauacggcggaggccggaggccgggcuuacaaccacgcccuguccgagcuuccggaaacccuggagacacuccugcugcucacccuucuggccacagugaccgggggaauuuuucuguuccucaugagcggccgcgggaucggaaagaugacacugggcaugugcugcauuaucaccgcuucuauccuucugugguaugcccagauucaaccucacuggaucgcggccuccauuauccucgaauuuuuccugauuguucugcucauccccgagcccgaaaaacagagaacgccucaggacaaucagcuuacauacguggucaucgcuauucugaccguggucgccgcuaccauggccaacgagaugggcuuucuggagaagaccaagaaggaccucgggcugggaagcaucaccacacaagaauccgagucuaauauucuugauaucgaccugcggccggcgagcgccuggacgcucuaugcuguggccaccacauucguuacccccaugcugcgccauuccauugaaaacucuagcgugaaugugucccugacagcuaucgccaaccaggcuaccguccucaugggccuugggaaaggauggccucugagcaagauggauauuggcguuccccugcucgccaucggguguuacucucaggugaauccuaucacgcugaccgcggcccuucugcuccugguggcucacuacgccauuaucggacccggccugcaggcuaaggccacaagagaggcccaaaaacgggcggcugccggcauuaugaagaacccuaccgucgacgggaucacagugauugaucucgaaccgauccccuaugacccuaaauuugagaagcagcuuggacagguuaugcugcugauccucugcgugacccagguccugaugaugcgcacgacaugggcucuuugugaggcccugacccucgccacaggccccauuuccacccugugggaagggaauccuggaagauucuggaacaccacaaucgcugugagcauggccaauauuuuucggggcucuuaccuggcgggggccggacuccuuuucuccaucaugaaaaacacgaccaauacacgcagaggcaccggcaacauuggggagacacugggagaaaaguggaagucccggcugaaugcucucggcaaaucugaguuucaaaucuauaagaaaagcgggauccaggaggucgauagaacccuggccaaggaaggaauuaaacgcggcgagacggaccaucacgcugugucccgggggucugccaaacuuagaugguucguugaacgcaacauggugacacccgagggaaaagucguggaucugggcugcggcagagggggauggagcuacuauuguggcgggcucaagaacguuagagaagugaagggacugaccaaaggcgggccgggacaugaggagccuauccccauguccaccuacggcuggaaucugguccgccuccagagcggcguggacguguuuuucacacccccugaaaagugcgauaccguucuuugugacauuggggaguccucucccaacccuacaaucgaagcgggacggacgcugagaguccugaaucucguggagaacuggcugaauaacaauacccaauucugcauuaaagugcuuaacccguauaugcccagcgucaucgaaaagauggagacacugcagcgcaaauacggcggggcccucguucggaauccucuguccagaaacucuacccacgagauguacugggugagcaaugcuacaggaaacaucguguccucugucaauaugauuagccgcaugcugaucaaccgguuuaccaugaagcacaagaaagccacguaugaacccgauguggaccucggcuccgggaccagaaauauuggaaucgagagcgaaauuccuaaccuugacaucauuggcaagcgcaucgagaaaaucaagcaggaacaugagacaucuuggcacuacgaucaggaccaucccuauaaaaccugggcuuaccacggcuccuaugagacaaagcaaaccgggagcgccucuuccaugguuaacggaguggucagacugcugacaaagccgugggaugugguuccuauggugacccagauggcuaugacggacacaacccccuucggccagcagcgggucuuuaaagaaaagguggauacccgcacacaagagccuaaagaagggacgaagaaacucaugaagauuaccgccgaguggcuguggaaggagcuuggcaagaagaaaacacccagaauguguacccgggaagaguucacaagaaaggugcggagcaaugcggcccugggcgcuaucuuuaccgacgaaaacaaauggaagucugcccgcgaggcugucgaagauuccagauucugggagcucauugaccgggagcgcaaucugcaccuggaagggaaaugcgagacauguguuuacaacaugaugggaaagagagaaaagaaacucggcgaguuuggcaaggccaaagggagccgggccaucugguauauguggcugggagcgcgcuuccuugaauuugaggcucugggcuuccucaaugaggaucauugguuuuccagacggaacagccugucugggguggaaggagagggccuucaccgccugggguacauucucagagacgugagcaagaaagaaggcggagccauguacgccgaugacaccgcuggcugggacacgcggaucacccuggaggaucugaagaaugaagagauggucacaaaccauaugaagggggagcacaaaaagcucgccgaagcuaucuucaaacugaccuaucagaauaaggugguucgcgugcagagaccuacaccccggggaaccgucauggacauuaucucccgcagagaucagcggggcucugggcaagugggaacguacggccuuaacacauuuaccaauauggaggcccagcugauuagacagauggaaggggagggcaucuucaaaagcauucaacaucucacaguuaccgaggaaaucgcggugcagaacuggcuggcccgcgucggacgggagagacuuucccgcauggcuaucucuggcgacgauugcgugguuaagccgcuggacgaucgguucgccagcgcucucacggcccugaaugacauggggaaggugagaaaagauauucagcagugggaaccuucccgcggauggaacgacuggacccaaguccccuuuugcucucaccacuuccaugagcuggugaugaaggauggccggguccucgugguucccuguagaaaucaggacgaacugaucgggcgcgcgcggauuagccagggagccggcuggucccuuaaagagacagcuugccugggaaagagcuaugcccagauguggacccucauguacuuucacagacgcgaucugcggcuugcugccaacgcuaucuguucugccgugccuucccauugggucccgacaagcagaaccacauggucuauucacgcgaaacacgaguggaugaccacggaagacaugcuggccguguggaaccggguguggauccaagagaaucccuggauggaagacaagacaccuguugaguccugggaagaggugcccuaucucggcaagagagaggaucaguggugcggaagccugauuggccugaccucccgcgcuaccugggccaaaaacauccagacagccaucaaucagguccggucucucauugggaacgaagaguacaccgacuauaugccuagcaugaagagauuccgcagagaagaggaagaggcuggagugcugugguga

SEQ ID NO: 20291 - RNA, 9876 nt, Artificial Sequence
  derived and/or modified CDS sequence (opt5) from DENV-2__GQ398302__SS-prME
accgccggcgugaucauuaugcugauccccacagcuauggccuuccaccucacgaccagaaacggggagccucauaugauugucagccggcaggaaaagggaaaaucccugcuuuuuaagacagaggacggcguuaauaugugcacccugauggcgaucgaucucggggaacugugugaggacacaauuaccuacaaaugcccgcuucugcgccaaaacgaacccgaggauaucgacuguuggugcaauucuacaagcaccugggugacguauggaaccuguacaaccacaggcgagcacagacgggaaaagcgcuccguggcucucgucccucauguggggaugggacuggagaccagaacggaaacauggaugucuagcgagggcgccuggaaacacguucagcggaucgagaccuggauucugcgccaucccggcuucacaaucauggccgcuauucucgccuacaccaucgggaccacacacuuucagagagcucugauuuucauccuucugacggccguggcgccuuccaugaccaugcggugcauuggaaucucuaaccgcgauuuugucgaaggcgugagcgggggauccuggguugacaucgugcucgagcacggcagcugugucacaaccauggccaagaauaagcccacacuggauuucgaacuuauuaaaaccgaggcuaagcagccugccacgcugagaaaauauugcaucgaagcuaagcucacaaacaccaccacagagucucgguguccgacccaaggggagcccucccugaaugaagagcaggacaaacgcuuugugugcaagcauagcaugguggauagaggauggggcaacggcugugggcuguucggaaagggcgggauugucacaugcgccauguuuacgugcaaaaagaauauggaaggaaaaguugugcucccugagaaccuggaauacaccaucgugauuacaccccacucuggcgaggagcaugcggucgggaaugacaccggaaagcacggcaaagaaaucaagaucacaccucaguccagcauuaccgaggccgaacuuacgggcuaugggaccgugacaauggaguguucuccccggaccggacuggauuucaacgaaaugguucuccugcagauggaggacaaagcuuggcuugugcaccgccaaugguuucuggaucucccgcugccuuggcugcccggcgccgacacacagggguccaauuggauccagaaggagacccucgucacguucaagaacccucaugcuaaaaagcaggacgugguugugcugggaagccaagaaggcgccaugcacacagcccuuaccggggcuacagagauucagauguccucuggcaaucugcucuuuaccggacaucugaaaugcagacuucggauggauaagcugcagcucaaaggcaugagcuacuccauguguaccgggaaguucaagaucgucaaagaaauugcggagacacaacacggaacgaucgugaucagaguccaguaugagggcgacgggagccccugcaagauucccuucgaaaucauggaucuggagaaacgccaugugcugggacggcucauuaccguuaacccuaucguggccgaaaaggacucuccggucaacauugaggcugaacccccuuuuggcgauuccuacaucauuaucgggguggagcccggccagcugaaacuuaauugguucaagaagggaagcucuaucggccagauguuugagacaaccaugagaggggccaaacgcauggccauucugggagacacagcuugggauuucggcagccucgggggaguuuuuaccuccaucggcaaggcccugcaccaaguguucggggcgauuuacggcgcugccuuuucuggagucagcuggacgaugaaaauccugauuggcgugaucaucacauggauugggaugaacucccggagcaccucucuuuccgugagccucguucuggucggaguggugacccuguaucucggcgccaugguccaggcugacucugggugugugguuuccuggaagagcaaagaacugaagugcggauccggcaucuucauuacagauaaugugcacaccuggacagagcaguacaaguuucagccugaaucucccagcaaacuugccuccgcuauccaaaaggcccaugaggaagggauuuguggcaucagaucugucacgcgccuggagaaccucauguggaaacagaucaccccggagcugaaucacauucugagcgaaaacgaggugaagcuuacaaucaugaccggagacauuaaaggcaucaugcaggcggggaagcggucccucagaccucagcccacagaacugaaauauagcuggaagaccuggggaaaggccaaaaugcugucuacggagucccauaaucaaaccuuccucauugauggcccugaaacagcugagugccccaacaccaaucgcgccuggaacagccuggagguugaagacuacggguuuggaguguucacaaccaauaucuggcuuaagcugcgggagaaacaggacgucuuuugugauucuaagcucauguccgcugccaucaaagacaacagagcggugcacgccgauaugggcuauuggauugaaagcgcucugaaugacacauggaagauggagaaggccucuuucaucgagguuaaaagcugccacuggccuaagucccauacccuguggagcaacggcgugcuugaaucugagaugauuauccccaaaaauuucgcugggccggucucccagcacaacuaccgcccuggauaucauacgcagacagccggccccuggcaccucgggaagcuggaaauggauuuugacuucugugagggaaccaccgugguggucacagaagauugcggcaaccgggggcccagccugagaaccacgacagccuccggaaaacucauuaccgaguggugcugucggucuugcacacugccuccgcuucgcuacagaggcgaggacggcuguugguacgggauggaaauccggccccugaaggagaaggaagagaaucucguuaacagccuggugaccgcuggacauggccaaauugauaauuuuucccugggggugcuuggaauggcgcucuuccuggaagagaugcugagaacacgcgucggcaccaaacacgccaugcuccugguggcuguuucuuuugugacgcuuaucaccgggaacaugagcuuccgggaccugggaagagucauggugaugguuggcgccacaaugaccgaugacaucggcauggggauuacauaucucgcccugcuggcugccuuuaaggugcgcccuaccuucgcggcuggacuucugcucagaaaacugacguccaaggagcucaugauggccacaaucggcauugcccugcuuucucagagcaccauccccgaaacaauucuggagcucaccgaugcucuggcccuggggaugaugguccuuaaaaucgugcggaauauggaaaaguaccagcuggcgguuaccaucauggcuauuuccugcgugccuaacgccgucauccuccaaaaugccuggaaggugagcuguacaauucuggcugccgugucugucuccccccuccugcuuacgagcucucagcagaaagcugacuggaucccucuggcccucaccauuaagggacugaaccccacagcgaucuuucugaccacacuuucccgcaccagcaaaaagagaucuuggccgcugaaugaggccaucauggcuguuggcaugguguccauucucgccagcucccugcucaaaaacgacaucccuaugacggggccccugguggcuggaggccuucugacagucugcuaugugcugaccggccggagcgccgaucucgaacuggagcgcgccgcugacguuaagugggaggaucaggcggaaauuucugggagcuccccuauccuuucuauuaccaucagcgaggacggauccaugucuauuaaaaaugaagaggaggaacaaacacugaccauccucaucagaacaggccugcucgugauuagcggggucuuccccguguccaucccgauuacggccgcugccugguaccugugggagguuaagaagcagcgggccggagugcuuugggaugucccuucucccccucccgugggcaaagcugaacuggaggacggggccuaucgcaucaagcagagaggaauucugggcuacagccagaucggcgcgggggucuauaaagaaggaaccuuucacacaauguggcaugugacccggggcgcuguucucaugcaccgcgggaagagaaucgagcccuccugggccgaugugaaaaaggaccugauuagcuacggaggcggguggaagcuugagggagaauggaaagagggcgaagagguccaagugcuggcccucgaaccuggcaagaacccgcgggcuguucagacaaaacccgggcuguucaagaccaauacgggaaccaucggcgccgugucucucgauuuuuccccugggacaagcggaucucccauugucgacagaaaaggcaaggugguggggcuguacggaaacggcguugucacccgcuccggcgcguaugugagcgcuaucgcccagacagagaaguccauugaggauaauccugaaaucgaggacgauaucuuccggaaaaagagacuuaccauuauggaccugcaucccggggccggaaaaacaaagcgcuaccugccugcuaucgugcgggaagccauuaaaagaggccuccgcacgcugauccuugcuccgacccgggucguggccgcggagauggaagaggcccugagagggcuccccauucgcuaucagacaccugcuauccgggccgagcacaccggaagagaaauuguugaccugaugugucaugcuaccuucacaaugcggcuccugucucccgugcgcgucccuaacuacaaccuuaucaucauggaugaggcccacuuuacggaccccgccagcauugcugcgagaggcuauaucuccacccggguggaaaugggggaggccgcuggcauuuucaugacagccaccccgccuggaagccgcgaucccuuuccccaaucuaaugccccuaucauggacgaggaaagagagauucccgaacgguccuggaacagcggccacgaguggguuacagauuucaaggggaagaccgugugguuugucccuucuaucaaagcuggaaaugacaucgccgcgugccugagaaagaacggcaaaaaggugauucagcugagccgcaaaacguucgauuccgaauacguuaagacacgggcuaaugacugggauuuuguggucaccaccgacaucucugagaugggggccaacuucaaggccgagagagugauugauccgcgccgguguaugaaacccgugauccucacagacggagaagagagagucauucuggcuggcccuaugcccguuacccauagcuccgccgcgcagcgccgggggagaaucggccgcaauccuaagaacgaaaaugaccaauauaucuacaugggagagccccuugaaaacgaugaggacugcgcccacuggaaagaggcuaagaugcugcucgauaauauuaacacaccggaaggcaucauuccuucuauguuugagcccgaaagagagaaaguggacgccaucgauggggaauaccggcugcgcggagaggcuagaaagaccuucguggaccugaugcggcgcggcgaucucccugucuggcuugccuauagaguggcugccgaggggauuaauuacgcggaccggagaugguguuuugauggaaucaaaaacaaucagauucuggaagagaacguugaaguggagaucuggacgaaggagggcgaacgcaagaaacugaagccccgguggcucgacgccagaaucuauagcgauccucuggcucuuaaagaguucaaggaauucgccgcugggcgcaaaucccugacacucaaccugauuaccgagaugggccggcugcccacauuuaugacccagaaggccagagacgcccucgauaaucuugcuguccugcauacggcggaagccggaggccgggcuuacaaccacgcccugagcgagcucccggagacccuggaaacacuucugcuccugacccugcucgccacagugaccgggggaaucuuccuuuuucugaugucuggcaaggggauuggaaaaaugacacugggcaugugcugcaucauuaccgcuuccauccuccugugguaugcccagauccaaccucacuggauugcggccagcaucauucuugaguucuuucugaucguucuccugauucccgaacccgagaagcagcgcacgccucaggacaaucagcugacauacguggucaucgcuauccucaccguggucgccgcuaccauggccaacgaaaugggcuuccuugagaaaacaaagaaagaccuggggcugggauccauugcgacccaagagucugaaagcaauauccucgauauugaccugagaccggccuccgcuuggacacuuuaugccguggcuacgaccuuuguuacacccaugcugcggcauucuaucgagaacagcuccgugaaugugagccucaccgccauugcuaaccaggccacaguccugaugggccuggggaagggauggccucucucuaagauggauaucggcguuccccuucuggcgauuggguguuacucccaggugaauccuaucacccugacggccgcucuccugcuucugguggcccacuacgcuaucauuggacccggccuccaggccaaagccacccgcgaagcgcaaaagagagcugccgcuggcaucaugaaaaacccuacagucgacgggauuaccgugaucgaucuggagccgauucccuaugacccuaaguucgaaaaacagcugggacagguuaugcuccuuauccugugcgugacacagguccugaugaugcggaccacgugggcccucugugaggcccugacacuugcuaccggccccaucagcacacugugggaggggaauccuggacgcuuuuggaacaccaccauugccgugucuauggcgaauaucuucagaggcuccuaccucgccggggcuggacugcuguuuagcauuaugaagaacacaacgaauacccggcgcggcacaggcaacaucggggaaacccucggagagaaguggaaaucuagacuuaaugcccugggcaagagcgaauuccaaauuuauaaaaaguccgggauccaggaggucgaucggacacuggcuaaagagggaaucaagagaggcgaaaccgaccaucacgccgugucucgcgggagcgcgaaacuccggugguuuguugagagaaacauggugacgcccgaaggaaaggucguggaucugggcugcggccgcgggggaugguccuacuauuguggcgggcuuaagaacguucgggaggugaaaggacugacaaagggcgggccgggacaugaagagccuauucccaugagcaccuacggcuggaaucucgucagacugcaguccggcguggacguguucuucacccccccugagaaaugcgauacacugcucugugacaucggggaaucuagccccaacccuaccauugaggccggacgcacacuucggguucugaaucuggucgaaaacuggcucaauaacaauacgcaauuuugcaucaaggugcugaacccguauaugcccuccgugauugagaaaauggaaacccuucagagaaaguacggcggggcucugguccgcaauccucucucucggaacagcacacacgagauguacuggguuuccaaugccaccggaaacaucgugucuagcgugaauaugaucuccagaaugcugauuaaccgcuucacaaugaagcacaaaaaggcuaccuaugagcccgaugucgaccugggcagcgggacgcggaauaucggaauugaaucugagaucccuaaccucgacauuaucggcaaaagaauugaaaagaucaaacaggagcaugaaaccuccuggcacuacgaucaggaccaucccuauaagacaugggccuaccacggcagcuaugagaccaagcaaacagggucugcuuccagcauggugaacggaguugugcgccuucugaccaaaccgugggaugucgugccuaugguuacacagauggccaugaccgacacgacacccuuuggccagcagagaguguucaaggagaaagucgauacccggacccaagaaccuaaggaggggacaaaaaagcugaugaagaucacggcggaauggcucuggaaagagcugggaaagaaaaagaccccccgcauguguacaagagaggaauuuacccggaaagugagaucuaaugccgcucuuggcgccauuuucacagacgagaacaaguggaaauccgcucgggaagccguggaggauagccgcuuuugggaacugaucgacagagagcggaaucuccaccuggaggggaagugcgaaaccugugucuacaacaugaugggaaagcgcgagaaaaagcugggcgaauucggcaaagccaagggguccagagcgauuugguauauguggcucggagcucgguuucuggaguucgaagcccuuggcuuucugaaugaggaucauugguucagccgcgggaacucucucagcggaguugagggcgaagggcugcacagacuuggcuacauccugcgggacguguccaaaaaggagggaggcgccauguacgcugaugacacagccgggugggacacccgcauuacgcucgaagaucugaagaaugaggaaauggugaccaaccauaugaaaggagagcacaagaaacuggcugaggccaucuuuaagcucacauaucagaauaaagucgugagaguucagcggccuaccccccgcggcacagugauggacaucauuucuagacgggaucagcgcgggagcggacaagucggcaccuacgggcugaacacguucacaaauauggaagcgcagcuuaucagacagauggagggcgaaggaauuuucaaguccauccaacaucugaccgugacagaggagauugccguucagaacuggcucgcucgggugggcagagaacgccugucucggauggccaucagcggggacgauugcgucgugaagccgcuugacgauagauuugcuuccgcccugaccgcgcucaaugacaugggaaaaguucgcaaggauauccagcagugggagccuucucggggcuggaacgacuggacgcaagugcccuucugcagccaccacuuucaugaacuggucaugaaagaugggagagugcuggucgugcccugucgcaaucaggacgagcucauuggacgggccagaaucucccagggcgcuggguggagccugaaggaaaccgccugccuuggcaaaucuuaugcucagauguggacacugauguacuuccaccgccgggaucucagacuggccgcuaacgccauuuguuccgcgguuccuagccauugggugccgaccucucgcacaaccugguccauccacgccaagcacgaguggaugacaaccgaggacaugcuugcugucuggaaccggguguggauucaagaaaaucccuggauggaggacaagacgccuguggaaagcugggaggaaguucccuaucugggaaaaagagaggaucaguggugcggcucccucaucgggcugacaucucgggccaccugggccaagaacauucagaccgcuaucaaucaggugagaagccugaucggaaacgaggaauacacagacuauaugccuuccaugaaacgcuuucggagagaggaagaggaagccggcguccucugguga

SEQ ID NO: 20292 - RNA, 9876 nt, Artificial Sequence
  derived and/or modified CDS sequence (opt5) from DENV-2__GQ398272__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacaaacacugaccauccucaucagaacagggcugcucgugauuucuggaguuuuccccgugagcaucccgauuacggcugcggccugguaccugugggaggucaagaagcagcgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccugaugcaccgcggaaagagaaucgagcccagcugggcggaugugaaaaaggaccucauuuccuacggcgggggauggaagcuggagggcgaauggaaagagggcgaagagguucaagugcuugcucuggaaccugggaagaauccgcgggccguccagacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaucccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcacaccggcagagaaauugucgaccucaugugucaugcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccuuagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccauucuagcgccgcucagcggagaggccgcaucggaagaaacccuaaaaaugaaaacgaccaauauaucuacaugggcgagccccuggaaaaugaugaggacugcgcccacuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccagauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucauacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccaaccucacuggauugccgcuuccaucauucuggaguuuuuccuuaucgugcugcucauucccgaacccgagaaacagagaacgccucaggacaaccagcugacauacgucgugaucgccauccugaccguuguggcggccaccauggcuaaugaaaugggguuucucgagaagaccaagaaggaccuuggacugggcagcauuaucacccaagaguccgaaucuaacauucuggauaucgaccuccggccggccagcgcuuggacacuguaugccguggcgacgaccuucgucacacccaugcuucgccauuccauugaaaauucuagcguuaacgugucccugaccgccaucgcuaaucaggccacagugcucauggggcugggaagaggcuggccucugagcaaaauggauauuggggucccccuccuugcuaucggauguuacucucaggugaacccuaucacccugauugccgcucugcuccugcuuguugcccacuacgcgaucauuggccccggccugcaggccaaggcuacgcgggaagcccaaaagcgcgcugccgccgggaucaugaaaaauccuaccguggacggaauuacagucaucgaucucgagccgauccccuaugacccuaaguuugaaaaacagcugggccaggugaugcugcucguccuuugcgugacccagguucugaugaugagaacaaccugggcgcugugugaggcucucacgcuggccacagggcccauuuccacccuuugggagggaaacccuggccgguucuggaauacaaccaucgcugugagcauggccaacauuuuucgcgggucuuaccuggccggagcuggccuccuguucuccaucaugaagaauaccacaaacacgagacggggcaccgggaauauuggagaaacacugggcgagaaauggaaaagcagacucaacgcccuugggaagucugaauuucaaaucuauaaaaagagcggaauccaggaggucgaucgcacccuggcgaaagagggcauuaagagaggggaaacagaccaucacgccguguccagaggaucugcuaaacugcgcugguucguugagcggaacauggugacccccgaaggcaaggucguggaucucggcugcgggagaggaggcuggagcuacuauugugggggacugaaaaaugugcgcgagguuaagggccuuacgaaagggggaccgggccaugaggagccuauccccauguccacauacggcuggaaccugguccggcuccagagcgggguggacguguucuuuacacccccugagaaaugcgauacccugcugugugacauuggagaauccucucccaauccuacaaucgaggccggcagaacccuccgcguccuuaaccugguugaaaauuggcugaacaauaacacacaauucugcauuaaggugcucaauccguauaugcccagcgugaucgagaaaauggaaacgcugcagcggaaguacgggggagcucuugucagaaacccucugucccgcaauucuacccacgagauguacugggugagcaacgccacaggcaauaucguuuccucugugaacaugauuagccggaugcucaucaauagauuuaccaugaaacacaagaaggcgacauaugagcccgaugucgaccugggguccggaacccgcaacauuggcaucgaaaacgagauuccuaaucuggacaucauuggcaaaagaaucgaaaagaucaaacaggagcaugaaacgagcuggcacuacgaucaggaccaucccuauaagaccugggccuaccacgggucuuaugagacaaaacaaaccggauccgcuagcucuauggugaacggcguugugcggcuccuuacaaagccgugggaugucgugccuauggugacccagauggccaugacagacaccacgcccuucgggcagcagcgcgucuuuaaggagaaaguugauacaagaacccaagaaccuaaggagggaaccaaaaagcugaugcggauuacagcugaauggcuguggaaagagcucggcaagaagaaaacgcccagaauguguacccgggaggaguucacacgcaaggugagauccaaugccgcucugggggccaucuuuaccgacgagaacaaauggaaaagcgcgcgggaagccguggaggauucucgcuucugggaacuugucgacagagagcggaaucugcaccucgagggaaaaugcgaaacauguguguacaacaugaugggcaagcgcgagaaaaagcugggcgaauuugggaaggcuaaaggauccagagccauuugguauauguggcugggcgcucgguuccucgaguuugaagcccugggguuccuuaaugaggaucauugguuuagccgcggaaacucccugagcggcguugagggggaaggccuccacaagcugggauacauccuuagagacgugucuaaaaaggagggcggggccauguacgcggaugacaccgcuggaugggacacacggauuacccuggaagaucucaaaaaugaggaaauggucacgaaccauaugaagggcgagcacaagaaacuggccgaggccaucuucaagcugaccuaucagaauaaagugguucgcgugcagagaccuacaccccgggggaccgucauggacaucauuagccgcaaggaucagagaggauccggccaaguggggacauacggccucaacaccuucacgaauauggaagcucagcugauccggcagauggagggagaaggcauuuuuaaaucuauccaacaucuuacaguuaccgaggagauugccgugcagaacuggcuggcuagagucgggcgcgaacggcucagcagaauggccaucuccggagacgauugcguggucaagccgcuggacgaucgcuucgcgucugcccuuacagcucugaaugacaugggcaaggugcggaaagauauccagcagugggagccuagcagaggguggaacgacuggacccaaguucccuuuugcucccaccacuuccaugaacucgugaugaaggauggacgcguccugguggugcccugucggaaccaggacgagcugauuggcagagcccgcaucucucagggggcuggcuggagccucaaagaaacggccugccugggaaaguccuaugcgcagauguggacccuuauguacuuucaccggagagaucugcgccucgccgcuaaugccauuuguagcgcuguuccuucucauugggugccgacaucccggaccacauggagcauccacgccaaacacgaguggaugaccacagaggacaugcuggcugucuggaacagaguguggauucaagaaaaucccuggauggaggacaagaccccuguugaaucuugggaggaagugcccuaucuuggcaagcgggaggaucaguggugcgggucccugaucggacucacgagcagagccacaugggcgaaaaacauucagaccgccaucaaucagguccgcucccugaucggcaacgaggaauacaccgacuauaugccuucuaugaagcgguucagaaaagaggaagaggaagcuggggugcugugguga

SEQ ID NO: 20293 - RNA, 9876 nt, Artificial Sequence
  derived and/or modified CDS sequence (opt5) from DENV-2__GQ398292__SS-prME
accgccggaguguucaucaugcugauucccacagcuauggccuuucaccucacgacccggaacggggagccucauaugaucgucggacggcaggaaaagggcaagucccugcuuuucaagacagaggacgggguuaauaugugcacccugauggcgauugaucucggagaacugugugaggacacaaucaccuacaagugcccgcuucugcgccaaaacgaacccgaggauauugacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggaucaugcgccaucccggguuuacaauuauggccgcuauccuggccuacaccauuggaaccacacacuuccagagagcucucaucuuuauucugcuuacggccguggcgccuagcaugaccaugcggugcaucggcauuuccaaccgcgauuucgucgaaggggugucuggaggcagcuggguugacaucgugcuggagcacggguccugugucacaaccauggccaagaauaagcccacacucgauuuugaacugaucaaaaccgaggcuaagcagccugccacgcuuagaaaauauugcauugaagcuaagcugacaaacaccaccacagagagccgguguccgacccaaggagagcccucucucaaugaagaacaggacaaacgcuucgugugcaagcauuccaugguggauagaggcuggggcaacggguguggacuguuuggcaaagggggaaucgucacaugcgccauguucacgugcaaaaagaauauggaaggcaaaguugugcugccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuuuaacgaaaugguucugcuccagauggaggacaaggcuuggcuggugcaccgccaaugguuccuugaucugccgcucccuuggcugcccggggccgacacacagggaucuaauuggauucagaaggagacccuggucacguuuaagaacccucaugcuaaaaagcaggacgugguugugcucggcucccaagaaggggccaugcacacagcccugaccggcgcuacagagauccagaugagcuccggaaaucuucuguucaccggccaucucaaaugcagacugcggauggauaaacuucagcugaaagggaugucuuacagcauguguaccggaaaguucaagauugucaaagaaaucgcggagacacaacacggcacgauugugaucagaguccaguaugagggggacggaucccccugcaagauccccuuugaaauuauggaucucgagaaacgccaugugcugggccggcugaucaccguuaacccuauuguggccgaaaaggacagcccggucaacaucgaggcugaacccccuuucggggauucuuacauuaucauuggcguggagcccggacagcucaaacugaauugguuuaagaagggcuccagcaucgggcagauguucgagacaaccaugagaggagccaaacgcauggccauccuuggcgacacagcuugggauuuugggucucugggaggcguuuucaccagcauugggaaggcccuccaccaaguguuuggcgcgaucuacggagcugccuucuccggcgucucuuggacgaugaaaauucugaucggggugauuaucacauggaucggaaugaacagccgguccaccagccugucugugucccuuguucucgucggcguggugacccuguaucugggggccaugguccaggcugacagcggaugugugguuucuuggaaguccaaagaacucaagugcggcagcgggauuuuuaucacagauaaugugcacaccuggacagagcaguacaaguuccagccugaaucccccucuaaacuggccagcgcuauucaaaaggcccaugaggaaggcaucuguggaauuagauccgucacgcgccuugagaaccugauguggaaacagaucaccccggagcucaaucacauccugucugaaaacgaggugaagcugacaauuaugaccggcgacaucaaagggauuaugcaggcgggaaagcggagccuuagaccucagcccacagaacucaaauauuccuggaagaccuggggcaaggccaaaaugcugagcacggagucucauaaucaaaccuuucugaucgaugggccugaaacagcugagugccccaacaccaaucgcgccuggaacucccucgagguugaagacuacggauucggcguguuuacaaccaauauuuggcugaaacuucgggagaaacaggacgucuucugugauagcaagcugaugucugcugccaucaaagacaacagagcggugcacgccgauaugggcuauuggaucgaauccgcucucaaugacacauggaagauggagaaggccagcuucauugagguuaaaucuugccacuggccuaagagccauacccugugguccaacggggugcuggaaagcgagaugaucauucccaaaaauuuugcuggaccggucucucagcacaacuaccgcccuggcuaucauacgcagacagccgggcccuggcaccuuggaaagcucgaaauggauuucgacuuuugugagggcaccaccgugguggucacagaagauugcgggaaccggggacccucccugagaaccacgacagccagcggcaaacugaucaccgaguggugcugucgguccugcacacucccuccgcugcgcuacagaggcgaggacggguguugguacggaauggaaauucggccccuuaaggagaaggaagagaaucugguuaacucucucgugaccgcuggccaugggcaaaucgauaauuucagccugggagugcugggcauggcgcuuuuucucgaagagaugcugagaacacgcgucgggaccaaacacgccaugcugcucguggcuguuuccuucgugacgcugauuaccggaaacaugucuuuucgggaccuuggcagagucauggugaugguuggcgccacaaugaccgaugacaucgggaugggaaucacauaucuggcccuccuggcugccuucaaggugcgcccuaccuuugcggcuggccugcuucugagaaaacucacgagcaaggagcugaugauggccacaauugggaucgcccuccugucccagucuaccauucccgaaacaauccuugagcugaccgaugcucucgcccugggaaugaugguccugaaaauugugcggaauauggaaaaguaccagcuugcgguuaccaucauggcuaucagcugcgugccuaacgccgucauucugcaaaaugccuggaagguguccuguacaauccucgcugccgugagcgucucuccccugcuccugacguccagccagcagaaagcugacuggauuccucuugcccugaccaucaagggccucaaccccacagcgauuuuccugaccacacugucucgcaccuccaaaaagagaagcuggccgcuuaaugaggccaucauggcuguugggauggugucuauccuggccuccagccuccugaaaaacgacauuccuaugacgggaccccucguggcuggcggccugcuuacagucugcuaugugcugaccgggcgguccgccgaucuggaacucgagcgcgccgcugacguuaagugggaggaucaggcggaaaucagcggaucuagcccuauucuguccaucaccauuucugaggacggcagcauguccaucaaaaaugaagaggaggaacaaacacuuaccauucugaucagaacagggcuccuggugaucucuggagucuuucccgugagcauuccgaucacggccgcugccugguaccucugggagguuaagaagcagcgggccggcgugcugugggaugucccuucucccccucccguggggaaagcugaacuugaggacggagccuaucgcauuaagcagagaggcauccugggcuacagccagauuggggcgggagucuauaaagaaggcaccuuccacacaauguggcaugugaccagaggggcuguucugaugcaccgcggaaagagaaucgagcccagcugggccgaugugaaaaaggaccucaucuccuacggcgggggauggaagcuggagggcgaauggaaagagggcgaagagguccaagugcuugcccuggaaccugggaagaacccgcgggcuguucagacaaaacccggacucuuuaagaccaauacgggcaccauuggggccgugagccuggauuucucuccuggaacauccggcagccccaucgucgacagaaaagggaagguggugggacucuacggcaacggcguugucacccgcucuggggcguauguguccgcuauugcccagacagaaaagagcaucgaggauaauccugaaauugaggacgauaucuuccggaaaaagagacugaccaucauggaccuucaucccggagccggcaaaacaaagcgcuaccugccugcuauugugcgggaagccaucaaaagagggcugcgcacgcucauucuggcuccgacccgggucguggccgcggagauggaagaggcccuuagaggacugcccauccgcuaucagaccccugcuauucgggccgagcacaccggcagagaaaucguugaccucaugugucaugcuaccuuuacaaugcggcugcucucccccgugcgcgucccuaacuacaaccugauuaucauggaugaggcccacuucacggaccccgccucuaucgcugcgagaggguauauuagcacccggguggaaaugggcgaggccgcuggaaucuuuaugacagccaccccgccuggcucccgcgaucccuucccccaaagcaaugccccuauuauggacgaggaaagagagauccccgaacggucuuggaacuccgggcacgaguggguuacagauuuuaagggaaagaccgugugguucgucccuagcauuaaagcuggcaaugacaucgccgcgugccuuagaaagaacgggaaaaaggugauccagcugucucgcaaaacguuugauagcgaauacguuaagacacgggcuaaugacugggauuucguggucaccaccgacauuuccgagaugggagccaacuuuaaggccgagagagugaucgauccgcgccgguguaugaaacccgugauucugacagacggcgaagagagagucauccucgcugggccuaugcccguuacccauucuagcgccgcgcagcgccggggcagaauuggacgcaauccuaagaacgaaaaugaccaauauaucuacaugggcgagccccuggaaaacgaugaggacugcgcccacuggaaagaggcuaagaugcuucuggauaauaucaacacaccggaagggauuaucccuuccauguucgagcccgaaagagagaaaguggacgccauugauggagaauaccggcuccgcggcgaggcuagaaagaccuuuguggaccugaugcggcgcggggaucugccugucuggcucgccuauagaguggcugccgagggaaucaauuacgcggaccggagaugguguuucgauggcauuaaaaacaaucagauccuugaagagaacguugaaguggagauuuggacgaaggagggggaacgcaagaaacugaagccccgguggcuggacgccagaaucuauucugauccucucgcucugaaagaguucaaggaauuugccgcuggccgcaaaagccuuacacugaaccucaucaccgagaugggacggcugcccacauucaugacccagaaggccagagacgcccuggauaaucucgcuguccuucauacggcggaagccggcgggcgggcuuacaaccacgcccuguccgagcugccggagacccucgaaacacugcuucugcucacccugcuggccacagugaccggaggcauuuuucucuuccuuaugagcgggaagggaaucggcaaaaugacacugggcaugugcugcauuaucaccgcuucuauucugcucugguaugcccagauccaaccucacuggaucgcggccuccauuauccuggaguuuuuccuuauuguucugcucauccccgaacccgagaagcagcgcacgccucaggacaaucagcugacauacguggucauugcuauccugaccguggucgccgcuaccauggccaacgaaaugggguuucucgagaaaacaaagaaagaccuuggacugggcagcaucgcgacccaagaguccgaaucuaauauucuggauaucgaccucagaccggccagcgcuuggacacuguaugccguggcuacgaccuucguuacacccaugcuucggcauuccauugagaacucuagcgugaaugugucccugaccgccaucgcuaaccaggccacaguccucauggggcugggaaagggcuggccucugagcaagauggauauugggguuccccuccuugcgaucggauguuacucucaggugaauccuauuacccugacggccgcucugcuccugcuuguggcccacuacgcuaucaucggccccggccugcaggccaaagccacccgcgaagcgcaaaagagagcugccgcugggauuaugaaaaacccuacagucgacggaaucaccgugauugaucucgagccgauccccuaugacccuaaguuugaaaaacagcugggccagguuaugcugcucauucuuugcgugacacagguccugaugaugcggaccacgugggcccugugugaggcccucacacuggcuaccgggcccaucuccacacuuugggagggaaauccuggccgcuucuggaacaccaccaucgccgugagcauggcgaauauuuuuagagggucuuaccuggccggagcuggccuccuguucuccaucaugaagaacacaacgaauacccggcgcggcacagggaacauuggagaaacccugggcgagaaguggaaaagcagacucaaugcccuugggaagucugaauuucaaaucuauaaaaagagcggcauucaggaggucgaucggacacuggcuaaagagggcaucaagagaggggaaaccgaccaucacgccgugucccgcggaucugcgaaacugcggugguucguugagagaaacauggugacgcccgaaggcaaggucguggaucucggcugcgggcgcggaggcuggagcuacuauugugggggacugaagaacguucgggaggugaaaggccuuacaaaagggggaccgggccaugaggagccuauccccauguccaccuacggcuggaaucuggucagacuccagagcgggguggacguguucuuuacacccccugagaaaugcgauacccugcugugugacauuggagaauccucucccaacccuaccaucgaggccggccgcacacuccggguucuuaaucuggucgaaaacuggcugaauaacaauacgcaauucugcauuaaggugcucaacccguauaugcccagcgugaucgagaaaauggaaacccugcagagaaaguacgggggagcucuuguccgcaauccucugucccggaacucuacacacgagauguacuggguuagcaaugccaccggcaacauuguguccucugugaauaugaucagcagaaugcucaucaaccgcuuuacaaugaagcacaaaaaggcuaccuaugagcccgaugucgaccugggguccggaacgcggaauauuggcaucgaaagcgagauuccuaaccuggacaucauuggcaaaagaaucgaaaagauuaaacaggagcaugaaaccucuuggcacuacgaucaggaccaucccuauaagacaugggccuaccacggguccuaugagaccaagcaaacaggaagcgcuucuuccauggugaacggcguugugcgccuccuuaccaaaccgugggaugucgugccuaugguuacacagauggccaugaccgacacgacacccuucgggcagcagagaguguuuaaggagaaagucgauacccggacccaagaaccuaaggagggaaccaagaagcugaugaagaucacggcggaauggcuguggaaagagcucggcaagaaaaagacaccccgcauguguacaagagaggaguucacccggaaagugagaagcaaugccgcucugggggccaucuuuacagacgagaacaaguggaaaucugcucgggaagccguggaggauucccgcuucugggaacuuauugacagagagcggaaucugcaccucgagggaaagugcgaaaccugugucuacaacaugaugggcaagcgcgagaaaaagcugggcgaauuugggaaagccaagggaagcagagcgaucugguauauguggcugggcgcucgguuccucgaguuugaagcccugggguuccuuaaugaggaucauugguuuucccgcggaaacagccugucuggcguugagggggaaggccuccacagacugggauacauucuucgggacgugagcaaaaaggagggcggggccauguacgcugaugacacagccggaugggacacccgcaucacgcuggaagaucucaagaaugaggaaauggugaccaaccauaugaaaggcgagcacaagaaacuggcugaggccauuuucaagcugacauaucagaauaaagucgugagaguucagcggccuacaccccgcgggacagugauggacaucaucuccagacgggaucagcgcggaucuggccaagucgggaccuacggccucaacacguucacaaauauggaagcgcagcugauuagacagauggagggagaaggcaucuuuaagagcauucaacaucuuaccgugacagaggagaucgccguucagaacuggcuggcucggguggggagagaacgccucucccggauggccauuucuggagacgauugcgucgugaagccgcuggacgauagauucgcuagcgcccuuaccgcgcugaaugacaugggcaaaguucgcaaggauauccagcagugggagccuucccggggguggaacgacuggacgcaagugcccuuuugcucucaccacuuccaugaacucgucaugaaagauggaagagugcuggucgugcccugucgcaaucaggacgagcugaucggccgggccagaauuagccagggggcuggcuggucccucaaggaaaccgccugccugggaaaaagcuaugcucagauguggacacuuauguacuuucaccgccgggaucugagacucgccgcuaacgccaucuguucugcgguuccuucccauugggugccgaccagccgcacaaccuggucuauucacgccaagcacgaguggaugacaaccgaggacaugcuggcugucuggaaccggguguggauccaagaaaaucccuggauggaggacaagacgccuguggaauccugggaggaaguucccuaucuuggcaaaagagaggaucaguggugcgggagccugauuggacucacaucccgggccaccugggccaagaacauccagaccgcuauuaaucaggugagaucucugaucggcaacgaggaauacacagacuauaugccuagcaugaaacgcuuccggagagaggaagaggaagccgggguccugugguga

SEQ ID NO: 20294 - RNA, 9876 nt, Artificial Sequence
  derived and/or modified CDS sequence (opt5) from DENV-2__GQ398267__SS-prME
accgccggaaucauuaucaugaugauucccaccgugauggcuuuccaccugacgaccagaaacggggagccucauaugaucgucagccggcaggaaaagggaaaaagccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcaugguuagcauccucgcgucuucccugcucaaaaacgauauuccuaugacagggccccugguggccggaggccuucugaccgucugcuacgugcugaccggccgcagcgcugaccucgagcuggaaagagccgcugacguccggugggaggagcaggccgaaaucuccgggagcucuccuauccuuagcauuacaaucuccgaggauggaucuaugagcauuaagaaugaagaggaggaacagacccugacaauccucauucgcacgggccugcucgugaucuccgggcuguuccccguuucuauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauucccagaucggcgccgggguguacaaagaaggaacauuucacaccauguggcaugucacacgcggcgcugugcugaugcacaaggggaaaagaauugagcccuccugggccgacgugaagaaagaucuuaucagcuacggaggcggguggaagcuggagggagaauggaaggagggcgaagagguucagguccucgcgcuggaaccuggcaaaaacccgcgggcugugcaaaccaagcccggacucuucaaaacgaacaccggaacaauuggcgccgugucccuggacuuuagcccugggaccucuggaucccccaucgucgauaagaaaggcaaggugguugggcuuuauggaaauggcguggucacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuagccccauccggguuccuaauuauaaccugauuaucauggaugaggcccacuuuacagaccccgcuuccauugccgcucgcggcuacaucucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgagugggucacggacuucaaggggaagacagugugguuugugccuuccauuaaagccggaaaugauaucgcugccugccugcggaagaacggcaaaaaggucauucaacucagcagaaaaaccuucgacucugaauauaucaagacccgcacaaaugauugggacuuuguugugaccacagauaucagcgagaugggggccaacuucaaggcugagcgggugauugacccgagacgcuguaugaaacccgucauccugaccgauggagaagaacgggugauucuugccggcccuaugcccguuacgcauuccucugcggcucagagacgcgggcgggugggcagaaauccuaagaacgaaaaugaccaguacaucuacaugggagagccccuggaaaacgaugaggacugcgcccacuggaaagaggccaagaugcuccuggacaauauuaacacaccggaaggcaucaucccuagcauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaacuaugccgauagacggugguguuuugacggagucaaaaauaaccaaauucuggaagagaauguggaagucgagaucuggacaaaggagggcgaaagaaagaaacucaagccccgcuggcuggaugcucggauuuacuccgacccucuugcccugaaagaguucaaggaguucgcugccgggagaaaaucucucacccugaaccugaucacggagaugggccgccuccccaccuuuaugacacagaaggcgaagaaugcccuugauaaccuggcugugcugcauaccgccgaagcuggaggccgggccuauaaucacgcccucagcgagcugccggagacacuugaaacccugcuccugcugacacuccuugcuaccguuacaggcgggauuuuccuguuucugauguccgggaaagggaucggaaagaugacacucggcaugugcugcaucauuaccgcgagcauccugcuuugguacgcccagauucagccucacuggaucgcugccucuauuauccuggaguucuuucucaucgugcugcugauucccgaacccgagaaacaaagaaccccucaggacaaccagcucacauauguggucaucgccauucuuaccguuguggcugccacaauggcgaaugaaaugggcuuccuggagaagacgaaaaaggauuuugggcugggauccaucaccacacagcaaccggagagcaacauucucgacaucgaucugcggcccgccuccgcuuggacccuuuacgccguggcuacaaccuucaucacgccuaugcugcgccauucuauugaaaauagcuccgucaacgugucucucaccgccaucgcgaaucaggccacaguucugaugggccuggggaagggauggccccucagcaaaauggacauuggcgugccucuucuggcuaucggguguuacucccaggucaaccccauuacccugaucgccgcucuccugcuucugguggcccacuaugcuauuaucggaccuggccuccaggccaaggcgacaagagaggcccaaaaacgggcugccgcuggcaucaugaagaauccgaccgucgacgggaugacggugauugaucuggaccccaucccuuacgaucccaaauuugaaaagcagcugggacagguuaugcuccuugugcugugcgucacacaggugcugaugaugcgcaccacaugggcccucugugaggcccugacccuugcgaccggcccuauuagcacacugugggaagggaaccccggaagauucuggaauacgaccaucgcuguuucuauggccaacauuuuucggggcuccuaucucgcuggggccggacugcuguucagcaucaugaagaacacagccaauacccgcagaggcacaggcaacaucggggagacccucggagagaaauggaagaaucggcuuaacgcucugggcaaaucugaauuucaaauuuacaagaaauccgggauccaggagguggaccgcacgcuggccaaggaaggaauuaaaagaggcgagacagaucaucacgcggucagccgggggucugccaagcucagaugguucguggagcgcaaucuggugaccccggaaggaaagguugucgaccuuggcugcggcagagggggauggagcuauuacuguggcgggcugaaaaacgugaaggaggugaaaggacucaccaagggcgggccuggacaugaagaacccauccccauguccacauauggcuggaaucuggucagacugcagucuggcguugauguguucuuuaccccucccgaaaaaugcgacacacuccuuugugauauuggggagagcuccccuaacccgacgguggaggcuggacgcacccugcggguccugaaucucguggaaaacuggcugaauaacaauacacaauucugcaucaagguucuuaaccccuacaugccuagcgugaucgagaagauggaagcccugcagagaaaauacggcggggcucucguccgcaauccccugucccggaacucuacccacgagauguauugggugagcaacgccuccggaaauauuguuucuagcgugaacaugaucuccagaaugcugauuaaucgcuuuacaaugcggcacaagaaagcgaccuacgaaccugacgucgaucucggcucugggacgagaaacaucggaauugagagcgagacccccaaucuugacaucaucggcaagcgcauugagaaaaucaagcaggagcaugaaacauccuggcacuaugaucaggaccauccguacaagaccugggccuaucacggcagcuacgagacaaaacaaaccgggucugcuuccagcauggugaacggagugguccggcugcugacaaagccuugggacguuauucccauggugacccagauggccaugacggauacaaccccuuucggccagcagagaguguuuaaagaaaaggucgacacccgcacacaagagcccaaagaggggacgaagaagcucaugaaaaucaccgcugaauggcuguggaaggagcuuggcaaaaagaaaacaccuagaauguguacccgggaagaguucacacgcaaggugagaucuaaugccgcucugggcgccauuuuuaccgaugagaacaaauggaaguccgcgcgggaagccguugaggacagcggguucugggaacucguggauaaggagagaaaucugcaccuggaaggaaaaugcgagacaugugucuauaacaugaugggcaagcgggagaaaaagcucggcgaauuugggaaagcuaagggaucucgcgccaucugguacauguggcugggcgcuagauuccuugaguuugaagcccugggguuccucaaugaggaccauugguuuucccgggaaaacagccuguccggaguggagggcgaggggcuucacaagcugggcuacauucuccgcgauguuagcaaaaaggaaggaggcgccauguaugcggacgauaccgcugggugggacacgagaaucacccuggaggaucugaaaaaugaagagauggugacaaaccauauggaaggagagcacaagaaacucgccgaggccaucuucaagcugaccuaccagaauaaggucgugcggguucagcgccccacaccgagaggcaccgugauggacauuaucucucggcgcgaccagagagggagcggacaagucgugacguauggccuuaacacauucaccaacauggaagcucagcugauucggcagauggagggggaaggcgucuuuaaauccauccaacagcucacagugaaggaggagauugccguuaaaaauuggcugauccgcgugggaagagaacggcuuucucgcauggcuaucagcggcgaugacugcgucgugaagccucuggaugacagauucgccuccgcgcucauugcccugaacgauauggggaaagugcggaaggacauccagcagugggagcccucuagaggauggaaugauuggacccaaguucccuuuugcagccaucacuuccacgaacugauuaugaaggacggccgcgugcucgucgugccuugucggaaccaggaugagcugaucgggagagcucgcauuucccagggagccggcuggucucuucgggaaacggcuugccuggggaaaagcuacgcccagauguggucccucauguauuuucauagacgcgaccugcggcuugcggccaaugcuaucuguagcgccguuccgucucacugggugcccaccuccagaacaaccuggagcauccaugcuacacacgaguggaugaccacagaggauaugcugaccgucuggaaccgcguguggauucaagaaaauccuuggauggaggacaagacgcccgucgaaucuugggaggaaaucccuuaccucggcaaacgggaggaucaguggugcggaucccugauuggccugacaagcagagccaccugggcuaagaacauccagaccgccauuaaucaggugcgcucccucaucgggaacgaggaauauacagacuacaugcccucuaugaaacgguucagacgggaggaagaggaagcgggaguucugugguga

SEQ ID NO: 20295 - RNA, 9876 nt, Artificial Sequence
  derived and/or modified CDS sequence (opt5) from DENV-2__GQ398266__SS-prME
accgccggaaucauuaucaugaugauucccaccgugauggcuuuccaccugacgaccagaaacggggagccucauaugaucgucagccggcaggaaaagggaaaaucccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgaauaaaaagcggucuuggccgcugaacgaagcuauuauggccgugggcaugguuuccauccucgcgagcucucugcucaaaaaugauauuccuaugacagggccccugguggccggaggccuucugaccgucugcuacgugcugaccggccgcuccgcugaccucgagcuggaaagagccgcugacguccggugggaggagcaggccgaaaucagcggguccagcccuauccuuucuauuacaaucagcgaggauggauccaugucuauuaagaacgaagaggaggaacagacccugacaauccucauucgcacgggccugcucgugaucagcgggcuguuccccguuuccauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauagccagaucggcgccgggguguacaaagaaggaacauuucacaccauguggcaugucacacgcggcgcugugcugaugcacaaggggaaaagaauugagcccuccugggccgacgugaagaaagaucuuaucucuuacggaggcggguggaagcuggagggagaauggaaggagggcgaagagguucagguccucgcgcuggaaccuggcaaaaacccgcgggcugugcaaaccaagcccggacucuucaaaacgaauaccggaacaauuggcgccgugagccuggacuuuuccccugggaccagcggaucucccaucgucgauaagaaaggcaaggugguugggcuuuauggaaacggcguggucacaagauccggcaccuacgugagcgccaucgcucagacagagaagucuauugaggacaauccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuucccccauccggguuccuaacuauaaucugauuaucauggaugaggcccacuuuacagaccccgcuagcauugccgcucgcggcuacaucuccaccagaguggaaaugggggaggccgccggcaucuucaugacagcuaccccgccuggaucucgggaccccuuuccccagagcaacgcgccuauuauggaugaggaacgcgagauccccgaaagauccuggaauagcggccacgagugggucacggacuucaaggggaagacagugugguuugugccuucuauuaaagccggaaacgauaucgcugccugccugcggaagaauggcaaaaaggucauucaacucuccagaaaaaccuucgacagcgaauauaucaagacccgcacaaacgauugggacuuuguugugaccacagauaucucugagaugggggccaauuucaaggcugagcgggugauugacccgagacgcuguaugaaacccgucauccugaccgauggagaagaacgggugauucuugccggcccuaugcccguuacgcauagcuccgcggcucagagacgcgggcgggugggcagaaacccuaagaaugaaaacgaccaguacaucuacaugggagagccccuggaaaaugaugaggacugcgcccacuggaaagaggccaagaugcuccuggacaacauuaacacaccggaaggcaucaucccuucuauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaauuaugccgauagacggugguguuuugacggagucaaaaacaaucaaauucuggaagagaacguggaagucgagaucuggacaaaggagggcgaaagaaagaaacucaagccccgcuggcuggaugcucggauuuacagcgacccucuugcccugaaagaguucaaggaguucgcugccgggagaaaaucccucacccugaaucugaucacggagaugggccgccuccccaccuuuaugacacagaaggcgaagaacgcccuugauaaucuggcugugcugcauaccgccgaagcuggaggccgggccuauaaccacgcccucucugagcugccggagacacuugaaacccugcuccugcugacacuccuugcuaccguuacaggcgggauuuuccuguuucugaugagcgggaaagggaucggaaagaugacacucggcaugugcugcaucauuaccgcguccauccugcuuugguacgcccagauucagccucacuggaucgcugccagcauuauccuggaguucuuucucaucgugcugcugauucccgaacccgagaaacaaagaaccccucaggacaaucagcucacauauguggucaucgccauucuuaccguuguggcugccacaauggcgaacgaaaugggcuuccuggagaagacgaaaaaggauuuugggcugggaucuaucaccacacagcaaccggaguccaauauucucgacaucgaucugcggcccgccagcgcuuggacccuuuacgccguggcuacaaccuucaucacgccuaugcugcgccauuccauugaaaacucuagcgucaaugugucccucaccgccaucgcgaaccaggccacaguucugaugggccuggggaagggauggccccucucuaaaauggacauuggcgugccucuucuggcuaucggguguuacagccaggucaaucccauuacccugaucgccgcucuccugcuucugguggcccacuaugcuauuaucggaccuggccuccaggccaaggcgacaagagaggcccaaaaacgggcugccgcuggcaucaugaagaacccgaccgucgacgggaugacggugauugaucuggaccccaucccuuacgaucccaaauuugaaaagcagcugggacagguuaugcuccuugugcugugcgucacacaggugcugaugaugcgcaccacaugggcccucugugaggcccugacccuugcgaccggcccuauuuccacacugugggaagggaaucccggaagauucuggaacacgaccaucgcuguuagcauggccaacauuuuucggggcucuuaucucgcuggggccggacugcuguucuccaucaugaagaauacagccaacacccgcagaggcacaggcaauaccggggagacgcucggagagaaauggaagaaccggcuuaaugcucugggcaaaagcgaauuucaaaucuacaagaaaucugggauucaggagguggaccgcacacuggccaaggaaggaaucaaaagaggcgagaccgaucaucacgcggucucccgggggagcgccaagcucagaugguucguggagcgcaaccuggugaccccggaaggaaagguugucgaccuuggcugcggcagagggggauggucuuauuacuguggcgggcugaaaaaugugaaggaggugaaaggacucacaaagggcgggccuggacaugaagaacccauucccaugagcaccuauggcuggaaccuggucagacugcaguccggcguugauguguucuuuacaccucccgaaaaaugcgacacgcuccuuugugauaucggggagucuagcccuaauccgaccguggaggcuggacgcacacugcggguccugaaccucguggaaaauuggcugaacaauaacacccaauucugcauuaagguucuuaaucccuacaugccuuccgugaucgagaagauggaagcccugcagagaaaauacggcggggcucucguccgcaacccccugagccggaacuccacacacgagauguauugggugucuaaugccagcggaaacaucguuuccucugugaauaugauuagcagaaugcugaucaaccgcuuuaccaugcggcacaagaaagcgacguacgaaccugacgucgaucucggcuccgggaccagaaauauuggaaucgagucugagacacccaaccuugacauuaucggcaagcgcaucgagaaaauuaagcaggagcaugaaaccagcuggcacuaugaucaggaccauccguacaagacaugggccuaucacggcuccuacgagaccaaacaaacagggagcgcuucuuccauggugaauggagugguccggcugcugaccaagccuugggacguuauccccauggugacgcagauggccaugacagauaccaccccuuucggccagcagagaguguuuaaagaaaaggucgacacacgcacgcaagagcccaaagaggggaccaagaagcucaugaaaauuacagcugaauggcuguggaaggagcuuggcaaaaagaaaaccccuagaauguguacacgggaagaguucacccgcaaggugagaagcaacgccgcucugggcgccaucuuuacagaugagaauaaauggaagucugcgcgggaagccguugaggacuccggguucugggaacucguggauaaggagagaaaccugcaccuggaaggaaaaugcgagaccugugucuauaauaugaugggcaagcgggagaaaaagcucggcgaauuugggaaagcuaagggaagccgcgccauuugguacauguggcugggcgcuagauuccuugaguuugaagcccugggguuccucaacgaggaccauugguuuucucgggaaaauucccugagcggaguggagggcgaggggcuucacaagcugggcuacauccuccgcgauguuuccaaaaaggaaggaggcgccauguaugcggacgauacggcugggugggacaccagaauuacacuggaggaucugaaaaacgaagagauggugaccaaucauauggaaggagagcacaagaaacucgccgaggccaucuucaagcugacauaccagaacaaggucgugcggguucagcgccccaccccgagaggcacggugauggacaucauuagccggcgcgaccagagagggucuggacaagucgugacauauggccuuaacaccuucacaaauauggaagcucagcugauccggcagauggagggggaaggcgucuuuaaaagcauucaacagcucaccgugaaggaggagaucgccguuaaaaacuggcugauucgcgugggaagagaacggcuuucccgcauggcuaucucuggcgaugacugcgucgugaagccucuggaugacagauucgccagcgcgcucacggcccugaaugauauggggaaagugcggaaggacauccagcagugggagcccuccagaggauggaacgauuggacccaaguucccuuuugcucucaucacuuccacgaacugauuaugaaggacggccgcgugcucgucgugccuugucggaaucaggaugagcugaucgggagagcucgcauuagccagggagccggcuggucccuucgggaaacagcuugccuggggaaaucuuacgcccagauguggagccucauguauuuucauagacgcgaccugcggcuugcggccaacgcuaucuguuccgccguuccgagccacugggugcccaccucuagaacaaccugguccauucaugcuacacacgaguggaugaccacggaggauaugcugacagucuggaaucgcguguggauccaagaaaacccuuggauggaggacaagacccccgucgaaagcugggaggaaaucccuuaccucggcaaacgggaggaucaguggugcggaucucugauuggccugaccuccagagccacaugggcuaagaauauccagaccgccauuaaccaggugcgcagccucaucgggaaugaggaauauacagacuacaugcccuccaugaaacgguucagacgggaggaagaggaagcgggaguucugugguga

SEQ ID NO: 20296 - RNA, 9876 nt, Artificial Sequence
  derived and/or modified CDS sequence (opt5) from DENV-2__GQ398265__SS-prME
accgccggaaucauuaucaugaugauucccaccgugauggcuuuccaccugacgaccagaaacggggagccucauaugaucgucagccggcaggaaaagggaaaaucccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacacccugccacccuuagaaaguacugcguggaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucacgccaagaaacaggauguggucgugcugggaagccaagagggcgccaugcauacggcucucacaggggcgaccgaaauucagauguccucuggcaaccugcuuuuuacaggacaccugaagugcagacuccggauggacaaacugcagcuuaagggcaugagcuauuccauguguaccgggaaauucaaggucgugaaggagaucgccgaaacccaacauggaacaauuguuaucagagugcaguacgagggcgacgggagccccugcaaaauucccuucgagaucauggaucuggaaaagcgccacguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaucaaguguucggggcgaucuauggcgcugccuuuagcggaguuuccuggacgaugaagauucucaucggcgucgugauuacauggaucgggaugaauagccggucuaccucccugagcgugucucugguccuugugggaguugugacccucuaccugggcgucauggugcaggccgacuccggguguguugugagcuggaaaaacaaggagcugaaaugcggauccggcauuuucaucacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucacagagaacgaaguuaaacugaccauuaugacaggagacaucaagggcaucaugcaggccgggaaacggagccugagaccucagcccaccgagcuuaaguacuccuggaaagcguggggaaaggccaagaugcucagcacggaacugcacaaucauaccuuccugauugauggcccugagacagcugaaugccccaacaccaaucgcgccuggaacucucucgagguggaggacuauggguuuggagucuucacaaccaauaucuggcugaaacuuaaggaacggcaagauguguuuugugacuccaaacugaugagcgcugccauuaaggacaacagagcggugcacgccgauaugggcuacuggaucgagucugcucucaacgacacauggaaaauugaaaaggccuccuucaucgaggucaagagcugccacuggccuaaaucucauacccuguggagcaauggcguucuggaguccgaaaugaucauucccaagaacuucgcugggccggugagccagcacaauuaucgcccuggauaccauacgcagacagccggccccuggcaccuugggcggcucgagauggauuuugacuucugugaaggaaccaccguggucgugacagaggauugcggcaacagagggcccucucugcggaccacgacagccuccggaaaacugaucaccgaauggugcugucgcagcugcacacucccuccgcugagauaccggggcgaggacggcuguugguaugggauggagauuagaccccuuaaggaaaaagaggaaaaucugguuaacucccucgugaccgcuggacauggccagaucgauaauuuuucucuggggguccugggaauggcgcuuuuccucgaggaaaugcugcgcacacgggugggcaccaagcacgccauucugcucguugcugugagcuuugucacgcugaucaccgggaacauguccuucagagaccuuggacgcgugaugguuauggugggcgccacaaugaccgaugacauuggcaugggggucacauaccuggcccuccuggcugccuuuaaggugagaccuaccuucgcggcuggacugcuucugcggaaacucacgucuaaggagcugaugaugacaaccaucggcaucgugcuccugagccaauccacaauucccgagucuauccuugaacugaccgaugcccucgcccuggggaugaugguccugaaaauuguucgcaauauggagaaguaucagcuugcugugaccaucauggccauucugugcgugccuaacgcggucauccuccagaaugcuuggaaagugagcuguacaacgcuggccguuguguccgucagcccccuccugcuuaccucuucccaacagaaggccgacuggaucccucuggcucucacaauuaagggacugaaccccaccgccaucuuucugacaacccuuagcagaacgaauaaaaagcggucuuggccgcugaacgaagcuauuauggccgugggcaugguuuccauccucgcgagcucucugcucaaaaaugauauuccuaugacagggccccugguggccggaggccuucugaccgucugcuacgugcugaccggccgcuccgcugaccucgagcuggaaagagccgcugacguccggugggaggagcaggccgaaaucagcggguccagcccuauccuuucuauuacaaucagcgaggauggauccaugucuauuaagaacgaagaggaggaacagacccugacaauccucauucgcacgggccugcucgugaucagcgggcuguuccccguuuccauuccgaucaccgccgcugcgugguaucuuugggaggugaaaaagcaaagagccggaguccugugggacgugccuucucccccucccguuggcaaagcugaacuggaggauggggccuaccggaucaagcagaagggcauucucggcuauagccagaucggcgccgggguguacaaagaaggaacauuucacaccauguggcaugucacacgcggcgcugugcugaugcacaaggggaaaagaauugagcccuccugggccgacgugaagaaagaucuuaucucuuacggaggcggguggaagcuggagggagaauggaaggagggcgaagagguucagguccucgcgcuggaaccuggcaaaaacccgcgggcugugcaaaccaagcccggacucuucaaaacgaauaccggaacaauuggcgccgugagccuggacuuuuccccugggaccagcggaucucccaucgucgauaagaaaggcaaggugguugggcuuuauggaaacggcguggucacaagauccggcaccuacgugagcgccaucgcucagacagagaagucuauugaggacaauccugaaaucgaggaugacauuuuccgcaaaaagcggcugacgaucauggaucugcaucccggggccggaaaaaccaagagauaucucccugcgauuguucgcgaagcuaucaaacggggccugagaacacuuauccuggccccgacccgcguggucgccgcugagauggaagaggcccuccgggggcugcccauuagauaccagaccccugcuauccgcgccgagcacacaggacgggaaauuguggaccucaugugucaugcgacguucaccaugagacugcuuucccccauccggguuccuaacuauaaucugauuaucauggaugaggcccacuuuacagaccccgcuagcauugccgcucgcggcuacaucuccaccagaguggaaaugggggaggccgccggcaucuucaugacagcuaccccgccuggaucucgggaccccuuuccccagagcaacgcgccuauuauggaugaggaacgcgagauccccgaaagauccuggaauagcggccacgagugggucacggacuucaaggggaagacagugugguuugugccuucuauuaaagccggaaacgauaucgcugccugccugcggaagaauggcaaaaaggucauucaacucuccagaaaaaccuucgacagcgaauauaucaagacccgcacaaacgauugggacuuuguugugaccacagauaucucugagaugggggccaauuucaaggcugagcgggugauugacccgagacgcuguaugaaacccgucauccugaccgauggagaagaacgggugauucuugccggcccuaugcccguuacgcauagcuccgcggcucagagacgcgggcgggugggcagaaacccuaagaaugaaaacgaccaguacaucuacaugggagagccccuggaaaaugaugaggacugcgcccacuggaaagaggccaagaugcuccuggacaacauuaacacaccggaaggcaucaucccuucuauguuugagcccgaacgcgagaaagucgaugcuauugacggggaauauagacugcggggagaggcccgcaagaccuucguggaucucaugagacggggcgaccuuccuguuuggcuggcguaccgcguggccgcugaggggaucaauuaugccgauagacggugguguuuugacggagucaaaaacaaucaaauucuggaagagaacguggaagucgagaucuggacaaaggagggcgaaagaaagaaacucaagccccgcuggcuggaugcucggauuuacagcgacccucuugcccugaaagaguucaaggaguucgcugccgggagaaaaucccucacccugaaucugaucacggagaugggccgccuccccaccuuuaugacacagaaggcgaagaacgcccuugauaaucuggcugugcugcauaccgccgaagcuggaggccgggccuauaaccacgcccucucugagcugccggagacacuugaaacccugcuccugcugacacuccuugcuaccguuacaggcgggauuuuccuguuucugaugagcgggaaagggaucggaaagaugacacucggcaugugcugcaucauuaccgcguccauccugcuuugguacgcccagauucagccucacuggaucgcugccagcauuauccuggaguucuuucucaucgugcugcugauucccgaacccgagaaacaaagaaccccucaggacaaucagcucacauauguggucaucgccauucuuaccguuguggcugccacaauggcgaacgaaaugggcuuccuggagaagacgaaaaaggauuuugggcugggaucuaucaccacacagcaaccggaguccaauauucucgacaucgaucugcggcccgccagcgcuuggacccuuuacgccguggcuacaaccuucaucacgccuaugcugcgccauuccauugaaaacucuagcgucaaugugucccucaccgccaucgcgaaccaggccacaguucugaugggccuggggaagggauggccccucucuaaaauggacauuggcgugccucuucuggcuaucggguguuacagccaggucaaucccauuacccugacagccgcucuccugcuucugguggcccacuaugcuaucauuggaccuggccuccaggccaaggcgaccagagaggcccaaaaacgggcugccgcuggcaucaugaagaacccgacggucgacgggaugacagugaucgaucuggaccccauuccuuacgaucccaaauuugaaaagcagcugggacagguuaugcuccuugugcugugcgucacccaggugcugaugaugcgcacaaccugggcccucugugaggcccugacccuugcgacaggcccuaucuccacgcugugggaagggaaucccggaagauucuggaacaccacaauugcuguuagcauggccaacaucuuucggggcucuuaucucgcuggggccggacugcuguucuccauuaugaagaauaccgccaacacacgcagaggcaccggcaauacgggggagacacucggagagaaauggaagaaccggcuuaaugcucugggcaaaagcgaauuucaaaucuacaagaaaucugggauccaggagguggaccgcacccuggccaaggaaggaauuaaaagaggcgagaccgaucaucacgcggucucccgggggagcgccaagcucagaugguucguggagcgcaaccuggugacaccggaaggaaagguugucgaccuuggcugcggcagagggggauggucuuauuacuguggcgggcugaaaaaugugaaggaggugaaaggacucaccaagggcgggccuggacaugaagaacccauccccaugagcacauauggcuggaaccuggucagacugcaguccggcguugauguguucuuuacgccucccgaaaaaugcgacacccuccuuugugauauuggggagucuagcccuaauccgacaguggaggcuggacgcacccugcggguccugaaccucguggaaaauuggcugaacaauaacacacaauucugcaucaagguucuuaaucccuacaugccuuccgugauugagaagauggaagcccugcagagaaaauacggcggggcucucguccgcaacccccugagccggaacuccacccacgagauguauugggugucuaaugccagcggaaacaucguuuccucugugaauaugaucagcagaaugcugauuaaccgcuuuacgaugcggcacaagaaagcgaccuacgaaccugacgucgaucucggcuccgggacaagaaauaucggaauugagucugagacccccaaccuugacaucauuggcaagcgcaucgagaaaaucaagcaggagcaugaaacaagcuggcacuaugaucaggaccauccguacaagaccugggccuaucacggcuccuacgagacaaaacaaaccgggagcgcuucuuccauggugaauggagugguccggcugcugacgaagccuugggacguuauucccauggugacacagauggccaugaccgauaccacaccuuucggccagcagagaguguuuaaagaaaaggucgacacgcgcacccaagagcccaaagaggggacaaagaagcucaugaaaaucaccgcugaauggcuguggaaggagcuuggcaaaaagaaaacaccuagaauguguacccgggaagaguucacacgcaaggugagaagcaacgccgcucugggcgccauuuuuaccgaugagaauaaauggaagucugcgcgggaagccguugaggacuccggguucugggaacucguggauaaggagagaaaccugcaccuggaaggaaaaugcgagacgugugucuauaauaugaugggcaagcgggagaaaaagcucggcgaauuugggaaagcuaagggaagccgcgccaucugguacauguggcugggcgcuagauuccuugaguuugaagcccugggguuccucaacgaggaccauugguuuucucgggaaaauucccugagcggaguggagggcgaggggcuucacaagcugggcuacauucuccgcgauguuuccaaaaaggaaggaggcgccauguaugcggacgauaccgcugggugggacacaagaaucacccuggaggaucugaaaaacgaagagauggugacaaaucauauggaaggagagcacaagaaacucgccgaggccauuuucaagcugaccuaccagaacaaggucgugcggguucagcgccccacgccgagaggcacagugauggacaucaucagccggcgcgaccagagagggucuggacaagucgugaccuauggccuuaacacauucaccaauauggaagcucagcugauucggcagauggagggggaaggcgucuuuaaaagcauccaacagcucacggugaaggaggagauugccguuaaaaacuggcugauccgcgugggaagagaacggcuuucccgcauggcuauuucuggcgaugacugcgucgugaagccucuggaugacagauucgccagcgcgcucaccgcccugaaugauauggggaaagugcggaaggacauccagcagugggagcccuccagaggauggaacgauuggacacaaguucccuuuugcucucaucacuuccacgaacugaucaugaaggacggccgcgugcucgucgugccuugucggaaucaggaugagcugauugggagagcucgcaucagccagggagccggcuggucccuucgggaaaccgcuugccuggggaaaucuuacgcccagauguggagccucauguauuuucauagacgcgaccugcggcuugcggccaacgcuauuuguuccgccguuccgagccacugggugcccacaucuagaaccacaugguccauccaugcuacccacgaguggaugacgacagaggauaugcugaccgucuggaaucgcguguggauucaagaaaacccuuggauggaggacaagacccccgucgaaagcugggaggaaaucccuuaccucggcaaacgggaggaucaguggugcggaucucugaucggccugacauccagagccaccugggcuaagaauauucagacagccaucaaccaggugcgcagccucauugggaaugaggaauauacggacuacaugcccuccaugaaacgguucagacgggaggaagaggaagcgggaguucugugguga

SEQ ID NO: 20297 - RNA, 9876 nt, Artificial Sequence
  derived and/or modified CDS sequence (opt5) from DENV-2__KX702403__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugauccuuauucugcucacggccgucgcgccuagcaugaccaugcggugcaucggcauuuccaaccgcgauuucguggaagggguuucuggaggcagcuggguggacaucguccuggagcacggguccugugugacaaccauggccaagaauaagcccacacuugauuuugaacugaucaaaaccgaggcuaagcagccugccacgcucagaaaauauugcauugaagcuaagcugacaaacaccaccacagagagccgguguccgacccaaggagagcccucucugaaugaagaacaggacaaacgcuucaucugcaagcauuccaugguggauagaggcuggggcaacggguguggacucuuuggcaaagggggaauugucacaugcgccauguucacgugcaaaaagaauauggaaggcaaaaucguucagccugagaaccuggaauacaccauugugaucacaccccacagcggggaggagcaugcggugggaaaugacaccggcaagcacggcaaagaaaucaagauuacaccucagucuuccaccacggaggccgaacuuaccggguauggaacagucaccauggaguguagcccccggacaggccuggauuuuaacgaaauggugcuccugcaaauggaggacaaggcuuggcuuguucaccgccagugguuccuggaucucccgcugccuuggcugcccggggccgacacccagggaucuaauuggauccagaaggagacgcucgugacauuuaagaacccucaugcuaaaaagcaagacgucgugguucugggcucccaggaaggggccaugcacaccgcccuuacaggcgcuaccgagauucagaugagcuccggaaaucuccuguucaccggccaucugaaaugcagacuucggauggauaagcugcaacucaaagggaugucuuacagcauguguacaggaaaguuuaagaucgugaaagaaauugcggagacgcagcacggcaccaucgucaucagagugcaguaugagggggacggaucccccugcaagauucccuucgaaaucacagaucuggagaaacgccauguccugggccggcucauuaccgugaacccuaucguuacagaaaaggacagcccggugaacauugaggccgaacccccuuucggggauucuuacaucauugucggcguggagcccggacagcugaaacuuaauugguuuaagaagggcuccagcaucgggcaaauguucgagaccacgaugagaggagcuaaacgcauggccauccugggcgacacagccugggauuuugggucucucggaggcguuuucaccagcauugggaaggcucugcaccagguguuuggcgccaucuacggagcggcuuucuccggcgucucuuggaccaugaaaauucugaucggggugauuaucacauggaucggaaugaacagccgguccaccagccuuucugugucccucguucuggucggcguggugacacuguaucucggggccaugguccaggccgacagcggauguauugugucuuggaagaauaaagaacugaagugcggcuccgggaucuuuauuacggauaacguucacaccuggacagagcaguacaaguuccaaccugaaagccccuccaaacuugcuucugccauccagaaggcucaugaggaaggcauuuguggaaucagaagcgugacccgccuggagaaucucauguggaaacagaucacaccggagcugaaccacauucuguccgaaaaugaggucaaacuuaccaucaugacgggcgacauuaaagggaucaugcaggccggaaagcggucucucagaccucaacccaccgaacugaaauauagcuggaagacauggggcaaggcgaaaaugcuguccaccgagagccauaaccagacauuucucauugaugggccugaaaccgccgagugccccaauacaaaccgcgcuuggaacucucuggagguggaagacuacggauucggcguuuuuaccacgaacaucuggcuuaagcugcgggagaaacaggacguguucugugauuccaagcucaugagcgccgcuaucaaagacaauagagccguccacgcggauaugggcuauuggauugaaucugcccugaacgacacauggaagauggagaaggcuuccuuuaucgaggugaaaagcugccacuggccuaagucucauacccuguggagcaaugggguucuugaauccgagaugauuauccccaaaaacuucgccggaccggugagccagcacaacuaccgcccuggcuaucauacccaaacagcugggcccuggcaccucggaaagcuggaaauggauuucgacuuuugugagggcaccacggucguggugacagaagauugcgagaaacgggggcccucucugagaaccacaaccgccuccggaaagcucauuacagaguggugcugucggagcugcacccugccuccgcuucgcuacagaggcgaagacggcuguugguacgggauggagauccggccccugaaggaaaaagaggaaaaucucgucaacucccugguuacggccggacauggccagauugauaauuucucucugggggugcuuggaauggcucucuuucuggaggagaugcugagaacccgcgugggcacaaagcacgcgauccuccuggucgcccuuagcuucgugacccugaucacagggaacauguccuuucgggaccucggaagaguuauggugauggucggcgcuaccaugacggaugacauuggcaugggggugacauaucuggcccugcuugccgcuuucaaaguucgcccuaccuuugccgcgggacugcuccugagaaagcucacaucuaaagaacugaugauggcuaccaucggcauugcccuucugagccaguccacccuccccgagacaauccuggaacugacggaugcccuugcucuggggaugauggcccucaagauugugcggaauauggagaaguaccaacuggcggucaccaucauggcuaucucuugcgugccuaacgccguuauucuccagaaugccuggaaagugagcuguacaauccuggcugccgucuccgugagcccccuucugcucaccucuucccagcagaaggcugacuggauuccucuggcccugacaaucaaaggacuuaaccccaccgcgauuuuccugacgacacucagccgcaccucuaagaaaagauccuggccgcugaaugaagccaucauggcugugggcauggucagcauccucgccucuucccugcuuaagaacgacauuccuaugaccgggccccugguugcuggaggccugcucacagugugcuaugugcugaccggccggagcgccgaucuugagcuggagcgcgccgcugacgucaaaugggaagaucaagcggagaucuccgggagcucuccuauucucagcaucacaauuuccgaagacggaucuaugagcaucaagaaugaggaggaagaacagacgcugaccauucucaucagaacaggccugcuugugaucuccgggguuuuucccgugucuauuccgaucaccgccgcugccugguaccugugggaagucaagaaacagcgggccggagugcugugggauguuccuucucccccucccgugggcaaggcugagcucgaagacggggccuaucgcauuaaacagagaggaauccugggcuacucccaaauuggcgcgggggucuauaaggagggaacauuccacaccauguggcaugugacgcggggcgcuguccuuaugcaccgcgggaaaagaaucgagcccuccugggccgaugugaagaaggaccugaucagcuacggaggcggguggaaacucgaaggagaguggaaggaaggcgaggaaguucaggugcuggcccucgagccuggcaaaaacccgcgggcuguccagaccaagcccgggauuuuuaaaacaaauaccggaacaaucggcgccgugucccuggauuucagcccugggaccucuggaucccccauuguugacagaaagggcaagguggucgggcuuuacggaaacggcguggugacacgcagcggcgcguauguuucugcuaucgcccagacggagaaauccauugaagauaauccugagaucgaagacgauaucuuucggaagaaaagacugaccauuauggaccugcaucccggggccggaaagacaaaacgcuaccucccugcuaucguccgggaggccauuaagagaggccugcgcacccuuauccuggcuccgacccgggugguggccgcggaaauggaggaggcccucagagggcugcccauucgcuaucaaacgccugcuauccgggccgaacacacgggaagagagauugucgaccucaugugucaugcuaccuucacaaugcggcugcuuagccccgugcgcguuccuaacuacaaccugaucaucauggaugaagcccacuucaccgaccccgccuccauugcugcgagaggcuauaucucuacacggguggagaugggggaggccgcuggcauuuuuaugaccgccacgccgccuggaagccgcgaucccuucccccaguccaaugccccuaucauggacgaagagagagaaauucccgagcggagcuggaacucuggccacgaaugggucacagauuuuaaggggaaaaccgugugguucguuccuuccaucaaggcuggaaaugacaucgccgcgugccugcgcaagaauggcaagaaagugauucagcucagccgcaagaccuuugauucugaguacgucaagacacgggcuaaugacugggauuucgugguuaccacagacaucagcgagaugggggccaacuuuaaagccgaaagagugauugauccgcgccgguguaugaagcccgucauccugaccgacggagaggaaagagugauucuugcuggcccuaugcccgugacgcauuccucugccgcgcaacgccgggggagaaucggccgcaauccuaaaaacgagaaugaccaguauaucuacaugggagaaccccuggagaacgaugaggacugcgcccacuggaaggaagcuaaaaugcuccuggauaauauuaacacaccggagggcaucauuccuagcauguucgaacccgagagagaaaaggucgacgccaucgauggggaguaccggcugcgcggagaggcuagaaaaaccuuuguugaccucaugcggcgcggcgaucuuccuguguggcuggccuauaagguggcugccgaagggauuaauuacgcggacagaaagugguguuucgauggaaucaaaaacaaucagauucuggaggaaaacgucgagguggagaucuggacaaaggaaggcgagcggaaaaagcucaaacccagauggcuggacgcccgcaucuauuccgauccucuugcucugaaggaauuuaaggaguucgccgcugggcggaaaucucucacccugaaccugauuacggaaaugggcagacuccccaccuucaugacacagaaggcccgcaaugcccuugacaaccuggcuguucugcauaccgcggaggugggaggcaaagccuacacacacgcucucagcgagcugccggaaacccuugagacacugcuccugcugacccuccuugccgccgucacagggggaaucuuucuguuccugauguccggcaaggggauuggaaaaaugacacucggcaugugcugcaucauuaccgcuagcauccugcuuugguaugcccaaauccagccucacuggauugcggccucuaucauucuggaauuuuuccucaucgugcugcugauucccgagcccgaaaagcagcggaccccucaggauaaucaacucacauacguugugaucgcuauccuuaccgucguggccgcuacaauggccaacgagaugggcuuucuggagaagacgaaaaaggaccugggguucggauccauuaccacacaggaaagcgaguccaauauccucgacauugaucugagaccggcgucugccuggacccuuuaugcugucgccacaaccuuugugacgcccaugcugcggcauagcaucgaaaacuccucuguuaaugugagccucaccgcuauugccaaccaggcuacagugcugaugggccuggggaaaggauggccucucuccaagauggacaucggcgucccccuucuggccauuggguguuacagccagguuaauccuaucacccugacagcggcccuccugcuucugguggcucacuacgccaucauuggacccggccuccaagcuaaagccacccgcgaggcccagaagagagcggcugccggcaucaugaagaacccuacgguggaugggauuacagucaucgaccuggaaccgauuccccaugauccuaaauucgagaagcagcugggacaggugaugcuccuuauccugugcguuacccaagugcugaugaugcggacaaccugggcucucugugaggcccugacccuugccacaggccccaucucuacgcugugggaagggaauccuggacgcuuuuggaacaccacaauugcugucuccauggccaauaucuucagaggcagcuaucucgcgggggccggacugcuguuuucuauuaugaaaaacaccacaaauacccggcgcggcacgggcaacgugggggagacacucggagaaaaguggaaauccagacuuaaugcucugggcaagagcgaguuccagaucuacaaaaagucugggauucaggaggucgaccggacccuggccaaggaaggaaucaaacgcggcgagaccgaucaccaugcugugagcagaggguccgccaagcuccggugguuuguugaaagaaacauggugacacccgagggaaaagucguggaccugggcugcggccgcgggggauggucuuauuacuguggcgggcuuaagaacguucgggaagugaaaggacugaccaagggcgggccgggacacgaggagccuauccccaugagcacauauggcuggaaucucgucagacugcaauccggcguggauguguucuucacgcccccugaaaagugcgacacccugcucugugauauuggggagagcucccccaacccuacaaucgaagcgggacgcacccuucggguucugaaucuggucgagaacuggcucaauaacaauacacaguuuugcauuaaagugcugaacccguacaugcccucugugaucgaaaagauggagacccuucagagaaaauauggcggggcccugguccgcaauccucucagccggaacuccacgcacgagauguacuggguuucuaaugcuaccggaaacauugugagcuccgugaauaugaucucuagaaugcugaucaaccgcuucacaaugaagcauaaaaaggccaccuacgaacccgacgucgaucugggcagcgggacacggaauauuggaaucgaguccgaaaccccuaaccucgacauuaucggcaagagaauugagaaaaucaagcaggaacacgagacaagcuggcauuaugaccaagaucaccccuacaaaaccugggcuuaucacggcucuuacgagacgaagcagacaggguccgccagcucuauggugaacggaguugugcgccuucugaccaaaccgugggacgucgugccuaugguuacccagauggcuaugacagauacgacccccuuuggccagcaacggguguucaaggaaaaggucgacacaagaacccaggagccuaaagaagggacaaagaaacugaugaagauuaccgccgaguggcucuggaaagagcugggaaaggagaaaacaccccgcauguguaccagagaggaauuuacgcggaaggugcgcuccaaugcggcccuuggcgcuguguucaccgaugagaacaaguggaaaagcgccagagaagcugucgaggacgggcgguuuugggagcugguugauagagaacggaaucuccaucuggagggaaagugcgaaacauguguguauaacaugaugggcaaacgcgagaagaaacugggcgaguucgggaaggccaagggaucuagagccaucugguacauguggcucggcgcgcgguuucuggaguucgaggcucuuggguuucugaaugaagaccacugguucucccgcggaaacagccucuccggcguggagggggaaggccugcauagacuuggauauauccugcgggaggucggcaaaaaggaagggggagccauguacgccgaugacaccgcuggcugggauacacgcauuacccucgaggaccugaaaaaugaggaaauggugacgaaccacaugaagggggagcauaaaaagcuggccgaagcuaucuuuaagcucacauaccagaauaaaguugugagaguccagcggccuacccccagaggaacagugauggacauuaucagcagaaaggaucaacggggcucugggcagguuggcaccuauggacugaacacguucaccaauauggaggcccagcuuauucgccaaauggagggcgaagggaucuucaaaagcauccagcaccugacagcgaccgaggaaacagccgugcagaacuggcucgcuagagucggacgggagcgccuguccagaauggccauuucuggcgacgauugcgugguuaagccgaucgacgaucgguuugcuagcgcccuuaccgcgcugaaugacauggggaaagugagaaaggauauucagcaaugggaaccuucccgcggauggaacgacuggacacagguccccuucugcucucaccauuuucacgagcucgugaugaaggauggccggguccuggugguucccuguagaaaucaggacgagcugaucgggcgcgcccggauuagccagggcgcuggauggucccucaaagaaaccgccugccugggcaagucuuacgcucaaauguggacgcuuauguauuuccauagacgcgaucugcggcucgccgcuaacgccaucuguagcgcggugccuucccacugggucccgacaagcagaaccaccuggucuauccacgccaaacaugaguggaugacaaccgaagacaugcuggcuguguggaaccgcguguggauucaggagaaucccuggauggaagauaagacaccuguugaguccugggaggaagugcccuaccuugggaaacgggaggaccaguggugcggaagccugaucggccucacgucuagagccaccugggccaagaacauucagacagcuaucaaucaaguccgcucccugauugggaacgaaggauauaccgacuacaugccuagcaugaagcgguuuagacgggaggaagaggaggccggcgugcugugguga

SEQ ID NO: 20298 - RNA, 9876 nt, Artificial Sequence
  derived and/or modified CDS sequence (opt5) from DENV-2__KX702404__SS-prME
accgccggcgugaucgucaugcugauucccacggcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccaccacggaggccgaacugaccggguauggaacagugaccauggaguguagcccccggacaggccuugauuucaacgaaaugguucugcuccaaauggaggacaaggcuuggcuggugcaccgccagugguuucuugaucugccgcucccuuggcugcccggggccgacacccagggaucuaauuggauucagaaggagacgcuggucacauucaagaacccucaugcuaaaaagcaagacgugguugugcucggcucccaggaaggggccaugcacaccgcccugacaggcgcuaccgagauccagaugagcuccggaaaucuucuguuuaccggccaucucaaaugcagacugcggauggauaaacuucaacugaaagggaugucuuacagcauguguacaggaaaguucaaggucgugaaagaaauugcggagacgcagcacggcaccaucgucauuagagugcaguaugagggggacggaucccccugcaagauccccuucgaaaucacagaucucgagaaacgccauguucugggccggcugauuaccgugaacccuaucgucacagaaaaggacagcccggugaacauugaggccgaacccccuuuuggggauucuuacaucauuguuggcguggagcccggacagcucaaacugaauugguucaagaagggcuccagcaucgggcaaauguuugagaccacgaugagaggagcuaaacgcauggccauucuuggcgacacagccugggauuucgggucucugggaggcgucuuuaccagcaucgggaaggcucuccaccagguguucggcgccaucuacggagcggcuuuuuccggcgugucuuggaccaugaaaauucugaucgggguuauuaucacauggauuggaaugaacagccgguccaccagccugucugucucccuugugcucgugggcgucgugacacuguaucugggggccaugguucaggccgacagcggauguguggucucuuggaagaauaaagaacucaagugcggcuccgggaucuucaucacggauaacgugcacaccuggacagagcaguacaaguuucaaccugaaagccccuccaaacuggcuucugccauucagaaggcucaugaggaaggcaucuguggaauuagaagcguuacccgccuugagaaucugauguggaaacagaucacaccggagcucaaccacauucuguccgaaaaugagaucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcgucuucaccacgaacaucuggcugaaacuucgggagaaacaggacguguuuugugauuccaagcugaugagcgccgcuauuaaagacaauagagccguucacgcggauaugggcuauuggaucgaaucugcccucaacgacacauggaagauggagaaggcuuccuucaucgaggugaaaagcugccacuggccuaagucucauacccuguggagcaaugggguccuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacgguggucguuacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggugaauagccucgugacggccggccaugggcagauugauaacuuuucucugggaguccugggcauggcucuuuuccucgaagagaugcugagaacccgcguggggacaaaacacgcgauccugcucguugcccugagcuuugugacccuuauuacaggaaauauguccuuccgggaccugggcagagucauggugaugguuggcgcuaccaugacggaugacaucgggaugggagugacauaucucgcccugcuggccgcuuuuaagguccgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcgguuaccaucauggcuauuucuugcgugccuaaugccgucauccugcagaacgccuggaaggugagcuguacaauccucgcugccguguccgucagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguugggauggugagcauucuggccucuucccuccugaaaaaugacaucccuaugaccggaccccuuguggcuggcggccugcugacagucugcuaugugcucaccgggcggagcgccgaucuggaacuugagcgcgccgcugacguuaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugauuuccggagucuuccccgugucuaucccgaucaccgccgcugccugguaccuuugggagguuaagaagcagcgggccggcgugcugugggaugucccuucucccccucccguggaaaaagcugagcuggaagacggggccuaucgcauuaagcagagaggaauccucggcuacucccaaauuggcgcgggggucuauaaagagggaacauuucacaccauguggcaugugacgcggggcgcuguucugaugcaccgcgggaagagaaucgagcccuccugggccgaugugaaaaaggaccuuauuagcuacggaggcggguggaagcuggaaggagaguggaaagaaggcgaggaaguccaggugcucgcccuggagccuggcaagaauccgcgggcuguucagaccaaacccgggaucuucaagacaaacaccggaacaaucggcgccgugucccucgauuuuagcccugggaccucuggaucccccauugucgacagaaaaggcaaggugguggggcuguacggaaauggcguugucacacgcagcggcgcguaugugucugcuaucgcccagacggagaaguccauugaagauaacccugagaucgaagacgauauuuuccggaaaaagagacuuaccaucauggaccugcaucccggggccggaaaaacaaagcgcuaccugccugcuaucgugcgggaggccauuaaaagaggccuccgcacccugauccuugcuccgacccgggucguggccgcggaaauggaggaggcccugagagggcuccccauucgcuaucaaaccccugcuauccgggccgaacacacgggaagagagauuguugaccugaugugucaugcuaccuucacaaugcggcuccugagccccgugcgcgucccuaacuacaaucuuaucauuauggaugaagcccacuuuaccgaccccgccuccaucgcugcgagaggcuauaucucuacacggguggagaugggggaggccgcuggcauuuucaugaccgccacgccgccuggaagccgcgaucccuuuccccaguccaacgccccuaucauggacgaagagagagaaauucccgagcggagcuggaacucuggccacgaauggguuacagauuucaaggggaagaccgugugguuugucccuuccaucaaagcuggaaacgacauugccgcgugccugagaaagaauggcaaaaaggugauccagcugagccgcaaaaccuucgauucugaguacguuaagacacgggcuaacgacugggauuuuguggucaccacagacaucagcgagaugggggccaauuucaaggccgaaagagugauugauccgcgccgguguaugaaacccgugauccucaccgacggagaggaaagagucauucuggcuggcccuaugcccguuacgcauuccucugccgcgcaacgccgggggagaaucggccgcaacccuaagaaugagaacgaccaguauauuuacaugggagaaccccuugagaaugaugaggacugcgcccacuggaaagaagcuaagaugcugcucgauaacaucaauacaccggagggcaucauuccuagcauguuugaacccgagagagaaaaaguggacgccaucgauggggaguaccggcugcgcggagaggcuagaaagaccuucguggaccugaugcggcgcggcgaucucccugucuggcuugccuauaaaguggcugccgaagggauuaacuacgcggacagaaagugguguuuugauggaaucaagaauaaccagauucuggaggaaaacguugagguggagaucuggacaaaagaaggcgagcggaagaaacugaagcccagauggcucgacgcccgcauuuauuccgauccucuggcucuuaaagaguucaaggaguucgccgcugggcggaagucucugacccucaaucugaucacggaaaugggcagacugcccaccuuuaugacacagaaagcccgcaacgcccucgacaaucuugcuguccugcauaccgcggaggugggaggcaaggccuacacacacgcucugagcgagcucccggaaacccuggagacacuucugcuccugacccugcucgccgccguuacagggggaaucuuccuuuuucugauguccggcaaagggauuggaaagaugacacugggcaugugcugcaucauuaccgcuagcauccuccugugguaugcccaaauucagccucacuggaucgcggccucuaucauucuugaguucuuucugaucgugcuccugauucccgagcccgaaaaacagcggaccccucaggauaaccaacugacauacgucgugaucgcuauucucaccgucguggccgcuacaauggccaaugagaugggcuuccuugagaagacgaagaaagaccugggguuuggauccaucaccacacaggaaagcgaguccaacauccuggacauugaucucagaccggcgucugccuggacccuguaugcuguugccacaaccuucgugacgcccaugcuucggcauagcaucgaaaauuccucugugaacgucagccugaccgcuauugccaaucaggcuacaguucucaugggccuggggaagggauggccucuguccaaaauggacaucggcgugccccuccuugccauuggguguuacagccaggugaacccuaucacccugacagcggcccugcuccugcuugucgcucacuacgccauuaucggacccggccugcaagcuaaggccacccgcgaggcccagaaaagagcggcugccggcaucaugaagaauccuacgguggaugggauuacaguuaucgaccucgaaccgauucccuaugauccuaaguuugagaaacagcugggacaggugaugcugcucauccuuugcgucacccaagugcugaugaugcggacaaccugggcucugugugaggcccucacccuggccacaggccccauuucuacgcuuugggaagggaacccuggacgcuucuggaauaccacaaucgcugucuccauggccaacaucuuuagaggcagcuaccuggcgggggccggacuccuguucucuauuaugaagaauaccacaaacacccggcgcggcacgggcaaugugggggagacacugggagaaaaauggaaguccagacucaacgcucuuggcaaaagcgaguuucagaucuauaagaaaucugggauucaggagguugaccggacccuggccaaggaaggaaucaagcgcggcgagaccgaucaucacgcugugagcagaggguccgccaaacugcggugguucgucgaaagaaacauggugacacccgagggaaagguuguggaccucggcugcggccgcgggggauggucuuacuauuguggcgggcugaaaaauguccgggaagugaagggacuuaccaaaggcgggccgggacaugaggagccuauucccaugagcacauacggcuggaaccuggugagacuccaauccggcguugaugucuucuuuacgcccccugaaaagugcgacacccugcugugugauaucggggagagcucccccaauccuacaaucgaagcgggacgcacccuccgggugcuuaaccugguggagaauuggcugaacaauaacacacaguucugcauuaagguccucaauccguauaugcccucuguuaucgagaagauggagacccugcagagaaaguacggcggggcccuugugcgcaacccucugagcagaaauuccacgcacgagauguacugggugucuaacgcuaccggaaauauugucagcuccgugaacaugaucucuagaaugcucauuaaucgcuuuacaaugaaacacaagaaagccaccuaugaacccgacguugaucugggcagcgggacacggaacaucggaaucgaguccgaaauuccuaaccuggacaucgugggcaagagaauugagaagaucaaacaggaacaugagaccagcuggcacuacgaccaagaucaucccuauaagacaugggcuuaccacggcucuuaugagaccaaacagacgggguccgccagcucuauggucaauggagugguucgccuccuuacaaagccgugggacguggucccuauggugacccagauggcuaugaccgauacaacgcccuucggccagcaacggguguuuaaagaaaaggucgacaccagaacacaggagccuaaggaagggaccaaaaagcugaugaaaauuacagccgaguggcuguggaaggagcucggaaaagaaaagacaccccgcauguguacaagagaggaguucacccggaaaguucgcuccaacgcggcccugggcgcuguguuuacgaaugagaacaaguggaaaagcgccagagaagcuguggaggaugggcgguucugggagcuugucgacagagaacggaaucugcaccucgagggaaaaugcgaaaccuguguguacaacaugaugggcaagcgcgagaaaaagcugggcgaauuugggaaagccaagggaucuagagccaucugguauauguggcugggcgcgcgguuccucgaguuugaggcucugggguuccuuaaugaagaucauugguuuucccgcggaaacagccuguccggcguugagggggaaggccuccacagacugggauacauucuucgggaggugggcaagaaagaagggggagccauguacgccgacgauacagcuggcugggacacccgcaucacacuggaggaucucaagaaugaggaaauggucaccaaccauaugaaaggggagcacaagaaacuggccgaagcuaucuucaagcugacguaucagaauaaggugguuagagugcagcggccuacaccccgcggaaccgucauggacauuaucagcagaaaagaccaacggggcucuggacaggugggcacauacggacucaacaccuucacgaauauggaggcccagcugauucgccaaauggagggcgaagggaucuuuaagagcauucagcaucuuaccgcgacagaggaaaucgccguucagaacuggcuggcuagagugggacgggagcgccucuccagaauggccaucucuggcgaugacugcgucgugaaaccgauugaugaccgguucgcuagcgcccugaccgcgcuuaaugauauggggaaggucagaaaagacauccagcaaugggaaccuucccgcggauggaacgauuggacacaggugcccuuuugcucucaccacuuccaugagcugguuaugaaggacggccgggugcucgucgugcccuguagaaaccaggaugagcugauugggcgcgcccggaucagccagggcgcuggauggucccugaaggaaaccgccugccucggcaaaucuuaugcucaaauguggacacugauguacuuucacagacgcgaccuucggcuggccgcuaaugccauuuguagcgcggugccuucccauuggguuccgaccagcagaacgacauggucuauccacgccaagcacgaguggaugaccaccgaagauaugcucgcuguguggaaccgcgucuggauccaggagaaucccuggauggaagacaaaacaccuguggaguccugggaggaaguucccuaucuggggaagcgggaggaucaguggugcggaagccuuauuggccugaccucuagagccacaugggccaaaaacauccagacggcuauuaaucaagugcgcucccucaucgggaacgaaggauacaccgacuauaugccuagcaugaagcgguucagacgggaggaagaggaggccggcguccugugguga

SEQ ID NO: 20299 - RNA, 9873 nt, Artificial Sequence
  derived and/or modified CDS sequence (opt5) from DENV-2__JQ686088__SS-prME
acaacaggaaugaucauuaugcugauccccacggugauggccuuccaccucaccacacggaacggggaaccucauaugauugugagccggcaggacaagggaaaaagccugcuuuuuaagaccaaagauggaacaaauaugugcacccugauggcuauggaccucggggaacugugugaagauacaaucaccuacaagugcccguuccuuaaacagaacgaacccgaagacauugauuguuggugcaauucuacgagcaccuggguuacauauggaaccuguacaaccacgggcgaacaccgcagagagaagcgguccguggcccuggugccucaugucgggaugggacucgagacacgcaccgaaacauggaugucuagcgagggcgcguggaagcacgcucagagaaucgaaaccuggauccugcggcaucccggcuuuaccauuauggccgccauccuggcuuacacaauugggacgacccacuuccagcgcgugcucaucuuuauucugcuuacagccguugcuccuuccaugaccaugagaugcaucggaauugccaaccgggacuucguggagggcgucucugggggaagcuggguggauaucguucuggagcacggcuccugugugacaaccauggcgaaaaauaagcccacgcucgacuuugaacugaucaaaacagaggccaagcagccugcuacccuucgcaaauauugcauugaagccaagcugaccaacacaaccacagauagcagauguccgacgcaaggggagcccucucucaaugaagaacaggacaagcgguucgucugcaaacauuccaugguggaucgcggauggggcaacggcugugggcuguuuggaaagggcgggaucgugaccugcgcuauguucacaugcaaaaagaauaugaaaggaaagauuguccagccugagaaccuggaauacaccaucguuauuacaccccacagcggcgaggaacaugccguggggaaugacaccggaaaacacggcaaggaggugaagaucacgccucagucuuccaucaccgaagcggagcucacaggcuaugggaccgucacaauggaguguagccccagaaccggacuggauuuuaacgaaauggugcuucugcaaauggaggacaaagccuggcucguucaccggcagugguuccuggaccuuccgcugccuuggcuccccggcgcugauacgcaggggucuaauuggauucagaaggaaacacuggugaccuuuaaaaacccucaugccaagaaacaagacgucgugguucugggaucccaggagggcgcuaugcacacagcccucaccggggccaccgaaauccagaugagcuccggcaaucugcuuuucacaggacaucugaagugccgccucagaauggauaagcugcaacuuaaaggcaugucuuacagcauguguacggggaaguucaaaguggucaaggagauugcugagacccagcacggaacaaucgugauucggguccaguaugaaggcgacgggucccccugcaaaauccccuuugagaucauggaucuggaaaagagacaugugcucggacgccugauuaccguuaacccuaucgugacagagaaggaccggccggucaacauugaggcggaacccccuuucggcgauagcuacaucauuaucgggguggagcccggccagcugaaacucaauugguuuaagaaaggaucuuccauuggccaaauguucgaaaccacgaugagaggggccaagcgcauggcuauccugggagacacagccugggauuuuggcagccuugggggaguuuucaccucuaucggcaaagcccugcaccagguguuuggggcuauuuacggcgccgcguucagcggagucuccuggaccaugaagauccucauuggcgugaucauuacauggaucgggaugaacucucggagcaccucccugagcgugucucugguucuugucggaaucgugacacucuaucugggcgugaugguccaggcugacuccgggugugugguuagcuggaagaauaaagagcugaagugcggaaacggcauuuuugugacggauaauguccacaccuggacagaacaguacaaauuccaaccugagucucccuccaagcucgccagcgccauccagaaagcucaugaggaagggauuuguggcaucagauccgugacccgccuggagaaccuuauguggaagcagauuacaccggaacugaaucacauccucucugagaacgaaguuaaacugaccaucaugacgggagacauuaagggcaucaugcaaguggggaagcggagccugcaaccucagcccaccgagcuuagauauuccuggaaaacauggggaaaggccaaaaugcucucuaccgagcugcauaaucagacauuucugauugacggcccugaaaccgcugagugccccaacacaaaucgcgccuggaacagccucgaagucgaggauuacggguucggaguguuuaccacgaauaucuggcugaaacuucgggaaaaacaggacguuuucugugauuccaagcugaugagcgcggccauuaaggacaacagagcugugcacgccgauaugggcuauuggaucgagucugcucucaaugacacauggaaaaucgagaaggccuccuucauugaagucaaaagcugccacuggccuaagucucauacccugugguccaacggcgugcuggagagcgaaaugaucauucccaaaaaccuugcggggccggugucucaacacaauaaccgcccuggauacuauacccagacagccggccccuggcaucucgggaagcuggagauggauuuugacuucuguaagggaaccacggucguugugacagaggauugcggcaaucgggggcccagccugagaaccacaaccgcuuccggaaaacucaucacagaauggugcugucggagcugcacccugccuccgcuucgcuacagaggcgaggacggcuguugguacgggauggaaauucggccccugaaggagaaagaagagaaccucgucaauucucuggucacggccggacacggccagaucgauaacuuuucccuggggauucuuggaauggcucucuuccuggaggaaaugcugagaacccgcgugggcacaaagcaugccauccuccugguugccgugagcuuugucacccuuaucacagggaauauguccuuccgggaccugggaagagugauuguuauggugggcgcuaccaugacggaugacaucggcaugggggucacauaucucgcgcugcuggccgcuuuuaaagugcgcccuaccuucgccgccggacuucugcucagaaagcugacaucuaaggagcucaugaugaccaccauuggcaucguucugcuuagccaauccucuauucccgaaacaauccuggagcucacggacgcucuggcccuggggaugaugauccuuaaaauggugcggaacauggaaaaguaccagcuggcggucaccauuauggcuauccucugcgugccuaaugccgugauucugcagaacgccuggaaagucagcuguacaauccucgcuguuguguccgugucuccccugcuucugaccagcucccagcaaaaggccgauuggauuccuaucgcgcucacaaucaaaggacugaaucccaccgcuauuuuucugacgacacuuagccgcaccucuaagaaaagauccuggccgcugaacgaggccaucauggccgucggcauggugagcauucucgcuucuucccugcucaagaaugacaucccuaugaccgggccccugguugccggaggccuucugacagugugcuauguccugaccggccggagcgcugaucucgagcuggaacgcgccgcggacgugaagugggaggaucaggccgaaauuucuggguccagcccuauccuuuccauuacaaucagcgaggacggaucuaugagcaucaaaaacgaagaggaggaacagacgcugaccauucucaucagaacaggccugcucguuguguccgggcuguuccccgucucugugccgauuaccgcugccgcuugguaccuuugggaggucaagaaacagcgggccggagugcugugggauguuccuucucccccucccgccggcaaggcugaacuggaggacggggcguaucgcaucaaacaaaagggcauucucggcuacucccagaucggcgccgggguguauaaggagggaacauuucacaccauguggcacgucacgagaggcgcugugcugaugcauaaagggaagcggaucgaacccuccugggccgauguuaaaaaggaccuuauuagcuacggaggcggguggaaacuggagggagaauggaaggagggcgaagaggugcagguccucgcccuggagccuggcaagaauccgcgcgcugugcagaccaaacccggacucuucaagacaaacaccggaacaaucggcgccgugucccuggauuuuucuccugggaccagcggaucccccauuguugacaaaaagggcaaagucguggggcuuuacggaaacggcguggucacaagaagcggcgcguaugugucugcuaucgcccaaacggaaaaguccauugaggauaauccugaaaucgaggacgacaucuuccggaagagacgccugaccauuauggaucugcaccccggggccggaaaaacaaagcgguaccucccugcuaucguuagagaagccauuaaacgcggccugcggacccuuauccuggcgccgaccagaguggucgcugccgagauggaggaagcccuccgcgggcugcccgugcgguaucagaccccugcuauuagagccgagcauacgggacgcgaaaucguugaccucaugugucacgcuaccuucacaaugcggcugcuuagccccauuagagugccuaacuacaaucugaucaucauggaugaggcccauuuuaccgaccccgcgucuauugccgcucggggcuauaucuccacacgcgucgaaaugggggaggccgcuggcauuuucaugaccgccacgccgccuggaagcagagaucccuuuccccaguccaacgccccuaucauggacgaggaacgggagauucccgaacgcucuuggaauagcggccacgagugggugacagauuucaaggggaaaaccguuugguuugugccuuccaucaagaccggaaacgacaucgcugcgugccugagaaagaauggcaaacgggucauucaacucagcagaaagacauucgauucugaguacaucaaaacccgcacaaacgacugggauuuuguggugaccacggacauuuccgaaaugggggccaauuucaaggcucagcgggucaucgacccgagacgcuguaugaaacccguuauucugacagauggagaggaacgggugauccuugccggcccuaugcccgugacccacagcucugccgcucagagagggcgcgucggccggaacccuaagaaugagaacgaccaguauaucuacaugggagaaccccuggagaaugaugaggacugcgcccauuggaaagaagcgaagaugcuccuggauaacauuaauacaccggagggcaucauuccuagcauguuugaacccgagagagaaaagguggacgcuaucgauggggaguaccgccugagaggagaggcccggaaaaccuucguugaccucaugcgcagaggcgaucuuccuguguggcuggccuauaaggucgcugccgaagggauuaacuacgcggaccggcgcugguguuuugauggaacgagaaacaaucaaauccuggaggaaaacguggagguugaaauuuggaccaaagagggcgagcggaagaaacucaagcccagauggcuggacgcccgcaucuaugcugauccucuugcccugaaggaguucaaagaguucgcugccgggcggaagucccucacacugaaucugaucaccgaaaugggcagacuccccacauuuaugacccagaaagugcgcgacgcucuugacaaccuggccguccugcacacagcggaggccggaggcaaggcuuacaaucaugcccucaacgagcugccggaaacccuugagacgcugcuccugcugacacuccuugcuaccgugaccgggggaauuuuccuguuucugaugucuggccgggggaucggaaaaaugacacucggcaugugcugcauuaucaccgccagcauucugcuuugguaugcccagauccagccucacuggaucgcugcguccauuauccuggaguucuuucucauuguccugcugauccccgagcccgaaaagcaaagaacaccucaggauaaucagcucacguacgugguuauugccauccuuaccgugguggcugccacaauggccaacgagaugggcuuccuggagaagaccaaaaaggaccuggggcucggaucuaucgucacacagcaaccggaaagcaauauucuggauaucgaccuucggcccgcuuccgccuggacccuguaugcgguugccacgaccuuuauuacaccuaugcuccgccacagcaucgagaacucuuccgugaaugugagccugaccgcuauugccaaccaggcuacaguccugaugggccucgggaaaggauggccccuuuccaagauggauaucggcgugccucugcuggccauuggguguuacucucagguuaaucccaucacccucacggcggcccuguuccuucugguggcucauuacgccaucauuggaccuggccuccaggcuaaagccacaagagaagcucaaaagcgggccgcggccggcaucaugaagaacccgaccgucgacgggauuacagugaucgaucuggaccccauuccuuaugaucccaaauuugagaagcagcugggacaggucaugcuccuugugcugugcguuacccaagugcugaugaugcgcaccacaugggcucucugugaagcccugacgcuugcuaccggcccugucagcacacugugggaggggaaucccggaagauucuggaacaccacaaucgccguguccauggccaauaucuuucggggcucuuaccucgcgggggcuggacugcuguucagcauuaugaaaaacaccacguccgcccgcagaggcacaggcaacaucggggagacccucggagaaaaguggaaaagccggcuuaaugcucugggcaagucugaguuucagauuuauaaaaaguccgggauccaggaaguugaccgcacccuggccaaggagggaauuaaaagaggcgaaacagaucaccaugccgugagccgggggucugcuaagcucagaugguucgucgagcgcaaccuggugaccccggagggaaaagugguugaccuuggcugcggcagaggcgggugguccuacuauuguggagggcugaagaaugucagagaagugaaagggcucacaaagggcgggccuggacacgaggaacccauccccaugagcacguacggcuggaaccuggugcgccugcagucuggcgucgauguuuucuuuaucccucccgagcggugcgacacccuccuuugugacauuggggagagcuccccuucuccgacaguggaagccggaagaacccugcgcgugcugaaucucgucgagaacuggcugagcaauaacacacaauucugcgugaagguucuuaaucccuauaugccuuccgugaucgagaagauggaggcgcugcagcggaagcauggcggggcccucgucagaaacccccugagccgcaauuccacccacgaaauguacugggugucuaacgcuagcggaaauauuguuuccucugugaacaugaucagccggaugcugauuaauagauuuacgaugcgccacaaaaaggccaccuacgagccugaugucgaccucggcuccgggacacggaacaucggaaucgagucugaaacccccaaccuugauauuaucggcaaaagaauugagaagaucaagcaggaacaugagacaagcuggcacuaugaccaggaucauccguacaaaaccugggcuuaucacggcuccuacgaaacaaagcaaaccgggagcgccucuuccauggugaauggagugguccgccugcugacgaaaccuugggacguugugcccauggugacacagauggcgaugaccgauaccacaccuuucggccagcagagagucuuuaaggagaaaguggacacgcggacccaagagcccaaggaagggacaaagaaacucaugcgcauuaccgccgaguggcuguggaaggaacuuggcaaaaagaaaacaccuagaauguguacccgggaggaguucacaaagaaaguuagaagcaacgcugcccugggcgcuaucuuuaccgaugagaauaaguggaagucugcccgggaggcugugggggacggacgcuucugggaacucgucgauaaagagagaaaccugcaccuggaaggcaagugcgagacguguguguauaauaugaugggcaaacgggagaagaaacucggggaauuuggaaaggccaagggcucccgcgcgauuugguacauguggcugggggccagauuccuugaguuugaagcucugggauuccucaacgaggaccauugguuuagccgggaaaauucucuguccggcguugagggggagggccuucacaaacugggauauauccuccgcgaagugagcaagaaagagggcggggccauguacgcugacgauaccgccggaugggacacaagaaucaccauugaagaucugaagaacgaggaaaugaucacaaaucauauggagggcgagcacaaaaagcuggccgaagcgauuuuccggcucaccuaccagaacaaggucgugcgcguucagagacccacgccgcgggggacagugauggacaucauuucccgcagagaucaacggggaagcggccaggucgggaccuauggccugaauacauucaccaacauggaggcucagcuuauccgccagauggaaggagagggcguguuuaaaucuauccaacaucugacggccgccgaagagauugcuguccagaauuggcucgugagaguugggcgggagagacugagccgcauggccaucuccggagacgauugcguggucaagccucuugacgaucgguucgcuagagcccugaccgcgcucaacgacaugggcaaagugcgcaaggauauucagcagugggaacccucucggggguggaaugacuggacacaagugcccuuuugcagccaccacuuccaugagcugaucaugaaagauggacgcauucugguugugccuuguagaaaccaggacgaacucaucggccgggccagaaucucccagggggcuggcuggucucugcgcgagaccgccugccuuggaaagagcuacgcucagauguggucccugauguauuuucaccggagagaccuccgccuggccgcgaacgccauuuguucugcugucccgagccauugggugcccacaucccggaccacauggagcauccacgccucucacgaguggaugaccacggaagauaugcuuacaguuuggaauagaguguggauucaagagaacccuuggauggaagacaagacccccgucgaguccugggaagagaucccuuaccugggcaaacgggaggaucaguggugcgggagccucauuggacugaccucuagagcuacaugggccaagaauauccagaccgcuauuaaccaggugcgcucccugaucggcaaugaagaguauacagacuacaugcccagcaugaaacgguucagacgcgaagaggaagaggccgggguccucugguga

SEQ ID NO: 20300 - RNA, 9876 nt, Artificial Sequence
  derived and/or modified CDS sequence (opt5) from DENV-2__KF479233__SS-prME
accgccggcgucaucauuaugcugauccccaccgcuauggccuuccaccucacgaccagaaacggggaaccucauaugauugucagccggcaggaaaagggaaaaucccugcuuuuuaagacagaggacggcguuaauaugugcacccugauggcgauggaucucggggaacugugugaggacaccaucaccuacaacugcccccuucugagacaaaaugaacccgaggauauugacuguuggugcaacucuacaagcaccugggugacguauggaaccuguacagcuaccggcgagcacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagaguucugaucuucauucuucugacagcgguggccccuuccaugacgaugcggugcaucggaauuucuaaucgcgauuuugucgaaggcgugagcgggggauccuggguugacaucgugcucgagcacggcagcugugucaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugugugcaaacacagcaugguggauagaggauggggcaauggcugugggcuguucggaaagggcgggaucgugaccugcgccauguuuacaugcaagaaaaacauggagggaaagauuguucagccugaaaaucucgaguauacgaucguggugacaccccauucuggcgaagagaacgcugucgggaaugacacaggaaaacacggcaaggagauuaaagugaccccucaguccagcaucacagaagccgagcugaccggcuacgggacgguuaccauggaauguucuccccggacaggacuugauuucaacgagauggugcugcuccaaauggaaaauaaggcuuggcugguccaucgccagugguuucuugaccugccgcucccuuggcugcccggcgccgauacccagggguccaacuggauccagaaagagacacuggugaccuucaagaacccucacgccaagaaacaagacguugugguccucggaagccaggagggcgcuaugcacacggcgcugacaggggccaccgaaauucagauguccucuggcaaucuucuguuuacaggacaucucaagugcagacugcggauggacaaacuucaacugaagggcaugagcuauuccauguguaccgggaaauucaagguggucaaggagaucgcugaaacccagcacggaacaauugugguuagagugcaguacgagggcgaugggagccccugcaaaauccccuucgagauuauggaccucgaaaagcgccauguccugggacggcugaucacggugaacccuaucguuaccgagaaagauucuccggugaauauugaagccgagcccccuuuuggcgacuccuacaucauuaucggggucgaacccggccagcucaagcugagcugguucaaaaagggaucuagcauuggccaaauguuugagacaaccaugagaggggccaagcgcauggcuauccuuggagauacagccugggacuucggcucccucggagggguguuuaccucuauuggcaaagcgcuccaccagguguucggggcuaucuauggcgccgccuuuagcggaguuuccuggacgaugaagauccugauuggcgucgugaucacauggauugggaugaacagccggucuaccucccugagcgugucucuuguccucgugggaguugugacccuguaccugggcgucauggugcaggcugauuccggguguguugugagcuggaaaaauaaggagcucaaaugcggauccggcaucuucauuacagacaacguccauaccuggacagaacaguauaaguuucaaccugagucucccagcaagcuggccuccgcuauccagaaagcccacgaagaggggaucuguggcauuagaucugugacgcgccuugaaaaucugauguggaagcagaucaccccggagcucaaccacauucugagcgagaaugaaguuaaacugacaaucaugaccggagauauuaagggcaucaugcaggcggggaaacggucccuuagaccucaacccacagagcucaaguacagcuggaaaaccuggggaaaggccaagaugcugucuacggaaccucagaaccagaccuuccugaucgacggccccgagacagcugaaugcccuaauaccaaccgcgccuggaacucccucgagguggaggauuauggguuuggagucuucacaaccaacauuuggcugaaacuuaaggaacggcaggacguguuuugugacagcaaacugaugucugcugccaucaaggauaauagagcggugcaugccgacaugggcuacuggauugaguccgcucucaacgauacauggaaaaucgaaaaggccagcuucauugaggucaagucuugccacuggcccaaaagccauacccugugguccaacggcguucuggagagcgaaaugaucaucccgaagaauuucgcugggccugugucucaacacaacuaucgccccggauaccacacgcagacagccggccccuggcaucuugggaaacucgagauggacuuugauuucugugaaggaaccaccguggucgugacagaggacugcggcaaucgggggccuucccugagaaccacgacagccagcggaaagcugauuaccgaauggugcugucgguccugcacacucccgccccugcgcuacaaaggcgaggauggcuguugguaugggauggagaucagaccucuuaaggaaaaggaggaaaaccugguuaauucucucgugaccgcuggacacggccagauugacaacuuuagccuggggguccugggaauggcgcuuuuccucgaggaaaugcugcggacaagagugggcaccaaacaugccguucugcucguggcugucuccuuuaugacgcugaucaccgggaauaugucuuuccgcgaucuuggacgggugaugguuauggugggcgccgccaugacagacgauauuggcaugggggucaccuaccuggcucuccuggccgcguuuaaggugagacccacauucgcugccggacugcuucugcgcaaacucaccagcaaggagcugaugaugacgacaaucggcauugugcuccugucccaaucuaccaucccugagacaauccuugaacugaccgacgcccucgcucuggggaugaugauucugaaaaucgucagaaacauggagaaguaucagcuugccguuaccauuauggcgauccugugcgugcccaaugcugugauucuccagaacgccuggaaggucagcuguacaauccuggccgugguuuccgugagcccucuccugcuuacgucuucccagcaaaaagcugauuggaucccccuggcccucaccauuaagggacugaauccgacagcuaucuuucugaccacacuuagccggaccaacaaaaagcgcucuuggccucugaaugaagccauuauggcggucggcaugguguccauccucgccagcucucugcucaaaaacgacauucccaugacggggccucugguugcuggaggccuucugacagugugcuacguccugaccggcagauccgccgaccucgagcuggaacgggcugccgaugugcgcugggaggaccaggccgagaucagcggguccagccccauccuuucuauuaccaucagcgaagauggauccaugucuauuaagaaugaggaagaggagcagacacugaccauccucauuagaacaggccugcucgucaucagcgggcuguucccgguguccauuccuaucacggcugcggccugguaucuuugggaaguuaaaaagcagcgggcuggagugcugugggacguccccucuccuccgcccgugggcaaggccgagcuggaagauggggccuaccgcaucaaacaaaaggggauucugggcuauagccagaucggcgcugggguuuacaaagagggaaccuuucacacaauguggcaugugaccagaggcgccguccugaugcacaaggggaaacggauugaaccuuccugggcggacgugcgcaaggaucuuaucucuuacggaggcggguggaagcuggagggagaguggaaagaaggcgaggaagugcagguucucgcucuggagccgggcaagaaccccagagccguccagacaaaaccuggacucuucaagaccaacacgggaaccauuggcgccgugagccuggacuuuucccccgggacaagcggaucuccuaucguggauaaaaagggcaaggucguggggcuuuauggaaauggcguugugacccgguccggcacauacgucagcgcuaucgcccaaaccgaaaaaucuauugaggacaaccccgagaucgaagaugacauuuucagaaagaaacgccugacaaucauggaucugcacccuggggcgggaaagacgaaacgguaucucccggcuauugugagagaggccaucaagcgcggccugcggacccuuauccuggcccccacaagaguuguggcugccgaaauggaggaagcucuccgcgggcugccuauucgguaccagacccccgccaucagagcggagcauaccggacgcgagauugucgaccucaugugucacgccacauucacgaugcggcugcuuuccccugugagaguucccaauuauaaccugaucauuauggacgaagcucauuuuaccgauccggccagcaucgcugcccggggcuacauuuccacacgcguggagaugggggaagccgcuggcaucuucaugaccgcgacaccucccggaucuagagaccccuuuccucagagcaaugcccccaucauggaugaggagcgggaaauuccugagcgcuccuggaacagcggccacgaaugggucaccgacuucaaggggaaaacggugugguuugugccgucuaucaaggcuggaaaugauauugccgccugccugcgcaaaaauggcaagaaagucauccaacucucccggaagacauucgacagcgaguauauuaagaccagaaccaaugauugggacuuuguugugacaaccgauaucucugaaaugggggcuaacuucaaagccgagcgcgugaucgacccccggagauguaugaagccugucauucugacagauggagaggaacgcgugauccuugcgggccccaugccuguuacccauagcuccgcugcccagcggagagggcgcauuggccggaaucccaaaaacgagaaugaccaguacaucuacaugggagaaccgcuggagaacgacgaagauugcgcccacuggaaggaggcuaaaaugcuccuggacaauauuaacacgccugagggcaucauccccucuauguuugaaccugagagagaaaagguggaugccauugacggggaguaucgccugagaggagaagcgcggaaaacauucgucgagcucaugcgcagaggcgaucuucccguguggcuggccuaccggguugcugccgaggggaucaacuaugcugaccgcagaugguguuuugauggaauuaagaauaaccagauccuggaagagaauguggaagucgagauuuggaccaaggagggcgagaaaaagaaacucaagccucgguggcuggacgccagaaucuacagcgauccccuugcucugaaagaguucaaggaguucgccgcggggcgcaagucccucacaaugaaccugauuaccgagaugggccggcugccgacguuuaugacccaaaaagccagaaaugcucucgacaaccuugccgugcugcacacagcugaagccggaggccgcgccuauaaucaugcucugucugagcucccugagacccuggaaacacuucugcuccugacccugcucgcgacagucaccgggggaaucuuccuuuuucugaugagcggcaaggggaucggaaaaaugacgcugggcaugugcugcauuaucacagccuccauucuccugugguacgcucagauccagccccacuggauugccgccagcaucauccuugaguucuuucugauugugcuccugauccccgaaccugagaagcagcggaccccgcaagauaaccagcugaccuauguugugauugcuauccucacaguggucgccgcgaccauggccaaugaaaugggcuuccuugagaaaacaaagaaggacuuugggcugggaucuauuguuacgcagcagcccgaguccaacauccuggauaucgaccucagaccugcuagcgccuggacccuguacgcuguggccacaaccuucauuacacccaugcuucggcauuccaucgaaaauucuagcgugaacgucucccugaccgcgauugccaaucaagcuacggugcucaugggccuggggaaaggauggccucugucuaagauggacaucggcguuccccuccuugccauuggguguuacagccaggugaacccuaucacccugacagcugcccugcuccugcuugucgcucacuaugccauuaucggaccgggccugcaggcgaaagccacccgcgaggcucagaagagagccgcugccggcaucaugaaaaaucccacaguggaugggauuaccgucaucgaccucgauccuauucccuacgacccuaaguuugaaaagcaacugggacaggugaugcugcucguucuuugcgugacgcagguccugaugaugcggacaaccugggcccugugugaggcgcucacacuggcuaccggccccaucuccacccuuugggaagggaacccgggacgcuucuggaauacaacgauugccgugagcauggcuaacaucuuuagaggcucuuaucuggccggggccggacuccuguucuccaucaugaaaaacaccgcuaauacacggcgcggcaccggcaacacaggggagacccugggagagaaguggaaaaauagacucaacagccuuggcaagucugaauuucaaauuuacaaacgguccgggauccaggagguugaucgcacgcuggccaaggaaggaauuaaaagaggcgagacagaccaccaugcggugagccgggggucugccaagcugagaugguucgucgagcgcaaucucgugaccccugaaggaaaggugauggaucugggcugcggcagagggggauggagcuauuacuguggcgggcuuaaaaacguucgggaggucaagggacugaccaaaggcgggcccggacacgaagaacccaucccuauguccacauauggcuggaaucucgugcgccugcagucuggcguggacgucuucuuuacacccccugaaaagugcgauacacugcucugugacauuggggagagcuccccgaaccccacgguugaggcuggacggacccuuagagugcugaaucugguggaaaacuggcucaauaacaauacacaguucugcaucaaaguccugaacccuuacaugcccagcgugaucgagaagauggaaacccuucaacgcaaguacggcggggcccugguucggaauccucucuccagaaacucuacacaugagauguauugggugagcaacgcuuccggaaauauugucucuagcgugaacaugaucucccgcaugcugauuaaucgguuuaccaugagacacaaaaaggccacguacgaacccgauguugaccugggcucugggacccgcaacaucggaauugagagcgagaucccgaaucucgauaucauuggcaaacggaucgaaaagauuaaacaggagcaugaaacauccuggcacuaugaccaggaccacccuuacaagaccugggcguaucauggcagcuacgagacaaagcagaccgggucugccuccagcauggugaacggagucgugagacuucugacaaaacccugggaugugaucccuauggucacccaaauggcuaugacggacacaacccccuucggccagcagcgcguuuuuaaggaaaaaguggauaccagaacacaggagccuaaggaggggacgaaaaagcugaugaagauuaccgccgaauggcucuggaaagagcugggaaagaaaaagacaccccggauguguacccgcgaagaguucacaagaaaagugcggucuaaugcugcccuuggcgcuaucuuuaccgacgagaacaaguggaaauccgccagagaagcggucgaggauagccgguucugggaacugguggacaaggagcgcaaucuccaccuggaagggaagugcgagacauguguuuauaacaugaugggaaaaagagagaagaaaauuggcgaauuuggcaaggccaaagggucucgggcuaucugguacauguggcugggagcccgcuuccucgaguuugaagcucugggcuuccuuaaugaggaucauugguuuuccagagaaaacagccuguccgggguggagggagagggccuccacaagcugggguacauccuucgggaagucagcaagaaagagggcggagccauguaugccgacgauaccgcgggcugggacacgcgcauuacccuggaagaucucaagaaugaggaaauggugacaaaccacauggagggggagcauaaaaagcuggcugaagccaucuucaaacugaccuaccaaaauaagguugugagaguccagcggccgacaccucgcggaaccgugauggacauuaucucuagacgggaccagcgcggcagcgggcaaguuggaacguauggccucaacacauucaccaacaugggggcccagcugauuagacagauggagggcgaaggaguguuuaaguccauccagcaccuuacaaccacggaggaggucgcugugcaagauuggcuggcccgggucggccgcgaaagacucucucggauggcuaucagcggggacgauugcgugguuaaaccccuggacgauagauucgccuccgcgcuuaccgcccugaaugacaugggaaaggugcgcaaagauauucagcagugggagcccucucggggcuggaacgacuggacacaggucccuuuuugcagccaucacuuccaugaacucaucaugaaggaugggagagugcuggugguuccgugucgcaaucaagacgagcugauuggacgggcuagaaucucccagggcgccggguggucucuccgcgaaaccgcuugccugggcaaaagcuacgcccagauguggucccuuauguauuuucaccggagagaucugcgccucgcggccaacgcuauuuguagcgccgugcccucucacugggucccuacaucccggaccacauggagcauccaugcuagacacgaguggaugaccacggaggacaugcugacaguguggaaucgcguuuggauccaggaaaaccccuggauggaggauaagaccccuguggaaucuugggaggaaauucccuaccuuggaaagcgggaggaccaauggugcggcucccugaucgggcucaccagcagagccacaugggcuaaaaauauucagaccgccaucaaccagguccggucccugauuggaucugaggaauauacagacuacaugccuagcaugaagagauuccgccgggaggaagaggaagcgggcgugcugugguga

SEQ ID NO: 20301 - RNA, 9876 nt, Artificial Sequence
  derived and/or modified CDS sequence (opt5) from DENV-2__KX372564__SS-prME
acagccggaaucauuaucaugaugauucccacagugauggcuuuccaccugacgaccagaaacggggagccucauaugaucgucagccggcaagaaaaggggaaaagccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucacagagaacgaagugaaacugaccaucaugacaggagacaucaagggcauuaugcaggccgggaaacggagccugagaccucagcccaccgagcuuaaguacuccuggaaagcguggggaaaggccaagguucucagcacggaacugcacaaucauaccuuccugaucgauggcccugagacagcugaaugccccaacaccaaucgcgccuggaacucucucgagguggaggacuauggguuuggagucuucacaaccaauauuuggcugaaacuuaaggaacggcaagauguguccugugacagcaaacugaugucugcugccaucaaggacaacagagcggugcacgccgauaugggcuacuggauugaguccgcucucaacgacacauggaaaaucgaaaaggccagcuuuaucgaggucaagucuugccacuggccuaaaagccauacccugugguccaauggcguucuggagagcgaaaugauuauccccaagaacuucgcugggccggugucucagcacaauuaucgcccuggauaccauacgcagacagccggccccuggcaccuugggcggcucgagauggauuucgacuuuugugaaggaaccaccguggucgugacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucugguuaacucucucgugaccgcuggacauggccagauugauaauuucagccuggggguccugggaauggcgcuuuuucucgaggaaaugcugcgcacacgggugggcaccaagcacgccauccugcucguugcuguguccuucgucacgcugauuaccgggaacaugucuuuuagagaccuuggacgcgugaugguuauggugggcgccacaaugaccgaugacaucggcaugggggucacauaccuggcccuccuggcugccuucaaggugagaccuaccuuugcggcuggacugcuucugcggaaacucacgagcaaggagcugaugaugacaaccaucggcauugugcuccugucccaaucuacaauccccgagaccauucuugaacugaccgaugcccucgcccuggggaugaugguccugaaaaucguucgcaauauggagaaguaucagcuugcugugacaauuauggccauccugugcgugccuaacgcggucauccuccagaaugcuuggaaagugagcuguacggcccuggccguuguguccgucagcccccuccugcuuaccucuucccaacagaagacagacuggauuccucuggcucucaccaucaagggacugaaccccacagccauuuuccugaccacgcuuagcagaacaucuaaaaagcgguccuggccgcugaaugaagcuaucauggccgugggcaugguuagcauucucgcgucuuccuuucugaaaaacgauaucccuaugaccgggccccucguggccggaggccugcuuaccgucugcuacgugcugacaggccgcagcgcugaccuggagcucgaaagagccgcugacauccggugggaggagcaggccgaaauuuccgggagcucuccuauccugagcauuaccaucuccgaggauggaucuaugagcauuaagaaugaagaggaggaacagacacuuacgauccugauucgcaccggccuccuggucaucuccggacucuuccccgugucuaucccgauuacagccgcugcgugguaucugugggagguuaaaaagcaaagagccggagugcuuugggacgucccuucucccccucccgugggccgggcugaacuggaggauggggccuaccgcaucaaacagaagggcauucugggcuauucccagaucggcgccgggguuuacaaggaaggaaccuuucacacaauguggcaugugaccagaggcgcuguccucaugcacaaagggaagcggauugagcccuccugggccgacgugaaaaaggaucugaucagcuacggaggcggguggaaacuugagggagaauggaaggagggcgaagaggugcagguucuggcgcucgaaccuggcaagaacccgagagcuguccaaacgaaacccgggcuguucaagaccaacacaggaaccaucggcgccgugucccucgacuuuagcccugggacaucuggaucccccauuguggauaaaaagggcaaagucguggggcuguauggaaauggcguugugacccgcagcggcacauacgucucugccaucgcucagacggagaaguccauugaggacaacccugaaaucgaggaugacauuuuccggaagaaaagacuuaccaucauggaucugcaucccggggccggaaagacaaaacgcuaucugccugcgaucgugcgggaagcuauuaagagaggccuccgcacccugauccuugccccgacccggguuguggccgcugagauggaagaggcccugagagggcuccccauucgcuaccagaccccugcuauccgggccgagcacacgggaagagaaauugucgaccugaugugucaugcgaccuucacaaugcggcuccugagccccauccgcgugccuaauuauaaccuuauuaucauggaugaggcccacuuuaccgaccccgcuuccaucgccgcuagaggcuacauuucuacacggguugaaaugggggaggccgccggcaucuucaugaccgcuacgccgccuggaagccgcgaccccuuuccccaguccaaugcgccuauuauggaugaggaaagagagauccccgaacggagcuggaacucuggccacgagugggugacagacuucaaagggaagaccgucugguuugugccuuccauuaaggccggaaaugauaucgcugccugccugcgcaagaacggcaagaaagugauccaacugagccgcaagaccuucgacucugaauauauuaaaacacggaccaaugauugggacuuugucguuacaaccgauaucagcgagaugggggccaacuucaaggcugagagagugauugacccgcgccgguguaugaagcccgugauccucacggauggagaagagagagucauucuggccggcccuaugcccgugacacauuccucugcggcucagcgccgggggagaguuggccgcaauccuaaaaacgaaaaugaccaguacaucuacaugggagagccccuugaaaacgaugaggacugcgcccacuggaaggaggccaaaaugcugcucgacaauaucaacaccccggaaggcauuaucccuagcauguuugagcccgaaagagagaagguggaugcuauugacggggaauaucggcugcgcggagaggccagaaaaacauucgucgaucugaugcggcgcggcgaccucccuguguggcuugcguacagaguugccgcugaggggaucaacuaugccgaucggagaugguguuuugacggagugaagaauaaccaaauucuggaagagaaugucgaaguggagaucuggaccaaagagggcgaacgcaagaagcugaaaccccgguggcucgaugcuagaauuuacuccgacccucuggcccuuaaggaguucaaagaguucgcugccgggcgcaagucucugacgcucaaccugaucaccgagaugggccggcugcccacauuuaugacccagaaagcgagaaaugcccucgauaaccuugcuguccugcauacagccgaagcuggaggccgggccuauaaucacgcccugagcgagcucccggagacccuggaaacacuucugcuccugacccugcucgcuacggugacagggggaaucuuccuuuuucugauguccggcaaggggauuggaaagaugacccugggcaugugcugcaucguuaccgcgagcauucuccugugguacgcccagauccagccucacuggauugcugccucuaucauccuugaguucuuucugauugugcuccugauccccgaacccgagaaacaacgcacaccucaggacaaccagcugaccuauguggucauugccauccucacaguuguggcugccacgauggcgaaugaaaugggcuuccuugagaagaccaaaaaggauuuugggcugggauccauuacaacccagcaaccggagagcaacauccuggacaucgaucucagacccgccuccgcuuggacacuguacgccguggcuaccacguucauuaccccuaugcuucggcauucuaucgaaaauagcuccgucaacgugucucugacagccauugcgaaucaggccaccguucucaugggccuggggaaaggauggccccugagcaagauggacaucggcgugccucuccuugcuauuggguguuacucccaggucaaccccaucacacugaccgccgcucugcuccugcuuguggcccacuaugcuauuaucggaccuggccugcaggccaaggcgacgcgcgaggcccagaaaagagcugccgcuggcaucaugaagaauccgacagucgacgggauuaccgugaucgaucucgaccccauuccuuacgaucccaaauuugaaaagcagcugggacagguuaugcugcucgugcuuugcgucacacaggugcugaugaugcggaccaccugggcccugugugaggcccucacacuggcgacgggcccuaucagcacccuuugggaagggaaccccggacgcuucuggaauacaaccauugcuguuucuauggccaacaucuuuagaggcuccuaucuggcuggggccggacuccuguucagcaucaugaaaaacacagccaauacccggcgcggcacgggcaacacaggggagacccugggagagaaguggaagaauagacucaacgcucuuggcaaaucugaauuucaaauuuacaagaaauccgggauccaggagguggaccggacccuggccaaggaaggaauuaaaagaggcgagacagaucaucacgcggucagccgcgggucugccaagcugcggugguucguggagagaaaucucgugaccccggaaggaaaaguugucgaccugggcugcggccgcgggggauggagcuauuacuguggcgggcuuaagaacgugaaggaggugaaaggacugacaaagggcgggccuggacaugaagaacccauccccauguccacguauggcuggaaucucguccggcugcagucuggcguugauguguucuuuaccccucccgaaaaaugcgacacacugcucugugauauuggggagagcuccccuaacccgaccguggaggcuggaagaacacuucgcguccugaaucugguggaaaacuggcucaauaacaauacccaauucugcaucaagguucugaaccccuacaugccuagcgugaucgagaaaauggaagcccuucagcggagauacggcggggcucugguccgcaauccccucucccggaacucuacgcacgagauguauugggugagcaacgccuccggaaauauuguuucuagcgugaacaugaucuccagaaugcugauuaaucgcuuuaccaugcggcacaagaaggcgacauacgaaccugacgucgaucugggcucugggaccagaaacaucggaauugagagcgaggugcccaaucucgacaucaucggcaaacgcauugaaaagaucaaacaggagcaugaaacauccuggcacuaugaucaggaccauccguacaagaccugggccuaucacggcagcuacgagacaaaacaaaccgggucugcuuccagcauggugaacggagucguuagacuucugacgaagccuugggacgugauucccauggugacacagauggccaugaccgauaccacaccuuucggccagcagcgggucuuuaaggaaaaaguggacacgcgcacccaagagcccaaggaggggaccaaaaagcugaugaaaaucaccgcugaauggcucuggaaggagcugggaaagaaaaagacaccuagaauguguacccgggaagaguucacaagaaaaguucggucuaaugccgcucuuggcgccauuuuuaccgaugagaacaaguggaaauccgcgcgcgaagccguggaggacagcggguucugggaacuggucgauaaggagagaaaucuccaccuggaaggaaaaugcgagacguguguguauaacaugaugggcaagcgggagaagaaacugggcgaauuugggaaggcuaaaggaucucgcgccaucugguacauguggcucggcgcuagauuccuggaguuugaagcccuuggguuccugaaugaggaccauugguuuucccgggaaaacagccucuccggaguugagggcgaggggcugcacaaacuuggcuacauucugcgcgaugugagcaaaaaggaaggaggcgccauguaugcggacgauaccgcugggugggacacaagaaucacccucgaggaucugaagaaugaagagauggucacaaaccauauggaaggagagcacaaaaagcuggccgaggccaucuuccggcucaccuaccagaauaaagugguucgcgugcagagacccacgccgcggggcacagucauggacauuaucucucgcagagaccagcgggggagcggacaaguggucaccuauggccugaacacauucaccaacauggaagcucagcuuauucgccagauggagggggaaggcguguuuaaguccauccaacaucugacggccaccgaggagauugcuguuaaaaauuggcucgugagagucggacgggaaagacugucucgcauggccaucagcggcgaugacugcguggugaagccuuucgaugaccgguuugcgaacgcccuuacagcucugaaugauauggggaagguuagaaaagacauccagcagugggagcccucccgcggauggaacgauuggacccaggugcccuucugcucucaccacuuucaugaacucauuaugaaggacggccggguccuggugguuccuuguagaaaucaagaugagcugaucgggcgcgcccggauuagccagggagcuggcuggucccucagagaaacagccugccuggggaaaucuuacgcgcagauguggagccuuauguauuuccaccgccgggaccugagacucgccgcuaacgccaucuguuccgcugugccgagccauuggguccccaccucucgcacaaccugguccauucacgccacgcacgaguggaugacaaccgaggauaugcugaccguguggaaucgggucuggauccaggaaaacccuuggauggaggacaagacacccguggaaagcugggaggaaaucccuuaccuuggcaaaagagaggaucaauggugcggaucucugauuggccucaccucccgggcuacaugggccaagaauauccagacggcgauuaaccagguuagaagccugaucgggaaugaggaauauaccgacuacaugcccuccaugaagcgcuuucggagagaggaagaggaagccggagugcugugguga

SEQ ID NO: 20302 - RNA, 9873 nt, Artificial Sequence
  derived and/or modified CDS sequence (opt5) from DENV-2__KX274130__SS-prME
agcgccgcuacccugcuccugcuugugcccacaaucauggccuuccaccugacgaccagaaauggcgaaccucacaugauugucgcgcggcacgaaaaggggaagucccucaucuucaagacagagaauggaguuaacaugugcacccugauggcuauggaccuuggcgaacugugugaggaaacagugaccuacaagugccccuaucucaagcagucugagcccgaggauauugacuguuggugcaauacaaccagcacgugggugaccuacgggacauguuccucuagcggagaacaucgcagagagaaacgguccgucgcccuggccccucacgugggcauggggcuggaaacccgcacagagaccuggaugucuagcgagggagcuuggaagcaugcccaaagaaucgaaaacuggauucuccggcaccccggcuauacgguuauggcugccgcgaucgccauggcuaucggcacaaauaacuuccagcgcgcccugauuuuugugcuucugaccgcugucgccccuuccaugacaaugagaugcguggggaucgcgaaucgggauuucguugagggagugagcggcgggucuugggucgacauugugcucgaacacggauccugugugaccaccauggccaagaacaaacccacacuggauuuugagcuuacgaagaccgaagcuaaacugccugccacacuccgcaaguacugcaucgaggcuaaacugaccaauacaaccacggagagcagauguccgacacagggcgaacccucucugccugaggaacaggacaagcgguucauuugccgccauucccucgucgauagaggguggggaaacggcuguggccuguuugggaagggaggcaucguuaccugcgccauguuuaccugcaaaaaguauauggaggggaaaauugugcaacccgaaaaucuugaguacacaguggccgucaccccucacagcggagaggaacauucugugggcaacgacacagggaagcacggacaggauguuaaaaucacgccccaguccagcaucaccgagacagcucuggaaggcuauggcuccauuucuauggaguguagcccgcggaccgggcucgacuuuaaugaaauggugcugcuucagauggaggauaaggcguggcugguccaccgccaaugguuccucgaccugccucugcccuggcucccuggauccgauacacagggcagcaacugggugcagaaagagacccugguuacguuuaagaauccccaugccaagaaacaggacguggucgugcuugggucucaagaaggagcuaugcacuccgcccugaccggcgccacagagauccagaugaccagcgggaaccuccuguucacaggccaucuuaagugcagacugcggauggacaaacucgaacugaagggaaugucuuacagcauguguaccggcaaauuuaaggucgugaaggagauugcugagacgcagcacgggacaaucguuauuagagugcaauacgaaggagagggcucccccugcaaaaucccuuucgaaaucauggaucuggagaagaaacauguccucgggcgccugauuaccgugaacccgaucauuacagaaaaggacaaacccaccaauaucgaggccgagccucccuucggagauucuuauauucuuaucggcguugaaccugggcagcugaagaugaacugguuuaagaaaggcagcuccaucggacagauguucgagaccacaaugcggggcgcgaagagaauggcuauucucggggacacggccugggauuuuggaagccugggcgggguguucaauucuaucggaaaagcccugcaccaggucuuuggcgcuguguacaacgccgcuuucuccggggugagcuggaccaugaagauucuuaucggcguuauuaucacauggauuggaaugaacucucgcuccaccagcauguccaucacacucgucauggugggccuggugacccuguaucucggggucgugguucaagccgacucuggauguguggucagcuggaaaacgaaggaacugaagugcggcuccgggaucuuugugacagauaacguucacguguggaccgagcaguacaaauuccagcccgaaucuccggcgaaacuugccgcugccauuaaaaaggcucaugaggagggagucuguggcauccggagcgugaccagacuggaaaauauuauguggaaacagaucacaccugagcucaaccacauucugaccgaaaaugacguuaaggugacaaucaugacgggggauaucaaaggcauucugcaacagggacgccgggcccuuagaccccagccuaccgagcucaaguauuccuggaaaagcuggggcaaaucuaagaucgucuccagcgaaacacauaaccagaccuuucugauugacgggcccgagacaaccgagugcccugauacgaaucgcgcguggaacucucuggaaguggaggacuacggauucggccucuuuuccaccaauaucuggcugcggcuuagagaaaaacaagacacacugugugauagcaagcucaugucugccgcugugaaagacgagcgcgccauucacgcugauaugggguauuggaucgagagcaagcugaacggauccuggaagaucgaaaaagccagcuuccuggaggucaagucuugcaccuggccccggucccacacacuuuggagcaauggcguucucgaauccgagaugauuaucccgaaaaaccugggcgggccugugucucagcauaacuacagacccggauacuauacccagacaaccggccccuggcaccuggggaagcucgaaauggacuuugauuacugugagggaacgacagugauugucaccgaggaaugcaauaaccggggcccuagccugcgcaccacaaccgccuccgggaaacuuaucacggaguggugcuguagaucuugcacaaugccgccccugcgguucaagggagaagacggcuguugguauggcauggagauuagaccucucaaggaaaaagaggagaaucuggugaacagccugguuaccgcugggcauggacagaucgauaauuucucccuuggcauccucgggauugcgcuguuucuggaagaggugaugaagucucgcaucggaauuaaacacacaaucggcaugaccauuaucacauuccuccugcuugucaccgggaacgugagcuaccgggaccugggaagaguuauucucauggugggcuccacgauggccgaugaaaugggcaugggggucaccuaucuggcucugcuugccacauuucgcaucagacccaccuucgcccuggcucucaugauccggaagcugacaagcaaagagcuccugauggccaccauuggaaucgugcuuauugcgcaaugcgacguuccuggcacgauccuggaaauuacagaugcuugugcccucgggcugaugcugcuuaagaugacccgcgagcuggagagauaccagcucgccgugacacugcucucucugaccugcauccccaaugcuaccaucauguggggagccuggaaggucacauguacgauucuuacccugguguccauggcgccucucuuucugacaaccagccggcagaaaacagacugggugcccgucgcucugucuaucuauggccuuaacccgaccgccauuuacuucacgacacuggccaaggcuaaaaagauccgcuccuggccucucaaugaagccguuauggcuguggggauggugagcauucuggccucuucccuccugagaaacgauauccccauggcgggaccucuugucgccggcggccugcugacccucugcuacgugcugaccgggcggagcgcugaccuugagcuggaaaaauccgccgacaucaaguggaaugaugacgcugagauuagcggaucuagccccaucauuaacguugccguguccgaggauggcucuaugagcaucaaagacgaagaggaagagaauacacucaccauucugauccgcacagggcuccuggccauuuccggaauguauccgauggcuaucccugcgacggccgcugucugguacuuuugggaagccagaaagcaacgggccggcgugcuuugggauguucccucuccuccgcccaccgggaaggcugagcuggaggaaggagccuaucgcaucaaacagagaggcauuuucggcuacagccagaucggggcgggaguguauaaggagggcacauuucauaccauguggcacgucacacggggguccgugcugauguguaaaggaaagagacucgaaccuucuugggcugacgucaaaaaggaucugauuagcuacggcgggggauggcgccuugacggcgaguggaccgaaggcgaggaggugcagguucuggcccucgaaccggggaagaacccccgggccgugcaaacgaaaccuggaauguucaagaccgauacaggcagaaucggggcugucucccuggacuuugcccccggaaccagcggcucuccuauuaucgauaaaaaggggaaagugaucggacucuauggcaauggcguugugaugaaguccggggcguacgucagcucuauugcucagacagagaagcgcgaagacgagauccccgaaauugaggaugacaucuuccggaaaagacgccugaccauuauggaccuucacccuggagccggcaagacaaaacgguaccugccggccaucgugagagaggcuaucaagcgcgggcugcggacgcucauucuggcccccaccagagugguugcugccgaaauggaggaagcgcuucggggacugccuauccgcuaucagacacccgccauuagagcugagcauaccggccgggagaucgucgaucucaugugccacgccaccuuuacaaugcgccugcucuccccugugagagugcccaacuacaaccugauuaucauggacgaagcucauuucacggauccggccagcauugccgcucggggguauaucgcgaccagagucgagaugggcgaagccgcuggaaucuucaugacagccaccccucccggcuccaaagaccccuuuccucagucuaaugcccccauuauggaugaggaacgcgagaucccugagcggagcuggaacuccgggcacgaauggauuacagacuucgagggaaagaccgugugguuuguuccgagcaucagagcuggcaaugauauugccacgugucuucgcaagaacgggaaaaaggugauccaacugucucggaaaacauucgacaccgaauacaucaagaccagaaauaacgauugggacuuugucgugacaaccgauauuuccgagaugggagcgaauuucaaagcugaacgcguuaucgacccccggagaugcaugaagccugugauucugacagacggcgaggagcgcgucauccucgccgggcccaugccugugacccccagcucugccgcucagagacggggccgcauuggaagaaacccgaagaaugaaaacgaucaguauaucuacaugggcgagccucuggaaaaugacgaggauugcgcccauuggaaagaagcgaagaugcuucuggacaacaucaauacgcccgaggggauuaucccugccauguuuggacccgagcgggagaagaccgaugcuauugacggcgaguaucgccucagaggggaaagccggaagaccuucguugagcugaugagacgcggagaucugccuguguggcucgccuacaaagucgcuuccgagggcuacucuuaugccgaccggagaugguguuuugaaggggugaagaacaaucagauccuugaggaaaaccuggagguggaaauuuggacaaaagagggcgagcgcaagaagcugcggcccaaauggcucgaugcuagaaccuacagcgacccgcaagcccugaaggauuucaaagaauuugcggccggacggaaguccacgacccuuaaccugaucgcugagcucggccgccugccuacauauaugacccagaaaacaagagacgcccuggauaaucucgcuguccuucacaccgccgaagaaggcgggcgggccuaccagcacgcuauuucugaacugcccgagacacuggagacccuccugcuucugugccuccuggcgacgguuagcggagggguguuccuguuccucauguccgggaagggcaucggcaagaugagcauggggcuuggauguaucauuacagccucuggccugcugugguaugcucaaauccagccccauuggauugccgccuccaucauucucgaauuuuuccugaucgugcuucugaucccugagccggaaaaacagcgcacaccccaggacaaccaacucaccuacgucgugauugcuauccugacacugguugccgcgaccauggccaaugagaugggguaucucgaaaagacaaagaaggaccuuggauuuggcaacccuuacguggcuagccacgaggccgcuauucuggauaucgaccugcaucccgccuccgcguggacgcucuacgccgucgcuaccacacugauuaccccuaugcuuagacacucuaucgagaauagcuccacaaacgugucucugaccgccaucgcuaaucaggccacgguucucauggggcugggaaaaggcuggccccugagccggauggaucucggcgugccucuucuggcucuggggugcuauucccaggucaacccgcucacccugacagccagccuucugcuccugauuggacacuacgcgaucauuggccccgggcugcaggccaaggcuacccgcgaagcccaaaagagaacagcugccggaaucaugaaaaauccuaccguggacggcauuacggucaucgauauugagcccaucccuuaugaccccaaguucgaaaaacagcucggacaggugaugcuucugguucuguguguggcccaggugcucaugaugcggacaaccugggcgaugugcgaggcucugacaaucgccaccggaccgauuucuacccuuugggagggcaacccuggcaaguuuuggaauacaacgaucgcugucuccauggccaacauuuuccgcgggagcuaccuggccggagcuggccuccuguuuucuaucaugaaaaauaccguuacagggagacggggaaccggcguggccggggaaacacugggagagaaguggaagauuaaacucaacggccuuggcagaaccgauuuccaaacguauaagcgcuccgggaucaucgaaguggaccggacacuggcgaaagagggaauuaagagaggcgaaaccaaucaucacgccgucagccgcgggucugcuaaacugcggugguuuguggagagaaaccucguuaagcccgagggaaaagugaucgaucugggcugugggcgcggaggcuggagcuacuauugcggcgggcuuaagaaugucaccgaagugaagggacugacaaaaggcgggcccggacaugaggaaccuauucccauguccaccuacggcuggaaccucguccggcugcagucugggguggacguuuucuuuacaccuccggagaagugugauacgcugcucugcgacaucggagaaagcucccccaacccuaccauugaggccggcagaacacuucgcgugcugaauauggucgagaacuggcugggcaauaaccaguucuguaucaaagugcucaaucccuacaugccuagcguuaucgaaaagauggagaaccugcagcggaaauuugggggaacccuugugagaaauccccugucccgcaacucuacacacgaaauguauugggucagcaaugcuuccggcaacauugugucuagcgugaauaugaucucccggaugcucauuaacagauucaccaugaagcauaagaaaccgacguacgagcaagauguugaccuggggucuggaacccgcaaugucggcaucgaaacagagaagccuaaccuggagauuaucgggaaaagaaucgaaaagauuaaagacgagcacaagcagaccuggcacuaugaucucgaccaucccuacaagacaugggccuaucacggaagcuacgaaaccaaacagacaggcuccgcgagcucuaugaucaauggcguggugaaacuucugaccaaaccuugggaugucauucccaugguuacgcaaauggccaugacagacaccaccccuuucgggcagcagcggguguuuaaggagaaaguggauacacgcacgcccgagccgaaggaaggaaccaagaaacugaugaagcucacagcuaaauggcugugggccgagcuuggcagacauaaggucccucggaugugcaccagagacgaguucacaaacaaagugcgguccaacgcugccaugggggcuguuuuuaccgaggaaaaucgcuggagcucugccaaggaggcgguggaggaugaagccuucugggaccuggucgauagagagcggaaacuccaucugcagggaaagugcgaaacauguguguauaacaugaugggcaagcgcgagaaaaagcugggggaauuuggcagagcuaaaggaucccgggccaucugguacauguggcucggcgcucgcuuccuggaguuugaggcccuuggguuccugaaugaagaccacugguuuagcagagagaacucucucuccggaguugaaggcgaggggcugcauaaacuuggauacauucugcgggaaaucggcgccaaagaugggggcaugauguaugcggacgacaccgcuggaugggauacgcgcgugaccgaggaggaccucaagaaugaagagaugauuagcgaacaaaugaagggcgagcacagaacacuggccgaggccaucuucaaacugaccuaccagaacaaggucgugcgggugcagcgccccacacccaaagggaccgucauggauaucauuuccagacgggaccagcgcggaagcggccaaguugggacguauggacucaauacauuuaccaacauggaagcucagcugaucagacagauggagggcgaagggcuuuuccgggauauuucuaagcugacaauccaggaggaaaccgccauucucacguggcugaaagagaagggcagagaccgccuuagccggauggcuaucuccggagaugacugcguggugaagccugucgaugacagauuugcccaugcgcugaccgcccucaaugauaugggcaaagugcgcaaggacauccaacagugggaggcuucuaaaggguggaacgauuggacacagguuccguucuguagccaccauuuccacgaaauuaucaugaaggacggacggaaacuggugguccccugcagaaaucaagacgagcugauuggccgcgcccggaucucccagggggcuggaugggcccucaaggaaaccgcgugucugggcaaggccuacgcucagauguggucucuuauguauuuucacagacgcgaucugcggcucgccgcuaacgccauuugcagcgcugugccuucccauuggguucccacaucuagaaccacauggagcauccacgcccaucaccaguggaugaccacggaggacaugcuggauguguggaaucgcgucuggauccuugaaaacccuuggauggacgauaaaacaugugugaaguccugggaggagguucccuaccuggggaaacgggaagaccaauggugcggcagccucauuggacugaccucuagagcgaccugggccaagaauaucaaaguggcuauugagcagguccggucccugaucggcaaggaagaguauacagauuacaugccuagcaugaagagauucaaacaggaacagucuaccgagggggcccucugguga

SEQ ID NO: 20303 - RNA, 9876 nt, Artificial Sequence
  derived and/or modified CDS sequence (opt5) from DENV-2__GU289914__SS-prME
uccgccggcaugaucauuaugcugauccccaccgugauggcuuuccaccugacaacgagaaacggggagccucauaugauugucucccggcaggaaaagggaaaaucucugcuuuuuaagaccgaggacggcguuaauaugugcacacugauggccauggaucucggggaacugugugaggacaccaucacauacaacugcccgcuucugagacaaaaugaacccgaggauauugacuguuggugcaacagcaccuccacaugggugaccuauggaacguguaccacaaccggcgagcacagacgggaaaaacgcucuguggcgcucgucccucauguggggaugggacuggagacaagaaccgaaacguggaugagcuccgagggcgcuuggaagcacgcccagcggaucgagacauggauccugcgccaucccggcuucaccauuauggccgcuauccucgccuacacaauugggaccacccacuuucagagagcucugaucuucauucuucugacagccguugcgccuucuaugacgaugcggugcaucggaauuagcaaucgcgauuuuguggaaggcgucuccgggggaagcuggguggacaucguucucgagcacggcucuugugugaccacaauggccaaaaacaagcccacccuggauuucgaacuuaucaagacagaggcuaaacagccugccacccugagaaaguauugcauugaagcuaaacucacgaauacaaccaccgagucccgguguccgacacaaggggagcccagccugaacgaagaacaagacaagcgcuuugucugcaaacauucuaugguggauagaggauggggcaauggcugugggcuguucggaaagggcgggaucgugaccugcgccauguuuacaugcaagaaaaacauggaaggaaaggucguucagccugagaaucucgaauacacgauuguggugacaccccacuccggcgaggagcaugcggucgggaacgacacaggaaaacacggcaaggaaaucaaagugaccccucagagcucuauuacagaggccgaacugaccggcuaugggacgguuaccauggaguguagcccccggacaggacuugauuucaaugaaauggugcugcuccaaauggagaacaaggcuuggcugguccaccgccagugguuucuugaccugccgcucccuuggcugcccggcgccgauacccaggggagcaauuggauccagaaagagacacuggugaccuucaagaacccucaugcuaagaaacaagacguugugguccucggaucccaggaaggcgccaugcacacggcccugacaggggcuaccgagauccagaugucuagcggcaaccuucuguuuacaggacaucucaagugcagacugcggauggacaaacuucaacugaagggcauguccuacagcauguguaccgggaaauucaagguggucaaggaaauugcggagacccagcacggaacaaucgugauuagaguucaguaugagggcgaugggucucccugcaaaauccccuucgaaauuauggaccucgagaagcgccaugugcugggacggcugaucacggucaauccuaucgugaccgaaaaagauuccccgguuaacauugaggccgaacccccuuuuggcgacagcuacaucauuaucgggguggaucccggccagcucaagcugaauugguucaaaaagggaucuagcauuggccaaauguuugagacaaccaugagaggggcuaagcgcauggccauccuuggagacacagccugggauuucggcucccucgggggagucuuuaccucuauuggcaaagcucuccaccagguguucggggccaucuacggcgcggcuuuuagcggaguguccuggacgaugaagauccugauuggcguuaucauuacauggaucgggaugaacagccggucuaccucccugagcgucucucuugugcucgugggaauugucacccuguaucugggcgugaugguucaggccgacuccggguguguggucagcuggaaaaauaaggagcucaaaugcggauccggcaucuucaucacagauaacgugcacaccuggacagaacaguacaaguuucaaccugagucucccagcaagcuggccuccgcuauucagaaagcccaggaagaggggaucuguggcauuagaucuguuacgcgccuugaaaaucugauguggaagcagaucaccccggagcucaaccauauucuggcugagaaugaagugaaacugacaaucaugaccggagacaucaagggcauuaugcaagccgggaaacggagccuuagaccucagcccacagagcucaaguauuccuggaaaaccuggggaaaggcgaagaugcugagcacggaaucucacaaccagaccuuccugaucgauggcccugagacagccgaaugccccaauaccaaccgcgcuuggaacucccucgaggucgaggacuacggguuuggaguguucacaaccaacauuuggcugaaacuuaaggaaaaacaggacgccuuuugugauagcaagcugaugucugcugccaucaaagacaaucgggcgguucaugccgauaugggcuauuggauugaguccgcucucaacgacacauggaagaucgaaaaggccagcuucaucgaggugaaaaacugccacuggccuaagucucacacccuguggagcaauggcguccuggaguccgaaaugauuauccccaaaaaccuugcugggccggugagccaacauaauuacagaccuggauaucacacgcagauugccggccccuggcaucucgggaagcuggagauggauuucgacuuuugugauggaacaaccguggucguuaccgaagacugcggcaaccgcgggcccucucugcggacaaccacggccuccggaaaacucaucacagaguggugcuguagaagcugcacccugccuccgcuucgguaccgcggcgaagauggcuguugguacgggauggagauuagaccccugaaggagaaggaagagaaucucgugaacucccuggugacagcuggacacggccaggucgacaauuucucucugggggugcuuggaauggcgcucuuucuggaagagaugcugcggaccagaguuggcacaaaacaugccauccuccugguggcugucagcuucgugacccuuauuacggggaacauguccuuucgcgaucugggacggguuguggucauggugggcgccaccaugacagacgauaucggcauggggguuaccuaucucgcccugcuggcugccuucaaggugagaccuacauuugcggcuggacuucugcuccgcaaacugaccucuaaggaacucaugaugacgacaaucggcauuguccugcuuagccaauccaccauccccgagacaauucuggagcucaccgacgcccuggcccuggggaugauggugcuuaaaauggugagaaauauggaaaaguaccagcuggcugucaccaucauggccauucucugcguuccuaacgcggugauccugcagaaugcuuggaaggugucuuguacaauccucgccgucgugagcguuagcccccugcuucugacgagcucucagcagaagaccgacuggauuccucucgcccugacaaucaagggacugaaccccaccgcuauuuuccuuacaacccugucccggacgagcaaaaagcgcucuuggccgcucaaugaggccaucauggcugugggcauggucuccauucuggccagcucucuccugaaaaacgauaucccuaugacagggccccuuguggcgggaggccugcugaccguuugcuaugugcucaccggcagauccgccgaccuggaacuugagcgggcugccgaugucaagugggaagaccaggcugagaucagcggguccagcccuauucugucuaucacaauuagcgaggauggauccaugucuaucaaaaaugaagaggaggaacagacccucacaauucugauccgcacgggccuccuggugauuagcgggcuuuuucccgucuccaucccgaucaccgccgccgcuugguaccugugggaggugaagaagcagagagcgggaguucugugggacgugccuucucccccucccaugggcaaagccgaacucgaggauggggcuuaucggauuaagcaaaaaggaauccugggcuacagccagauuggcgccggggucuauaaggaaggaacauuccacaccauguggcacgugacacgcggcgccguucuuaugcauaaagggaagagaaucgagcccuccugggcugacgugaagaaagaucugauuucuuacggaggcggguggaagcucgaaggagaguggaaagagggcgaagagguccaggugcuggcccucgaaccuggcaagaacccgcgggcggugcagaccaaacccgggcuguuucgcacgaacgcuggaaccaucggcgccguuagccuugacuucuccccugggacaagcggaucucccaucauugauaagaagggcaaagucguggggcuguacggaaauggcguggucaccagauccggcgccuaugugagcgcuaucgcccaaacagagaagucuauugaagacaacccugagaucgaggaugacauuuuucggaaaagacgccugaccaucauggaccuccaccccggggcgggaaagacaaaacgguaccugccugcuaucguuagagaagccauuaagcgcggccuucggacgcugauccucgccccgaccagaguggucgcugccgagauggaagaggcucugcgcgggcuccccauucgguaucagaccccugcuaucagagcggaacauaccggacgcgagauuguggaucugaugugucacgccaccuucacaaugcggcuucugucccccguuagagugccuaauuacaaccugaucauuauggacgaggcucauuucacggaucccgccagcaucgcugcccggggcuauaucuccacccgcgucgaaaugggggaggccgcuggcauuuuuaugacagcgaccccgccuggaucuagagaccccuucccccagagcaaugccccuaucauugaugaggaacgggagauccccgaacgcuccuggaacagcggccacgagugggugacagacuuuaaggggaaaaccguuugguucgugccuucuauuaaggcuggaaaugauaucgccgccugccuccgcaaaaauggcaagaaagucauccaacugucccggaagacguuugacagcgaauacgugaagacaagaaccaaugauugggacuucguggucaccacagauauuucugagaugggggcuaacuuuaaagccgaacgcguuaucgacccgcggagauguaugaagcccgugauucuuaccgacggagaggagcgcgugauccuggcgggcccuaugcccgucacacacagcuccgcugcccagcggagagggcgcauuggccggaauccuaaaaacgaaaaugaucaguauaucuacaugggagagccccucgaaaacgacgaggauugcgcccauuggaaggaagcuaaaaugcugcuggacaauaucaacaccccggagggcauuaucccuucuauguucgagcccgaaagagagaagguggaugccauugacggggaauaccgccucagaggagaggcgcggaaaacguuuguugaucuuaugcgcagaggcgaccugccuguguggcuggccuauaaggucgcugccgaagggaucaacuacgcugaucggcgcugguguuucgacggaauuaagaauaaccagauccucgaggagaauguggaaguugagauuuggacaaaagaaggcgagagaaagaaacugaagccccgguggcuugaugccagaaucuauagcgacccucuggcucucaaagaguuuaaggaguucgccgcggggcgcaagucccugacccugaaccucaucacagagaugggccggcuucccaccuucaugacgcaaaaagccagagaugcucuggacaaucuggccgugcuccacaccgcugaagccggaggccgcgccuacaaccaugcucugucugagcuuccggaaacacuggagacccuccugcugcucacacuucuggcgaccgucacagggggaauuuuucuguuccucaugagcggccgggggaucggaaagaugacccugggcaugugcugcauuaucacggccuccauucuucugugguaugcucagauccagccucacuggaucgccgccagcauuauccucgaguuuuuccugauugugcugcucauccccgaacccgagaaacagagaacaccucaagacaaucagcuuaccuacgucgugauugcuauccugaccguuguggccgcgacaauggccaacgaaaugggcuuucuggagaagaccaaaaaggaucucgggcugggaucuaucgcuacacagcagccggaauccaauauucuugacaucgaucugcggcccgccagcgcuuggacgcucuaugccguggcgaccacauucgucaccccuaugcugcgccacuccauugagaacucuagcguuaaugugucccugacagccaucgcuaaccaagccaccgugcucaugggccuugggaagggauggccccugucuaaaauggacauuggcgucccucugcucgcuaucggguguuacagccaggugaaucccauuacgcugaccgccgcccuucugcuccugguugcccauuacgcgaucaucggaccuggccugcaggccaaggcuacaagagaggcccagaaacgggcugccgccggcauuaugaagaacccgaccguggaugggaucacagucauugaccucgaucccaucccuuaugaccccaaauuugaaaagcaacuuggacaggugaugcugcugguccucugcgugacccagguucugaugaugcgcacgacaugggcgcuuugugaggcucugacccucgccacaggcccuauuuccacccugugggaagggaaucccggaagauucuggaacaccacaaucgcugugagcauggccaauaucuuucggggcucuuaccuggccggggcuggacuccuuuucuccauuaugaagaacacgaccaacacacgcagaggcaccggcaauaucggggagacacugggagaaaaauggaagucccggcugaacgcccucggcaaaucugaguuucaaauuuauaagaaauccgggauccaggaggucgaucgcacccuggcgaaggaaggaauuaaaagaggcgagacggaccaccaugccgugagccgggggucugcuaaacuuagaugguucguugaacgcaauauggugacaccggagggaaaggucguggaucugggcugcggcagagggggauggagcuacuauuguggcgggcucaaaaacgugcgggagguuaagggacugaccaaaggcgggccuggacacgaggaacccauccccauguccaccuacggcuggaaucugguccgccuccagucuggcguggacguguuuuucaucccucccgaaaagugcgauacacuucugugugacauuggggagagcuccccuaacccgaccgucgaagccggacggacacugagaguucucaaucugguggagaacuggcuuaauaacaauacgcaguucugcaucaaagugcugaaccccuauaugccuagcgucauugagaagauggaaacccuccaacgcaaguacggcggggcucuggugcggaauccccuguccagaaacucuacacaugagauguacuggguuagcaaugccuccggaaacaucgugucuagcgucaacaugauuucccgcaugcucaucaaucgguuuaccaugagacacaaaaaggcgacauaugaaccugacguggaucuuggcucugggacccgcaacaucggaauugagagcgaaauccccaaucuggacauuaucggcaaacggauugagaagaucaaacaggagcacgaaacguccuggcauuacgaucaggaccacccguauaagaccugggccuaccauggcagcuaugagacaaagcagaccgggucugcuuccagcaugguuaacggaguggucagacugcucacaaaaccuugggauguggugcccauggucacccaaauggccaugacagacaccacgccuuucggccagcagcgcguuuuuaaggaaaaaguggauacaagaacccaggagcccaaggaagggaccaaaaagcugaugaagauuacagcugaguggcuuuggaaagagcugggaaagaaaaagacgccucggauguguacccgcgaagaguucacaagaaaagugcggucuaaugccgcucucggcgccaucuuuaccgacgaaaacaaguggaaauccgcgagagaggccgucgaggauagccgguucugggaacugguggacaaggagcgcaaucugcaccucgaagggaagugcgagacauguguuuacaacaugaugggaaaaagagaaaagaaacugggcgaguuuggcaaggcuaaagggucucgggccaucugguauauguggcuuggagcucgcuuccuggaguuugaagcccucggcuuccugaaugaggaucacugguuuuccagagaaaacagccuuuccgggguggagggagaaggccugcauaagcucggguacauucugcgggacgucagcaagaaagagggcggagccauguacgcggacgauaccgcuggcugggacacacgcaucacccuggaggaucucaagaaugaagagauggugacgaaccacauggaaggggagcauaaaaagcuggccgaagccauuuucaaacuuaccuaucaaaauaagguugugagaguccagcggcccacaccgcgcggaaccgugauggacaucauuucuagacgggaucagcgcggcagcgggcaaguuggaacauacggccugaacaccuuuacgaauauggaggcucagcucaucagacagauggagggggaaggcguguucaagaacauccagcaccugacagucaccgaggaaauugccgugcaaaacuggcuugcucgggucggacgcgagagacugucccggauggccaucucuggcgacgauugcgugguuaaaccucucgacgauagauucgcgagcgcccugacagcucugaaugacauggggaagauucgcaaagauauccagcagugggagcccucccggggauggaacgacuggacccaggugcccuuuugcucucaucacuuccacgaacucauuaugaaggauggcagaguccugguggugccuugucgcaaucaagacgagcuuaucgggcgggccagaaucagccagggagcuggcuggucccugcgcgaaacggccugccucgggaaaucuuaugcgcagauguggagccugauguacuuucaucggagagaccuucgccuggccgcuaacgccauuuguuccgcuguuccgagccacugggugcccaccucucggacaaccugguccauccaugccaagcacgaguggaugacaaccgaagauaugcucacagucuggaauagaguguggauucaggagaacccuuggauggaggacaagacccccguugaaagcugggaggaaaucccuuaucugggcaaacgcgaggaucaauggugcggaucucugauuggccucacgucccgggcuacaugggccaagaauauccaggcggccauuaaccaggugagaagccugaucgggaaugaagaguacaccgacuauaugcccuccaugaaacgguucagacgcgaggaagaggaagcuggaguccuuugguga

SEQ ID NO: 20304 - RNA, 9876 nt, Artificial Sequence
  derived and/or modified CDS sequence (opt5) from DENV-2__AY858036__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuaccccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucgugacagauaauguccacaccuggacagaacaguauaaguuucagccugagucucccagcaagcucgcuuccgccauccaaaaagcucacgaagaggggauuuguggcaucagaucugugacgcgccuggaaaaccuuauguggaagcagauuaccccggagcugaaucauauccucagcgagaacgaaguuaaacugacaauuaugaccggagacaucaagggcaucaugcaggccgggaaacggucccugagaccucagcccacagagcuuaaguacagcuggaaaaccuggggaaaggcgaagaugcucucuacggaacugcacaaucauaccuuccugauugauggcccugagacagccgaaugccccaacaccaaucgcgcuuggaacucccucgagguggaggacuauggguuuggagucuucacaaccaauaucuggcugaaacuuaaggaacggcaagauguguuuugugacagcaaacugaugucugccgcuauuaaggacaacagagccgugcacgcggauaugggcuacuggaucgaguccgcccucaacgacacauggaaaauugaaaaggcuagcuucaucgaggucaagucuugccacuggccuaaaagccauacccugugguccaauggcguucuggagagcgaaaugaucauucccaagaacuucgccgggccggugucucagcacaauuaucgcccuggauaccauacgcagacagcuggccccuggcaccuugggcggcucgagauggauuuugacuucugugaaggaaccaccguggucgugacagaggauugcggcaacagagggcccucccugcggaccacgacagccagcggaaaacugaucaccgaauggugcugucgcuccugcacacucccuccgcugagauaccggggcgaggacggcuguugguaugggauggagauuagaccccuuaaggaaaaagaggaaaaucugguuaacucucucgugaccgccggacauggccagaucgauaauuuuagccuggggguccugggaauggcucuuuuccucgaggaaaugcugcgcacacgggugggcaccaagcacgcgauucugcucguugccguguccuuugucacgcugaucaccgggaacaugucuuucagagaccuuggacgcgugaugguuauggugggcgcuacaaugaccgaugacauuggcaugggggucacauaccuggcccuccuggccgcuuuuaaggugagaccuaccuucgccgcgggacugcuucugcggaaacucacgagcaaggagcugaugaugacaaccaucggcaucgugcuccugucccaaucuacaauucccgagaccauccuugaacugaccgaugcucucgcccuggggaugaugguccugaaaauuguucgcaauauggagaaguaucagcuugccgugacaaucauggcuauucugugcgugccuaacgccgucauccuccagaaugcguggaaagugagcuguacgacccuggcuguuguguccgucagcccccuccugcuuacaucuucccaacagaaggccgacuggaucccucuggcccucaccauuaagggacugaaccccacagcuaucuuucugaccacgcuugccagaacaagcaaaaagcggucuuggccgcugaaugaagcuauuauggccgugggcaugguuuccauccucgcgagcucucugcucaaaaacgauauuccuaugaccgggccccugguggccggaggccuucugaccgucugcuacgugcugacaggccgcuccgcugaccucgagcuggaaagagccgcugacguccggugggaggagcaggccgaaaucagcggguccagcccuauccuuucuauuaccaucagcgaggauggauccaugucuauuaagaaugaagaggaggaacagacacugacgauccucauucgcaccggccugcucgugaucagcgggcuguuccccguuuccauuccgaucacagccgcugcgugguaucuuugggaggugaaaaagcaaagagccggaguccugugggacgugccuucucccccucccguuggcaaagcugaacuggaggauggggccuaccggaucaagcagaagggaauucucggcuauagccagaucggcgccgggguguacaaagaaggaaccuuucacacaauguggcaugucacccgcggcgcugugcugaugcacaaggggaaaagaauugagcccuccugggccgacgugaagaaagaucuuaucucuuacggaggcggguggaagcuggagggagaauggaaggagggcgaagagguucagguccucgcgcuggaaccuggcaaaaacccgcgggcugugcaaacgaagcccgggcucuucaaaaccaacacaggaaccauuggcgccgugagccuggacuuuuccccugggacaagcggaucucccaucgucgauaagaaaggcaaggugguugggcuuuauggaaauggcguggucaccagauccggcacauacgugagcgccaucgcucagacggagaagucuauugaggacaacccugaaaucgaggaugacauuuuccgcaaaaagcggcugaccaucauggaucugcaucccggggccggaaaaacaaagagauaucucccugcgauuguucgcgaagcuaucaaacggggccugagaacccuuauccuggccccgacccgcguggucgccgcugagauggaagaggcccuccgggggcugcccauuagauaccagacaccugcuauccgcgccgagcacacgggacgggaaauuguggaccucaugugucaugcgaccuucacaaugagacugcuuucccccauccggguuccuaauuauaaccugauuaucauggaugaggcccacuuuaccgaccccgcuagcauugccgcucgcggcuacaucuccacaagaguggaaaugggggaggccgccggcaucuucaugaccgcuacgccgccuggaucucgggaccccuuuccccagagcaaugcgccuauuauggaugaggaacgcgagauccccgaaagauccuggaacagcggccacgagugggucacagacuucaaggggaagaccgugugguuugugccuucuauuaaagccggaaaugauaucgcugccugccugcggaagaacggcaaaaaggucauucaacucuccagaaaaaccuucgacagcgaauauaucaagacacgcaccaaugauugggacuuuguugugacaaccgauaucucugagaugggggccaacuucaaggcugagcgggugauugacccgagacgcuguaugaaacccgucauccugacggauggagaagagcgggugauucuugccggcccuaugcccguuacacauagcuccgcggcucagagacgcgggcgggugggcagaaauccuaagaacgaaaaugaccaguacaucuacaugggagagccccuggaaaacgaugaggacugcgcccacuggaaagaggccaagaugcuccuggacaauauuaacaccccggaaggcaucaucccuucuauguuugagcccgaacgcgagaaagucgaugcuauugacggggaauauagacugcggggagaggcccgcaagacauucguggaucucaugagacggggcgaccuuccuguuuggcuggcguaccgcguggccgcugaggggaucaacuaugccgauagacggugguguuuugacggagucaaaaauaaccaaauucuggaagagaauguggaagucgagaucuggaccaaggagggcgaaagaaagaaacucaagccccgcuggcuggaugcucggauuuacagcgacccucuugcccugaaagaguucaaggaauucgcugccgggagaaaaucccucacgcugaaccugaucaccgagaugggccgccuccccacauuuaugacccagaaggcgcggaaugcccuugauaaccuggcugugcugcauacagccgaaaccggaggcagagcuuauaaucacgcccucucugagcugccggagacacuugaaacccugcuccugcugacgcuccuugccacaguuaccgggggaauuuuccuguuucugaugagcggcaaggggaucggaaaaaugacccucggcaugugcugcaucauuacagcuuccauccugcuuugguacgcgcagauucagccucacuggaucgccgcuagcauuauccuggaguucuuucucaucgugcugcugauucccgaacccgagaagcaacggaccccucaggacaaccagcucacauauguggucaucgccauucuuacgguuguggccgcuaccauggccaaugaaaugggcuuccuggagaaaacaaagaaagauuuugggcugggaucuaucaccacacagcaaccggaguccaacauucucgacaucgaucugcgccccgcgagcgccuggacccuuuacgcuguggccacgaccuucaucacaccuaugcugagacauuccauugaaaauucuagcgucaacgugucccucaccgcuaucgccaaucaggcgacaguucugaugggccuggggaagggauggccccucucuaagauggacauuggcgugccucuucuggccaucggguguuacagccaggucaaccccauuacccugacggcugcccuccugcuucugguggcucacuaugccaucauuggaccuggccuccaggcuaaagccacacgggaggcgcaaaagcgcgccgcugccggcaucaugaaaaauccgaccgucgacgggaucacagugauugaucuggaccccaucccuuacgaucccaaguuugaaaaacagcugggacagguuaugcuccuugugcugugcgucacccaggugcugaugaugagaaccacaugggcucucugugaggcccugacgcuugccaccggcccuauuuccacacugugggaagggaaccccggacgguucuggaauaccacaaucgcgguuagcauggcuaacauuuuucgcggcucuuaucucgccggggcuggacugcuguucuccaucaugaagaacaccgccaauacgagacggggcacaggcaacaccggggagacccucggagagaaguggaaaaaucgccuuaacgcccugggcaagagcgaauuucaaaucuacaaaaagucugggauucaggagguggacagaacacuggcuaaagaaggaaucaagcggggcgagaccgaucaucacgccgucuccagagggagcgcgaaacuccgcugguucguggagcggaaucuggugacaccggaaggaaagguugucgaccuuggcugcggcagagggggauggucuuauuacuguggcgggcugaagaacgugaaagaggugaagggacucacgaaaggcgggccuggacaugaagagcccauucccaugagcaccuauggcuggaaucugguccgccugcaguccggcguugauguguucuuuacaccucccgaaaagugcgacacccuccuuugugauaucggggagucuagcccuaacccgacaguggaggccggacggacccugagaguccugaaucucguggaaaacuggcugaauaacaauacgcaauucugcauuaaaguucuuaaccccuacaugccuuccgugaucgagaagauggaagcucugcagcgcaaguacggcggggcccucguccggaauccccugagcagaaacuccacccacgagauguauugggugucuaacgcuagcggaaauaucguuuccucugugaacaugauuagccgcaugcugaucaaucgguuuacaaugagacacaaaaaggccaccuacgaaccugacgucgaucucggcuccgggacacgcaacauuggaaucgagucugagacccccaaucuugacauuaucggcaaacggaucgaaaagauuaaacaggagcaugaaacaagcuggcacuaugaucaggaccauccguacaagaccugggcguaucacggcuccuacgagacgaagcaaacagggagcgccucuuccauggugaacggaguggucagacugcugaccaaaccuugggacguuauccccauggugacccagauggcuaugacagauacgaccccuuucggccagcagcgcguguuuaaggaaaaagucgacacaagaacccaagagcccaaggaggggacaaaaaagcucaugaagauuaccgccgaauggcuguggaaagagcuuggaaagaaaaagacaccucggauguguacccgcgaagaguucacgagaaaagugcggagcaaugcugcccugggcgcuaucuuuaccgaugagaacaaguggaaaucugccagagaagcgguugaggacuccgaauucugggagcucguggauaaggaacggaaucugcaccuggaggggaagugcgagacaugugucuauaacaugaugggaaaacgcgaaaagaaacucggcgaguuuggcaaggccaaagggagcagagcuauuugguacauguggcugggagcccgguuccuugaauuugaggcucugggcuuccucaaugaagaccauugguuuucucgcgagaacucccugagcgggguggagggagaaggccuucacaagcugggguacauccucagagauguuuccaagaaagagggcggagccauguaugccgacgauaccgcgggcugggacacacggauuacccuggaagaucugaagaaugaggaaauggugacgaaccauauggagggggagcacaaaaagcucgcugaagccaucuuccgccugacauaccagaauaaagucgugagaguucagcggcccaccccgcgcggaacagugauggacaucauuagcagacgggaccagcgcggcucugggcaagucgugaccuauggacuuaacacguucaccaacauggaggcccagcugaucagacagauggaaggcgagggggucuuuaagagcauucaacaucucacagugaccgaggaaaucgcuguuaagaauuggcuggugcgggucggccgcgagagacuuucccggauggccauuucuggagaugacugcguggugaaaccucuggaugacagauucgcuagcgcccucacagcgcugaacgauaugggcaagguucgcaaagacauccagcagugggaacccucccggggguggaaugauuggacccaggugcccuuuugcucucaccacuuccaugagcugaucaugaaggacggaagaguccucgugguuccuugucgcaaccaagaugaacugauuggccgggccagaaucagccagggggcuggauggucccuucgcgagacagccugccugggcaaaucuuacgcucagauguggagccucauguauuuucaccggagagaccugcgccuugccgcgaaugccauuuguuccgcugugccgagccauuggguccccaccucucggacgacaugguccauccacgccacccacgaguggaugaccacagaagauaugcugaccguguggaacagagucuggauucaggagaauccuuggauggaagacaagacacccguggagagcugggaagagaucccuuaccucgggaagcgcgaggaucaauggugcggcucucugaucggacugacgucccgggcuaccugggccaaaaacauucagacagcuaucaaucagguuagaagccucauuggcaacgaagaguauaccgacuacaugcccuccaugaagcgguucagacgcgaagaggaagaggccggggugcugugguga

SEQ ID NO: 20305 - RNA, 9876 nt, Artificial Sequence
  derived and/or modified CDS sequence (opt5) from DENV-2__HQ332184__SS-prME
acagccggagugaucauuaugcugauccccacagcuauggccuuccaccucacgaccagaaauggggaaccucauaugauugucggacggcaggaaaagggaaagagccugcuuuuuaagacagaggacgggguuaauaugugcacccugauggcgaucgaucucggagaacugugugaggacacaauuaccuacaaaugcccgcuucugagacaaaaugaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgggugggauuucggaucucugggcggggucuuuacgagcauuggcaaggcccuccaccagguguucggagcuaucuacggcgccgcguuuuccgggguuucuuggacaaugaaaauccugauuggaguggucaucaccuggauuggcaugaacagccgguccaccagccugucugugucccuugugcucguuggggucgugacacuguaucugggagcuauggugcaggccgacagcggcugugucgugucuuggaagaauaaagaacucaagugcggguccggcaucuucauuaccgauaacguucacacauggacggagcaguacaaguuucaaccugaaagccccuccaaacuggccucugcuauccagaaggcccaugaggaaggaaucuguggcauuagaagcgugacccgccuugagaaucugauguggaaacagaucacaccggagcucaaccacauucuguccgaaaaugaggucaagcugaccaucaugacaggggacaccaaaggaauuaugcaggcuggcaagcggucucuuagaccucaacccacggaacucaaauauagcuggaagaccugggggaaggccaaaaugcuguccacagagagccauaaccagaccuuccugaucgauggaccugaaacagcggagugccccaauaccaaccgcgccuggaacucucucgagguggaagacuacggcuuuggcguuuucacaaccaacaucuggcugaaacuucgggagaaacaggacguguuuugugauuccaagcugaugagcgcugccauuaaagacaauagagcuguccacgccgauaugggguauuggaucgaaucugcgcucaacgacacguggaagauggagaaggccuccuucauugaggugaaaagcugccacuggccuaagucucauacacuguggagcaauggaguucuggaauccgagaugaucauucccaaaaacuucgcuggcccggugagccagcacaacuaccgcccuggguaucauacccaaaccgccggacccuggcaccuuggcaagcucgaaauggauuuugacuucugugaggggacaaccgucguggugacggaagauugcggaaaucggggccccucucugagaacaaccacagcuuccggcaaacugaucaccgaguggugcugucggagcugcacacucccuccgcugcgcuacagaggggaggacggauguugguacggcauggaaauucggccccuuaaggagaaggaagagaaccuggucaauucccucguuaccgccgggcauggacagaucgauaacuuuucucugggcgugcuggggauggcccuuuuccucgaagagaugcugagaacgcgcgugggaaccaaacacgcuacacugcucgucgcggccagcuuugugacccugaucacaggcaauauguccuuccgggaccuuggcagaguuauggugauggucggggcuaccaugacggaugacauuggaaugggcgugacauaucuggcccuccuggccgcuuuuaagguucgcccuaccuucgccgcggggcugcuucugagaaaacucacaucuaaggagcugaugauggcuaccaucggaauuacccuccugagccaguccacaauccccgaaacgauucuugagcugaccgaugcccucgcccugggcaugauggugcugaaaaucguccggaacauggaaaaguaccaacuugcugugacaaucauggccauuucuugcguuccuaaugcggugauccugcgcaacgcuuggaaggucagcuguaccauucucgccgccguguccgugagcccccugcuccugacaucuucccagcagaaagcugacuggaucccucuugcccugaccauuaaggggcucaaucccacggcuaucuuucugacaacccugagcagaaccucuaaaaagcgguccuggccgcuuaacgaggccaucauggcggucggaaugguuagcauucuggccucuucccuccugaaaaaugacaucccuaugacaggcccccucguggcuggcgggcugcuuaccgugugcuauguccugacaggacgcagcgccgaucuggaacucgagagagcugccgacgugaagugggaggaucaggccgaaauuuccggcagcucuccuauccugagcauuacgaucuccgaggacgggucuaugagcauuaaaaacgaagaggaggaacaaacccuuacaauccugauccggaccggacuccugguuauuuccggcguguuccccgucucuaucccgauuacagcugcggccugguaccucugggaggugaagaagcagcgcgcugggguucugugggaugugccuucucccccucccgucggaaaagccgaacuugaggacggcgccuauagaaucaagcagcggggcauucugggguacucccagaucggagcuggcguguauaaagaagggaccuuucacacgauguggcaugucacccgcggagccgugcugaugcacagaggcaagcggaucgagcccuccugggcggauguuaaaaaggaccucauuagcuacgggggaggcuggaagcuggagggcgaauggaaagagggggaagaggugcaaguccuugcucuggaaccuggaaagaauccgagagccgugcagacaaaacccggcaucuucaagaccaacacagggaccauuggagccguuucccucgauuuuagcccuggcacaucugggucccccaucguggaccgcaaaggaaaggucgugggccuguacggcaauggggugguuacgcggagcggagcuuaugucucugccauugcgcagaccgagaaguccaucgaggauaacccugaaaucgaggacgauauuuuccgcaagaagcgccucacaaucauggaccugcaucccggcgcugggaaaaccaagcgguaccuuccugccauugugagagaagccaucaaacgcggacugcggacccugauucucgcuccgacaagaguggucgccgcugagauggaagaggcccugcgcggccuucccauccgguaucagacgccugcgauuaaggccgagcacaccgggagagaaaucguggaccugaugugucaugcuacauucaccaugcggcuccugagccccguucgcgugccuaacuacaaucucaucauuauggaugaggcccacuuuacagaccccgcuuccaucgccgccagaggcuauauuucuacccgggucgaaaugggagaggcugcgggcaucuucaugacggccacaccgccugggagccgcgaucccuuuccccaauccaacgcuccuauuauggacgaggaaagagagauccccgaacggagcuggaacucuggacacgagugggugaccgauuucaagggcaaaaccguuugguuugugccuuccaucaaggccgggaacgacauugccgcuugccugcgcaagaauggaaagaaagucauccagcuuagccgcaagacauucgauucugaauacgugaagacccgggccaacgacugggauuuuguugugacaaccgacauuagcgagaugggcgcgaauuucaaagcugagagagucaucgauccgcgccgguguaugaagcccgugauucugacggacggggaagagagagugauccuggccggcccuaugcccgucacacauuccucugccgcucagcgccggggaagaaucggccgcaacccuaaaaaugaaaacgaccaauauauuuacaugggggagccccucgaaaaugaugaggacugcgcccacuggaaggaggcgaaaaugcugcuugauaacaucaauaccccggaaggaauuaucccuagcauguuugagcccgaaagagagaagguugacgccauugauggcgaauaccggcugcgcggggaggcuagaaaaacauucguggaccucaugcggcgcggagaucugccuguguggcuggccuauaaggucgcugccgagggcaucaacuacgcugacagaaagugguguuuugaugggauuaaaaauaaccagauccucgaagagaacguggaaguugagaucuggaccaaggagggcgaacggaagaaacuuaaacccagauggcuggacgcccgcauuuauuccgauccucuggcgcucaaagaguucaaggaguucgccgcuggacggaaaucucugacgcuuaaucugaucaccgagaugggcagacuccccacauuuaugacccagaaggcccgcaacgcucuggacaaucuggccgugcuccauacagccgaagcugggggacgggcguacaaccacgcccuuagcgagcugccggagacccuggaaacacuccugcuucugacccuccuggcuacggucacaggcgggauuuuccuguuucucauguccggaaaaggcaucggcaagaugacccuugggaugugcugcauuaucaccgccagcgugcugcugugguaugcccagauccaaccucacuggauugcugccucuaucauucucgaguucuuucugaucguucuucugauucccgaacccgagaaacagagaacaccucaggauaaucagcucaccuacguggucaucgcgauccugacaguggucgccgcuacgauggccaacgaaaugggauuccuggagaagaccaagaaagaccucggccuuggguccauuacaacccaagagagcgaauccaauauccuggacauugaucugcggccggcuucugccuggacacucuaugcgguggccaccacguuuguuacccccaugcugcgccauagcaucgagaacuccucugugaaugugagccuuacagcuauugccaaccaggcuaccguccugaugggacucggcaagggguggccucuguccaaaauggacaucggaguuccccugcucgccauuggcuguuacagccaggugaauccuaucacacuuaccgcugcccugcugcuccugguggcgcacuacgccaucauuggccccgggcuucaggcuaaggccacgagagaagcucaaaaacgggccgccgcgggaaucaugaagaacccuacagucgauggcauuaccgugaucgaccuggagccgauucccuaugauccuaaguucgaaaaacagcucgggcagguuaugcugcugauccucugcgugacacagguccuuaugaugcgcaccaccugggcucugugugaggcccugacacucgcuacgggacccaucucuacccugugggagggcaauccugggagauuuuggaacacaaccauugccguguccauggccaauaucuuccggggaagcuaccuugcuggcgccggccugcucuuuucuauuaugaagaacacaaccaauacgcgcagagggacaggaaacaucggcgaaacccugggggagaaauggaagucccggcugaacgcgcucggaaaaagcgaguuccaaauuuauaagaaaucuggcauccaggaggucgaccgcacccuugccaaggaggggaucaagagaggagaaacagaucaucacgcugugagccggggcuccgccaaacugagaugguuuguugagcgcaauauggugacccccgaaggcaaggucguggaccuggggugcggacggggcggguggucuuacuauuguggaggccucaaaaacguuagagaggugaaggggcugacaaaaggaggcccgggccaugaagaaccuauucccaugagcacguacggguggaaucuuguccgccugcaguccggaguggauguguucuucacacccccugagaagugcgacacccuccugugugauaucggcgaaagcucccccaacccuaccauugaggcugggcggacacugagaguucucaaucuugucgaaaacuggcugaauaacaauacccaauuuugcaucaaggugcugaacccguauaugcccucugugauugagaaaauggaaacgcuccagcgcaaguacggaggcgcccugguccggaauccucuuagcagaaacuccacccacgagauguacuggguuucuaaugcgacagggaacaucgugagcuccgugaauaugaucucucgcaugcugauuaaccgguucaccaugaaacacaagaaagccacauaugagcccgacgucgaucucggaagcggcaccagaaacaucggcauugaauccgagaucccuaaucuggacauuaucgggaagcgcauugaaaagaucaaacaggagcaugaaacaagcuggcacuacgaccaggaucaucccuauaagaccugggcuuaccacggaucuuaugagacgaaacaaacaggcuccgccagcucuauggugaacgggguugugcggcugcucaccaagccgugggacgucgugccuaugguuacccagauggcuaugacagauacgacccccuuuggacagcagagaguguucaaagagaaggucgacacacgcacccaagaaccuaaggagggcaccaagaaacuuaugagaaucaccgccgaauggcuguggaaagagcuggggaagaaaaagacaccccggauguguacccgcgaggaauuuacgagaaaagugcgguccaaugcugcccucggagcgauuuucaccgaugagaacaaguggaaaagcgccagagaagcuguggaggacggccgguuuugggaacuggucgauaaagagcgcaaucuucaccuggagggcaagugcgaaacauguguuuacaacaugauggggaaaagagagaagaaacucggagaguucggcaaggccaaggggucucgggcuaucugguauauguggcugggagcccgcuuucuggaguucgaagcccucggcuuucugaaugaggaccauugguucuccagagggaacagccuuuccggcguggagggagaaggccugcaccggcucggguacauucugcgcgaugugggcaagaaggagggcggggcgauguacgcugacgauaccgccggaugggacacaagaaucacccuugaagaccugaaaaaugaggaaauggucacgaaccauaugaagggcgagcacaaaaagcucgccgaggcuauuuuuaagcugacauaucagaauaaagugguucgggugcagcgcccuacccccagagggacagucauggauaucaucagccggcgcgaccagagaggcucuggacaagugggcaccuacgggcugaacacguucaccaauauggaagcccagcucauucggcagauggagggagaaggcaucuucaagagcauucaacaucugacagcuaccgaggagaucgccguucagaacuggcuugcgcgcguggggagagaacggcuguccagaauggccauuucuggagaugacugcgucgugaaaccgaucgaugaccgcuuugcuagcgcccucacagcucugaaugauaugggcaagguucggaaagacauccagcagugggagccuuccagaggguggaacgauuggacccaagugcccuucugcucucaccacuuucaugaacuugucaugaaggacggccgcgugcuggucgugcccugucggaaccaggaugagcucauuggcagagcccgcaucagccagggcgcgggguggucccugaaggaaacagccugccugggaaaaucuuaugcucagauguggacccucauguacuuccaccggagagaccugcgccuugccgcuaaugccauuuguagcgcuguuccuucccauugggugccgacgagccggacaaccuggucuauccacgccaagcacgaguggaugaccacagaggauaugcuggcggucuggaacagaguguggauucaagaaaaucccuggauggaggacaaaaccccuguggaauccugggaggaaguucccuaucucggcaagcgcgaggaccaguggugcgggagccugaucggacuuacaucucgggccacgugggcuaaaaacauucagaccgccaucaaucaggugagaucccugaucggcaacgaggaauacacagauuauaugccuagcaugaagcgguuuagacgcgaggaagaggaagccgggguccucugguga

SEQ ID NO: 20306 - RNA, 9876 nt, Artificial Sequence
  derived and/or modified CDS sequence (opt5) from DENV-2__HQ332185__SS-prME
accgccggagugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaacgaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaucaaagaacucaagugcggcuccgggauuuucaucaccgauaauguucacacauggacggagcaguacaaguuucaaccugaaagccccuccaaacuggcuucugccauccagaaggcucaugaggaaggcauuuguggaaucagaagcgugacccgccuugagaaccugauguggaaacagauuacaccggagcucaaucacauccuguccgaaaacgaggucaagcugaccauuaugacaggcgacaccaaagggaucaugcaggccggaaagcggucucuuagaccucaacccacggaacucaaauauagcuggaagaccuggggcaaggcgaaaaugcuguccacagagagccauaaucagaccuuccugaucgaugggccugaaacagccgagugccccaacaccaaucgcgcuuggaacucucucgagguggaagacuacggauuuggcguuuucacaaccaauauuuggcugaaacuucgggagaaacaggacguguuuugugauuccaagcugaugagcgccgcuaucaaaaacaauagagccguccacgcggacaugggcuauuggauugaaucugcccucaacgauacguggaagauggagaaggcuuccuucaucgaggugaaaagcugccacuggccuaagucucauacacuguggagcaaugggguucuggaauccgagaugauuauccccaaaaacuucgccggaccggugagccagcacaacuaccgcccuggcuaucauacccaaaccgcugggcccuggcaccuuggaaagcucgaaauggacuuugauuucugugagggcacaaccgucguggugacggaagacugcgggaaucggggacccucucugagaacaaccacagccuccggcaaacugauuaccgaguggugcugucggagcugcacacucccuccgcugcgcuacagaggcgaggauggguguugguacggaauggaaauccggccccuuaaggagaaggaagagaaccuggucaauucccucguuaccgccggccaugggcagaucgacaacuuuucucugggagugcugggcauggcucuuuuccucgaagagaugcugagaacgcgcguggggaccaaacacgcgauucugcucgucgccgugagcuuuguuacacugaucaccggaaauauguccuuccgggaucuuggcagagugauggucauggugggcgcuacaaugaccgacgauauugggaugggaguuacguaucuggcccuccuggccgcuuuuaaggugcgcccuacauucgccgcgggccugcuucugagaaaacucaccucuaaggagcugaugauggcuacaaucgggauuacccuccugagccaguccaccauccccgaaacaauccuugagcugacggacgcccucgcccugggaaugaugguccugaaaauugugcggaacauggaaaaguaccaacuugcuguuaccaucauggccauuucuugcgugccuaaugcggucauccugcgcaacgcuuggaaggugagcuguacaauucucgccgccguguccgucagcccccugcuccugaccucuucccagcagaaagcugauuggaucccucuugcccugacaaucaagggccucaaucccaccgcuauuuuucugacgacacugagcagaaccucuaaaaagcgguccuggccgcuuaacgaggccaucauggcgguugggauggugagcauucuggccucuucccuccugaaaaaugacaucccuaugaccggaccccucguggcuggcggccugcuuacagucugcuaugugcugaccgggcgcagcgccgaccuggaacucgagagagcugccgauguuaagugggaggaccaggccgaaauuuccggaagcucuccuauccugagcauuacaaucuccgaggauggcucuaugagcaucaaaaacgaagaggaggaacaaacgcuuaccauucugauccggacagggcuccuggugauuuccggagucuuccccgugucuaucccgauuaccgcugcggccugguaccucugggagguuaagaagcagcgcgcuggcgugcugugggacgucccuucucccccucccguggggaaagccgaacuugaggauggagccuauagaaucaagcagcggggcauccugggcuacucccagauuggggcuggagucuauaaagaaggcacauuucacaccauguggcaugugacgcgcggggccguucugaugcacagaggaaagcggaucgagcccuccugggcggacgugaaaaaggaucucauuagcuacggcgggggauggaagcuggagggcgaauggaaagagggcgaagagguccaagugcuugcucuggaaccugggaagaauccgagagccguucagaccaaacccggaaucuucaagacaaacaccggcacaauuggggccgugucccucgacuuuagcccuggaaccucuggcucccccaucgucgaucgcaaagggaagguggugggacuguacggcaauggcguugucacacggagcggggcuuaugugucugccaucgcgcagacggagaaguccauugaggacaacccugaaaucgaggaugacauuuuccgcaagaagcgccucaccaucauggaucugcaucccggagcuggcaaaacaaagcgguaccuuccugccauugugagagaagccaucaaacgcgggcugcggacccugauucucgcuccgaccagagucguggccgcugagauggaagaggcccugcgcggacuucccauccgguaucagaccccugcgaucaaggccgagcacacgggcagagaaauuguugaccugaugugucaugcuaccuucacaaugcggcuccugagccccgugcgcgucccuaacuacaaucucaucauuauggacgaggcccacuuuaccgaucccgcuuccaucgccgccagaggguauauuucuacacggguggaaaugggcgaggcugcgggaaucuucaugaccgccacgccgccuggcagccgcgaccccuuuccccaauccaacgcuccuaucauggaugaggaaagagagauucccgaacggagcuggaacucugggcacgaguggguuacagacuucaagggaaaaaccgugugguuugucccuuccaucaaggccggcaacgauauugccgcuugccugcgcaagaaugggaagaaagugauccagcuuagccgcaagaccuucgacucugaauacguuaagacacgggccaacgauugggacuuuguggucaccacagauauuagcgagaugggagcgaauuucaaagcugagagagugaucgacccgcgccgguguaugaagcccgugauccugaccgauggcgaagagagagucauucuggccgggccuaugcccguuacgcauuccucugccgcucagcgccggggcagaaucggacgcaacccuaaaaaugaaaacgaccaauauauuuacaugggcgagccccucgaaaaugacgaggauugcgcccacuggaaggaggcgaaaaugcugcuugacaacaucaauacaccggaagggauuaucccuagcauguuugagcccgaaagagagaagguggaugccauugacggagaauaccggcugcgcggcgaggcuagaaaaaccuucguggaucucaugcggcgcggggaccugccugucuggcuggccuauaagguggcugccgagggaaucaacuacgcugauagaaagugguguuuugacggcaucaaaaauaaccagauucucgaagagaacguugaaguggagaucuggacaaaggagggggaacggaagaaacuuaaacccagauggcuggaugcccgcauuuauuccgacccucuggcgcucaaagaguucaaggaguucgccgcuggccggaaaucucugacccuuaaucugaucacggagaugggaagacuccccaccuuuaugacacagaaggcccgcaacgcucuggauaaucuggccguccuccauaccgccgaagcuggcgggcgggcguacaaccacgcccuuagcgagcugccggagacacuggaaacccuccugcuucugacacuccuggcuaccgugacgggaggcauuuuccuguuucucauguccgggaaaggaaucggcaagaugacacuuggcaugugcugcaucauuaccgccagcguucugcugugguaugcccagauccaaccucacuggauugcugccucuaucauucucgaguucuuucugaucgugcuucugauccccgaacccgagaaacagagaaccccucaggacaaucagcucacauacgucgugauugcgauccugaccgucguggccgcuacaauggccaacgaaaugggguuccuggagaagacgaagaaagaucucggacuuggcuccauuaccacacaagagagcgaauccaauauccuggacauugaccugcggccggcuucugccuggacccucuaugcgguugccacaaccuuugugacgcccaugcugcgccauagcaucgagaacuccucugugaaugucagccuuaccgcuauugccaaccaggcuacaguucugauggggcucggaaagggcuggccucuguccaaaauggauaucggggugccccugcucgccaucggauguuacagccaggugaauccuauuacccuuacagcugcccugcugcuccuggucgcgcacuacgccaucauuggccccggccuucaggcuaaggccaccagagaagcucaaaaacgggccgccgcggggaucaugaagaacccuacgguggacggaauuacaguuaucgaucuggagccgauccccuaugacccuaaguucgaaaaacagcucggccaggugaugcugcugauucucugcgucacccaggugcuuaugaugcgcacaaccugggcucugugugaggcccugacccucgcuacagggcccaucucuacgcugugggagggaaauccuggcagauuuuggaacaccacaauugccgucuccauggccaauaucuuccgggggagcuaccuugcuggagccggccugcucuuuucuauuaugaagaacaccacaaauacccgcagaggcacggggaacaucggagaaacacugggcgagaaauggaagucccggcugaacgcgcucgggaaaagcgaguuccaaaucuauaagaaaucuggcauucaggagguggaucgcacccuugccaaggagggcaucaagagaggggaaaccgaccaucacgcuguuagccggggauccgccaaacugagaugguuuguggagcgcaauauggucacacccgaaggcaaggugguugaucugggcugcgggcggggaggcuggucuuacuauugugggggacucaaaaacgugagagaggucaagggccugaccaaagggggaccgggccaugaagaaccuauucccaugagcacauacggcuggaaucuugugcgccugcaguccgggguggacguuuucuucacgcccccugagaagugcgauacccuccugugugacaucggagaaagcucccccaacccuacaauugaggcuggccggacccugagaguccucaaucuuguggaaaacuggcugaauaacaauacacaauuuugcaucaaggugcugaacccguauaugcccucugucaucgagaaaauggaaacccuccagcgcaaguacgggggagcccugguucggaauccucuuagcagaaacuccacgcacgagauguacugggugucuaaugcgaccggcaacauugugagcuccgucaauaugaucucucgcaugcugauuaaccgguucacaaugaaacacaagaaagccaccuaugagcccgauguggaccucgggagcggaacaagaaacaucggcauugaauccgagaucccuaaucuggauauuaucggcaagcgcaucgaaaagauuaaacaggagcaugaaaccagcuggcacuacgaccaggaccaucccuauaagacaugggcuuaccacgggucuuaugagaccaaacaaacgggauccgccagcucuaugguuaacggcgugguccggcugcucacaaagccgugggaugugguuccuauggugacccagauggcuaugaccgacacaacgcccuuugggcagcagagagucuucaaagagaagguggauacccgcacacaagaaccuaaggagggaaccaagaaacuuaugagaaucacagccgaauggcuguggaaagagcugggcaaaaagaaaacaccccggauguguacacgcgaggaauuuaccagaaaagugcgguccaaugcugcccucggggcgauuuucacggacgagaacaaguggaaaagcgccagagaagcugucgaggauggacgguuuugggaacugguugacaaagagcgcaaucuucaccuggagggcaagugcgaaaccuguguguacaacaugaugggcaaaagagagaagaaacucggggaguucggaaaggccaagggcucucgggcuaucugguauauguggcugggggcccgcuuucuggaguucgaagcccucggauuucugaaugaggaucauugguucuccagaggcaacagccuuuccgggguggagggcgaaggacugcaccggcucggcuacauucugcgcgacgucgggaaaaaggagggaggcgcgauguacgcugaugacacagccgggugggauaccagaaucacacuugaagaccugaaaaaugaggaaauggugaccaaccauaugaagggagagcacaaaaagcucgccgaggcuaucuuuaagcugacguaucagaauaaaguugugcggguccagcgcccuacacccagaggcaccgugauggacauuaucagccggcgcgaucagagagggucuggccaaguuggaacauacggccugaacaccuucacgaauauggaagcccagcucauucggcagauggagggggaaggaaucuucaagagcauucaacaucugaccgcuacagaggagaucgccgugcagaacuggcuugcgcgcgucggcagagaacggcuguccagaauggccaucucuggggacgauugcgugguuaaaccgauugacgaucgcuuugcuagcgcccucaccgcucugaaugacaugggaaaggugcggaaagauauccagcagugggagccuuccagaggcuggaacgacuggacacaaguccccuucugcucucaccacuuucaugaacuugugaugaaggaugggcgcguccuggugguucccugucggaaccaggacgagcucauuggcagagcccgcaucagccagggagcgggcuggucccugaaggaaaccgccugccuggggaaaucuuaugcucagauguggacacucauguacuuccaccggagagaucugcgccuugccgcuaaugccauuuguagcgcugugccuucccauugggucccgaccagccggacgacauggucuauccacgccaagcacgaguggaugaccaccgaggacaugcuggcgguguggaacagaguguggauucaagaaaaucccuggauggaggauaaaacaccuguugaauccugggaggaagugcccuaucucggaaagcgcgaggaccaguggugcggcagccugaucgggcuuaccucucgggccacaugggcuaaaaacauccagacggccauuaaucaggucagaucccugaucggaaacgaggaauacaccgacuauaugccuagcaugaagcgguuuagacgcgaggaagaggaagccggcgugcucugguga

SEQ ID NO: 20307 - RNA, 9876 nt, Artificial Sequence
  derived and/or modified CDS sequence (opt5) from DENV-2__HQ332186__SS-prME
accgccggcgugaucgucaugcugauucccaccgcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacauucuggagcaaugggguccuggaauccgagaugaucauucccaaaaacuuugccggaccggugagccagcacaacuaccgcccuggcuaucauacccaaaucgcugggcccuggcaccugggaaaacuugaaauggauuucgacuuuugugagggcaccacaguggucguuaccgaagauugcgggaaucggggacccucucucagaacgacaaccgccuccggcaaacugauuacagaguggugcugucggagcugcacccugccuccgcuccgcuacagaggcgaggacggguguugguacggaauggaaauccggccccugaaggagaaggaagagaaccuugugaauagccuggugacagccggccaugggcagauugauaacuucucucucggaguccugggcauggcucuguuucuugaagagaugcucagaacccgcguggggacgaaacacgcgauccugcugguugccgugagcuucgucacccucaucacaggaaauauguccuuucgggaccugggcagagugaugguuauggugggcgcuaccaugacagaugacauugggaugggagucaccuaucuugcccugcucgccgcuuucaaggugcgcccuacguuugccgcgggccugcugcuuagaaaacugacaucuaaggagcucaugauggcuaccaucgggauuacacugcucagccaguccaccauccccgaaaccauucuggagcuuacagaugcccuggcccucggaaugaugguucugaaaaucgugcggaacauggaaaaguaccaacuggcugucacgaucauggccauuucuugcgugccuaaugcggugauccuucgcaacgcuuggaaggucagcuguaccauucuggccgccguuuccgugagcccccuccugcucacaucuucccagcagaaagcugacuggaucccucuggcccuuaccauuaagggccugaaucccacagcuaucuuccucaccacgcugagcagaacaucuaaaaagcgguccuggccgcugaacgaggccaucauggcgguggggauggucagcauucuugccucuucccugcucaaaaaugacaucccuaugaccggaccccugguggcuggcggccuccugaccguuugcuaugugcuuacagggcgcagcgccgaucuggaacuggagagagcugccgacgucaagugggaggaucaggccgaaauuuccggaagcucuccuauccucagcauuaccaucuccgaggacggcucuaugagcauuaaaaacgaagaggaggaacaaacacugacgauccuuauccggaccgggcugcucgugauuuccggaguuuuucccgugucuaucccgauuacagcugcggccugguaccugugggaggucaagaagcagcgcgcuggcgugcucugggaugucccuucucccccucccguggggaaagccgaacuggaggacggagccuauagaaucaagcagcggggcauucuuggcuacucccagaucggggcuggaguuuauaaagaaggcaccuuccacacaauguggcaugugacccgcggggccguccugaugcacagaggaaagcggaucgagcccuccugggcggaugugaaaaaggaccugauuagcuacggcgggggauggaagcucgagggcgaauggaaagagggcgaagagguucaagugcuggcucuugaaccugggaagaauccgagagccguccagacgaaacccggaaucuuuaagaccaacacaggcaccauuggggccgugucccuggauuucagcccuggaacaucuggcucccccaucguggaccgcaaagggaagguugucggacucuacggcaauggcguggugacccggagcggggcuuaugucucugccauugcgcagacagagaaguccaucgaggauaacccugaaaucgaggacgauauuuuccgcaagaagcgccugacgaucauggaccuccaucccggagcuggcaaaaccaagcgguaccugccugccauugugagagaagccaucaaacgcgggcuucggacacugauucuggcuccgaccagaguuguggccgcugagauggaagaggcccuccgcggacugcccauccgguaucagaccccugcgauuaaggccgagcacacaggcagagaaaucgucgaccuuaugugucaugcuacguuuaccaugcggcugcucagccccgugcgcguuccuaacuacaaucugaucauuauggaugaggcccacuucacagaccccgcuuccaucgccgccagaggguauauuucuacccggguggaaaugggcgaggcugcgggaaucuuuaugacagccaccccgccuggcagccgcgaucccuucccccaauccaacgcuccuauuauggacgaggaaagagagauccccgaacggagcuggaacucugggcacgagugggucacggauuuuaagggaaaaacagugugguucguuccuuccaucaaggccggcaacgacauugccgcuugccuccgcaagaaugggaagaaagugauccagcugagccgcaagaccuuugauucugaauacgucaagacccgggccaacgacugggauuucguggugacaaccgacauuagcgagaugggagcgaauuuuaaagcugagagagucaucgauccgcgccgguguaugaagcccguuauucuuacagacggcgaagagagagugauccuggccgggccuaugcccgugacccauuccucugccgcucagcgccggggcagaaucggacgcaacccuaaaaaugaaaacgaccaauauauuuacaugggcgagccccuggaaaaugaugaggacugcgcccacuggaaggaggcgaaaaugcuccuggauaacaucaauacgccggaagggauuaucccuagcauguucgagcccgaaagagagaaggucgacgccauugauggagaauaccggcuucgcggcgaggcuagaaaaacauuuguggaccugaugcggcgcggggaucucccuguuuggcuggccuauaagguggcugccgagggaaucaacuacgcugacagaaagugguguuucgauggcauuaaaaauaaccagauccuggaagagaacgucgaaguggagaucuggaccaaggagggggaacggaaaaagcucaaacccagauggcuugacgcccgcauuuauuccgauccucuggcgcugaaggaguucaaggaauuugccgcuggccggaaaucucucacacugaaucuuaucaccgagaugggaagacugcccacguucaugacccagaaggcccgcaacgcucucgacaaucuggccguucugcauacagccgaagcuggcgggcgggcguacaaccacgcccucagcgagcuuccggagacccuggaaacacugcuccugcuuacccugcucgcuacagugaccggaggcauuuuucuguuccugauguccgggaaaggaaucggcaagaugacgcucggcaugugcugcauuaucacagccagcguccuucugugguaugcccagauccaaccucacuggauugcugccucuaucauucuggaguuuuuccucaucgugcugcuuauucccgaacccgagaaacagagaaccccucaggauaaucagcugaccuacgucgugaucgcgauccucacaguuguggccgcuaccauggccaacgaaaugggguuucuggagaagacaaagaaagaccugggacucggcuccauuacgacccaagagccggaaagcaauauccuugacauugaucugcggcccgcuuccgccuggacacuguaugcgguggccaccacauucgucaccccuaugcuccgccauucuaucgagaacagcuccguuaaugugucucugacggcuauugccaaccaggcuaccgugcuuauggggcugggaaagggcuggccccucagcaaaauggacaucggggucccucugcuggccauuggauguuacucccaggugaaucccaucacacucaccgcugcccuucugcugcucguugcgcacuacgccaucauuggcccuggccugcaggcuaaggccacaagagaagcucaaaaacgggccgccgcggggaucaugaagaacccgaccguggauggaauuacggucaucgaccuugagcccauuccuuaugaucccaaguuugaaaaacagcugggccaggugaugcuccugauccugugcgucacacaggugcucaugaugcgcaccacaugggcucuuugugaggcccugacccuggcuaccgggccuaucagcacacucugggagggaaaucccggcagauucuggaacacgaccauugccguuucuauggccaauaucuuucggggguccuaccuggcuggagccggccuucuguucagcauuaugaagaacacaaccaauacacgcagaggcaccgggaacaucggagaaacgcucggcgagaaauggaagucucggcugaacgcgcuggggaaauccgaauuucaaauuuauaagaaaagcggaauccaggagguggaccgcacacucgccaaggagggcaucaagagaggggaaaccgaucaucacgcugucucucggggaagcgccaaacuuagaugguucguggagcgcaauaugguuaccccggaaggcaagguggucgaccugggcugcgggcggggaggcugguccuacuauugugggggacugaaaaacgugagagaggugaagggccucacaaaagggggaccuggccaugaggaacccauucccaugucuaccuacggcuggaaucugguucgccuucagagcggggucgauguguucuuuacaccucccgagaagugcgacacgcugcucugugauaucggagaauccagcccuaacccgaccauugaggcuggccggacacugagagugcugaaucucgucgaaaacuggcuuaauaacaauacccaauucugcaucaagguucugaaccccuauaugccuuccgugauugagaaaauggaaacacugcagcgcaaguacgggggagcccucgugcggaauccccugucuagaaacagcacccacgagauguacugggucuccaaugcgacgggcaacaucgugucuagcguuaauaugaucucccgcaugcuuauuaaccgguuuaccaugaaacacaagaaagccacauaugagccugacguggaucuggggucuggaaccagaaacaucggcauugaaagcgagauccccaaucucgacauuaucggcaagcgcauugaaaagaucaaacaggagcaugaaacauccuggcacuacgaccaggaucauaccuauaagacaugggcuuaccacgggagcuaugagaccaaacaaacgggaucugccuccagcauggucaacggcgugguucggcugcugacaaagccgugggacguggucccuauggugacccagauggcuaugaccgauacaacgcccuucgggcagcagagaguguuuaaagagaaggucgacacccgcacacaagaaccuaaggagggaaccaaaaagcucaugagaaucacagccgaauggcuuuggaaagagcugggcaagaaaaagacaccccggauguguacacgcgaggaguucaccagaaaaguucggucuaaugcugcccugggggcgauuuuuacggaugagaacaaguggaaguccgccagagaagcuguggaggacggacgguucugggaacucguggaucgcgagagaaaucugcaccuugagggcaaaugcgaaaccugugucuacaacaugaugggcaagcgggagaaaaagcugggggaauuuggaaaagccaagggcagccgcgcuaucugguauauguggcucggggccagauuccuggaguuugaagcccugggauuccucaaugaggaccauugguuuucucggggcaacucccugagcgggguggagggcgaaggacuucaccgccugggcuacauucucagagauguugggaagaaagagggaggcgcgauguacgcugacgauacagccgggugggacacccggaucacacuggaagaccuuaagaaugaggaaauggugaccaaccauaugaaaggagagcacaagaaacuggccgaggcuauuuucaagcucacguaucagaauaaggucgugcgcguucagagaccuacaccccggggcaccgugauggauaucaucucccgcagagaccagcgggggagcggccaagucggaacauacggccugaacaccuucacgaauauggaagcccagcugauucgccagauggagggggaaggaaucuuuaaaucuauucaacaucucaccgugacagaggagaucgcuguucagaacuggcuggccagagugggccgggaaagacuuagccgcauggcgauuuccggggaugacugcgucgugaagccgaucgaugaccgguucgccucugcucugaccgcccucaaugauaugggaaaagucagaaaggacauccagcagugggagccuagccgcggcuggaacgauuggacacaagugcccuuuugcucccaccacuuccaugaacugguuaugaaagacgggcgggugcuugucgugcccuguagaaaccaggaugagcugauuggccgcgcucggaucucucagggagccggcuggagccucaaggaaaccgcgugccuggggaaguccuaugcccagauguggacacugauguacuuucacagacgcgaccuccggcuggcugccaaugcuauuuguucugccgugccuagccauuggguuccgaccuccagaacgacauggagcauccacgcuaaacacgaguggaugaccaccgaggauaugcuugccguguggaaccgcgucuggauucaagaaaaucccuggauggaggacaagacaccuguggaaucuugggaggaaguucccuaucugggaaaacgggaggaccaguggugcggcucccucaucgggcugaccagcagagcgacaugggccaagaacauucagacggcuaucaaucaggugcggucucuuaucggaaacgaggaauacaccgauuauaugccuuccaugaaaagauuccgccgggaggaagaggaagccggcguccugugguga

SEQ ID NO: 20308 - RNA, 9876 nt, Artificial Sequence
  derived and/or modified CDS sequence (opt5) from DENV-2__HQ332187__SS-prME
accgccggagugaucauuaugcugauccccacagcuauggccuuccaccucacgaccagaaauggggaaccucauaugauugucggacggcaggaaaagggaaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauagcacaucuaccugggugacguauggaaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugauccugaaaauuguccggaacauggaaaaguaccaacuugcugugaccaucauggccauuucuugcguuccuaaugcggugauccugcgcaacgcuuggaaggucagcuguacaauucucgccgccguguccgugagcccccugcuccugaccucuucccagcagaaagcugacuggaucccucuugcccugacaaucaagggccucaaucccaccgcuauuuuucugacgacacugagcagaaccucuaaaaagcgguccuggccgcuuaacgaggccaucauggcggucgggaugguuagcauucuggccucuucccuccugaaaaaugacaucccuaugaccggaccccucguggcuggcggccugcuuacagugugcuauguccugaccgggcgcagcgccgaucuggaacucgagagagcugccgacgugaagugggaggaucaggccgaaauuuccggaagcucuccuauccugagcauuacaaucuccgaggacggcucuaugagcaucaaaaacgaagaggaggaacaaacgcuuaccauucugauccggacagggcuccugguuauuuccggaguguuccccgucucuaucccgauuaccgcugcggccugguaccucugggaggugaagaagcagcgcgcuggcguucugugggaugugccuucucccccucccgucgggaaagccgaacuugaggacggagccuauagaaucaagcagcggggcauccugggcuacucccagauuggggcuggaguguauaaagaaggcacauuucacaccauguggcaugucacgcgcggggccgugcugaugcacagaggaaagcggaucgagcccuccugggcggauguuaaaaaggaccucauuagcuacggcgggggauggaagcuggagggcgaauggaaagagggcgaagaggugcaaguccuugcucuggaaccugggaagaauccgagagccgugcagaccaaacccggaaucuucaagacaaacaccggcacaauuggggccguuucccucgauuuuagcccuggaaccucuggcucccccaucguggaccgcaaagggaaggucgugggacuguacggcaauggcgugguuacacggagcggggcuuaugucucugccaucgcgcagacggagaaguccauugaggauaacccugaaaucgaggacgauauuuuccgcaagaagcgccucaccaucauggaccugcaucccggagcuggcaaaacaaagcgguaccuuccugugauugugagagaagccaucaaacgcgggcugcggacccugauucucgccccgaccagagucguggcugccgagauggaagaggcucugcgcggacuucccauccgguaucagaccccugccaucaaggcggagcacacgggcagagaaauuguugaccugaugugucaugccaccuucacaaugcggcuccugagccccgugcgcgucccuaacuacaaucucaucauuauggaugaggcucacuuuaccgaccccgccuccaucgcugccagaggguauauuucuacacggguggaaaugggcgaggccgcuggaaucuucaugaccgcgacgccgccuggcagccgcgaucccuuuccccaauccaacgccccuaucauggacgaggaaagagagauucccgaacggagcuggaacucugggcacgaguggguuacagauuucaagggaaaaaccgugugguuugucccuuccaucaaggcuggcaacgacauugccgccugccugcgcaagaaugggaagaaagugauccagcuuagccgcaagaccuucgauucugaauacguuaagacacgggcuaacgacugggauuuuguggucaccacagacauuagcgagaugggagccaauuucaaagcggagagagugaucgauccgcgccgguguaugaagcccgugauccugaccgacggcgaagagagagucauucuggcugggccuaugcccguuacgcauuccucugccgcccagcgccggggcagaaucggacgcaacccuaaaaaugaaaacgaccaauauauuuacaugggcgagccccucgaaaaugaugaggacugcgcucacuggaaggaggccaaaaugcugcuugauaacaucaauacaccggaagggauuaucccuagcauguuugagcccgaaagagagaagguggacgcgauugauggagaauaccggcugcgcggcgaggccagaaaaaccuucguggaccucaugcggcgcggggaucugccugucuggcuggcuuauaagguggccgcugagggaaucaacuacgccgacagaaagugguguuuugauggcaucaaaaauaaccagauucucgaagagaacguugaaguggagaucuggacaaaggagggggaacggaagaaacuuaaacccagauggcuggacgcucgcauuuauuccgauccucuggcccucaaagaguucaaggaguucgcggccggccggaaaucucugacccuuaaucugaucacggagaugggaagacuccccaccuuuaugacacagaaggcucgcaacgcccuggacaaucuggcuguccuccauaccgccgaagccggcgggcgggcuuacaaccacgcgcuuagcgagcugccggagacacuggaaacccuccugcuucugacacuccuggccaccgugacgggaggcauuuuccuguuucucauguccgggaaaggaaucggcaagaugacacuuggcaugugcugcaucauuaccgcuagcguucugcugugguaugcccagauccaaccucacuggauugccgcuucuaucauucucgaguucuuucugaucgugcuucugauccccgaacccgagaaacagagaaccccucaggauaaucagcucacauacgucgugauugccauccugaccgucguggcggccacaauggcuaacgaaaugggguuccuggagaagacgaagaaagaccucggacuuggcuccauuaccacacaagagagcgaauccaauauccuggacauugaucugcggccggccucugcuuggacccucuaugccguugcgacaaccuuugugacgcccaugcugcgccauagcaucgagaacuccucugugaaugucagccuuaccgccauugcuaaccaggccacaguucugauggggcucggaaagggcuggccucuguccaaaauggacaucggggugccccugcucgcuaucggauguuacagccaggugaauccuauuacccuuacagccgcucugcugcuccuggucgcccacuacgcgaucauuggccccggccuucaggccaaggcuaccagagaagcccaaaaacgggcugccgccgggaucaugaagaacccuacgguggauggaauuacaguuaucgaccuggagccgauccccuaugauccuaaguucgaaaaacagcucggccaggugaugcugcugauucucugcgucacccaggugcuuaugaugcgcacaaccugggcgcugugugaggcucugacccucgccacagggcccaucucuacgcugugggagggaaauccuggcagauuuuggaacaccacaauugcugucuccauggccaauaucuuccgggggagcuaccuugccggagcuggccugcucuuuucuauuaugaagaacaccacaaauacccgcagaggcacggggaacaucggagaaacacugggcgagaaauggaagucccggcugaacgcccucgggaaaagcgaguuccaaaucuauaagaaaucuggcauucaggagguggaccgcacccuugcgaaggagggcaucaagagaggggaaaccgaucaucacgccguuagccggggauccgcuaaacugagaugguuuguggagcgcaauauggucacacccgaaggcaaggugguugaccugggcugcgggcggggaggcuggucuuacuauugugggggacucaaaaacgugagagaggucaagggccugaccaaagggggaccgggccaugaagaaccuauucccaugagcacauacggcuggaaucuugugcgccugcaguccgggguggauguuuucuucacgcccccugagaagugcgacacccuccugugugauaucggagaaagcucccccaacccuacaauugaggccggccggacccugagaguccucaaucuuguggaaaacuggcugaauaacaauacacaauuuugcaucaaggugcugaacccguauaugcccucugucaucgagaaaauggaaacccuccagcgcaaguacgggggagcucugguucggaauccucuuagcagaaacuccacgcacgagauguacugggugucuaaugccaccggcaacauugugagcuccgucaauaugaucucucgcaugcugauuaaccgguucacaaugaaacacaagaaagcgaccuaugagcccgacguggaucucgggagcggaacaagaaacaucggcauugaauccgagaucccuaaucuggacauuaucggcaagcgcaucgaaaagauuaaacaggagcaugaaaccagcuggcacuacgaccaggaucaucccuauaagacaugggccuaccacgggucuuaugagaccaaacaaacgggauccgcuagcucuaugguuaacggcgugguccggcugcucacaaagccgugggacgugguuccuauggugacccagauggccaugaccgauacaacgcccuuugggcagcagagagucuucaaagagaagguggacacccgcacacaagaaccuaaggagggaaccaagaaacuuaugagaaucacagcugaauggcuguggaaagagcugggcaaaaagaaaacaccccggauguguacacgcgaggaauuuaccagaaaagugcgguccaaugccgcucucggggccauuuucacggaugagaacaaguggaaaagcgcgagagaagccgucgaggacggacgguuuggcgaacugguugauaaagagcgcaaucuucaccuggagggcaagugcgaaaccuguguguacaacaugauggggaaaagagagaagaaacucggagaguucggcaaggcuaaggggucucgggccaucugguauauguggcugggagcucgcuuucuggaguucgaagcccucggcuuucugaaugaggaccauugguucuccagagggaacagccuuuccggcguggagggagaaggccugcaccggcucggguacauucugcgcgaugucggcaagaaggagggcggggccauguacgcggacgauacagcuggaugggacaccagaaucacacuugaagaccugaaaaaugaggaaauggugaccaaccauaugaagggcgagcacaaaaagcucgccgaggccaucuuuaagcugacguaucagaauaaaguugugcggguccagcgcccuacacccagagggaccgugauggauauuaucagccggcgcgaccagagaggcucuggacaaguuggcacauacgggcugaacaccuucacgaauauggaagcucagcucauucggcagauggagggagaaggcaucuucaagagcauucaacaucugaccgccacagaggagaucgcugugcagaacuggcuugcccgcgucgggagagaacggcuguccagaauggcgaucucuggagaugacugcgugguuaaaccgauugaugaccgcuuugccagcgcucucaccgcccugaaugauaugggcaaggugcggaaagacauccagcagugggagccuuccagaggguggaacgauuggacacaaguccccuucugcucucaccacuuucaugaacuugugaugaaggacggccgcguccuggugguucccugucggaaccaggaugagcucauuggcagagcucgcaucagccagggcgccggguggucccugaaggaaaccgcgugccugggaaaaucuuaugcccagauguggacacucauguacuuccaccggagagaccugcgccuugcugccaaugcuauuuguagcgccgugccuucccauugggucccgaccagccggacgacauggucuauccacgcuaagcacgaguggaugaccaccgaggauaugcuggccguguggaacagaguguggauucaagaaaaucccuggauggaggacaaaacaccuguugaauccugggaggaagugcccuaucucggcaagcgcgaggaccaguggugcgggagccugaucggacuuaccucucgggcgacaugggccaaaaacauccagacggcuauuaaucaggucagaucccugaucggcaacgaggaauacaccgauuauaugccuagcaugaagcgguuuagacgcgaggaagaggaagccggggugcucugguga

SEQ ID NO: 20309 - RNA, 9876 nt, Artificial Sequence
  derived and/or modified CDS sequence (opt5) from DENV-2__HQ332188__SS-prME
acagccggcgugaucguuaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaaggggugaugcaggccggaaagcggucucuuagaccucaacccacggaacucaaauauagcuggaagaccuggggcaaggcgaaaaugcuguccacagagagccauaaccagaccuuccugauugaugggccugaaacaaccgagugccccaauacaaaccgcgccuggaacucucucgaggucgaagacuacggauuuggcguguucaccacgaacaucuggcugaaacuucgggagaaacaggacgucuuuugugauuccaagcugaugagcgcugccauuaaagacaauagagcugugcacgccgauaugggcuauuggaucgaaucugcgcucaacgacacauggaagauggagaaggccuccuucaucgaggucaaaagcugccacuggccuaagucucauacccuguggagcaauggggugcuggaauccgagaugauuauccccaaaaacuucgcuggaccggugagccagcacaacuaccgcccuggcuaucauacccaaauugccgggcccuggcaccuuggaaagcucgaaauggauuuugacuucugugagggcacaaccgucguugugacggaagauugcgggaaucggggacccucucugagaacaaccacagcuuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcccuuuuccucgaagagaugcugagaacgcgcguugggaccaaacacgcuauucugcucguggcggucagcuuugugacacugaucaccggaaauauguccuuccgggaccuuggcagaguuauggugauggucggcgccacaaugaccgaugacaucgggaugggagcuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguucugaaaauugugcggaacauggaaaaguaccaacuugcugucaccaucauggccaucucuugcgugccuaaugcggugauucugcgcaacgcuuggaaggucagcuguacaauccucgccgccguuuccgugagcccccugcuccugaccucuucccagcagaaagcugacuggauuccucuugcccugacaaucaagggccucaaucccaccgcuauuuuucugacgacacugagcagaaccucuaaaaagcgguccuggccgcuuaacgaggccaucauggcgguggggauggucagcauccuggccucuucccuccugaaaaaugacauuccuaugaccggaccccucguggcuggcggccugcuuacaguuugcuaugugcugaccgggcgcagcgccgaucuggaacucgagagagcugccgacgucaagugggaggaucaggccgaaaucuccggaagcucuccuauucugagcaucacaauuuccgaggacggcucuaugagcaucaaaaacgaagaggaggaacaaacgcuuaccauucugauccggacagggcuccuggugaucuccggaguuuuccccgugucuauuccgaucaccgcugcggccugguaccucugggaggucaagaagcagcgcgcuggcgugcugugggaugucccuucucccccucccguggggaaagccgaacuugaggacggagccuauagaauuaagcagcggggcauccugggcuacucccagauuggggcuggaguuuauaaagaaggcacauuucacaccauguggcaugugacgcgcggggccguccugaugcacagaggaaagcggaucgagcccuccugggcggaugugaaaaaggaccucaucagcuacggcgggggauggaagcuggagggcgaauggaaagagggcgaagagauucaaguucuugcucuggaaccugggaagaauccgagagccgugcagaccaaacccggaaucuucaagacaaacaccggcacaauuggggccgucucccucgauuuuagcccuggaaccucuggcucccccaucguggaccgcaaagggaaggugguuggacuguacggcaauggcgucgugacacggagcggggcuuaugugucugccauugcgcagacggagaaguccaucgaggauaacccugaaaucgaggacgauauuuuccgcaagaagcgccucaccaucauggaccugcaucccggagcuggcaaaacaaagcgguaccuuccugccauugucagagaagccaucaaacgcgggcugcggacccugauucucgcuccgaccagagugguugccgcugagauggaagaggcccugcgcggacuucccauccgguaucagaccccugcgauuaaggccgagcacacgggcagagaaaucguggaccugaugugucaugcuaccuucacaaugcggcuccugagccccguccgcgugccuaacuacaaucucaucauuauggaugaggcccacuuuaccgaccccgcuuccaucgccgccagaggguauauuucuacacggguugaaaugggcgaggcugcgggaaucuucaugaccgccacgccgccuggcagccgcgaucccuuuccccaauccaacgcuccuauuauggacgaggaaagagagauccccgaacggagcuggaacucugggcacgagugggugacagauuucaagggaaaaaccgucugguuugugccuuccaucaaggccggcaacgacauugccgcuugccugcgcaagaaugggaagaaaguuauccagcuuagccgcaagaccuucgauucugaauacgugaagacacgggccaacgacugggauuuugucgugaccacagacauuagcgagaugggagcgaauuucaaagcugagagagugaucgauccgcgccgguguaugaagcccgucauucugaccgacggcgaagagagaguuauccuggccgggccuaugcccgugacgcauuccucugccgcucagcgccggggcagaaucggacgcaacccuaaaaaugaaaacgaccaauauauuuacaugggcgagccccucgaaaaugaugaggacugcgcccacuggaaggaggcgaaaaugcugcuugauaacaucaauacaccggaagggauuaucccuagcauguuugagcccgaaagagagaagguggacgccauugauggagaauaccggcugcgcggcgaggcuagaaaaaccuucgucgaccucaugcggcgcggggaucugccuguguggcuggccuauaagguugcugccgagggaaucaacuacgcugacagaaagugguguuuugauggcauuaaaaauaaccagauccucgaagagaacguggaagucgagaucuggacaaaggagggggaacggaagaaacuuaaacccagauggcuggacgcccgcauuuauuccgauccucuggcgcucaaagaguucaaggaguucgccgcuggccggaaaucucugacccuuaaucugaucacggagaugggaagacuccccaccuuuaugacacagaaggcccgcaacgcucuggacaaucuggccgugcuccauaccgccgaagcuggcgggcgggcguacaaccacgcccuuagcgagcugccggagacacuggaaacccuccugcuucugacacuccuggcuaccguuacgggaggcauuuuccuguuucucauguccgggaaaggaaucggcaagaugacacuuggcaugugcugcauuaucaccgccagcgugcugcugugguaugcccagauccaaccucacuggauugcugccucuaucauucucgaguucuuucugaucguccuucugauucccgaacccgagaaacagagaaccccucaggauaaucagcucacauacguggucaucgcgauccugaccgugguugccgcuacaauggccaacgaaaugggguuccuggagaagacgaagaaagaccucggacuuggcuccauuaccacacaagagccggaaagcaauauccuggacauugaucugcggcccgcuuccgccuggacccucuaugcgguggccacaaccuuugugacgccuaugcugcgccauucuaucgagaacagcuccgucaauguuucucuuaccgcuauugccaaccaggcuacagugcugauggggcucggaaagggcuggccccugagcaaaauggacaucggggugccucugcucgccauuggauguuacucccaggucaaucccaucacccuuacagcugcccugcugcuccugguggcgcacuacgccaucauuggcccuggccuucaggcuaaggccaccagagaagcucaaaaacgggccgccgcggggaucaugaagaacccgacgguugauggaauuacagugaucgaccuggagcccauuccuuaugaucccaaguucgaaaaacagcucggccaggucaugcugcugauccucugcgugacccagguccuuaugaugcgcacaaccugggcucugugugaggcccugacccucgcuacagggccuaucagcacgcugugggagggaaaucccggcagauuuuggaacaccacaauugccgugucuauggccaauaucuuccggggguccuaccuugcuggagccggccugcucuuuagcauuaugaagaacaccacaaauacccgcagaggcacggggaacaucggagaaacacugggcgagaaauggaagucucggcugaacgcgcucgggaaauccgaguuccaaauuuauaagaaaagcggaauccaggagguugaccgcacccuugccaaggagggcaucaagagaggggaaaccgaucaucacgcugugucucggggaagcgccaaacugagaugguuugucgagcgcaauauggugacaccggaaggcaagguuguggaccugggcugcgggcggggaggcugguccuacuauugugggggacucaaaaacgucagagaggugaagggccugaccaaagggggaccuggccaugaagaacccauucccaugucuacauacggcuggaaucuugugcgccugcagagcgggguugaugucuucuucacgccucccgagaagugcgacacccuccugugugauaucggagaauccagcccuaacccgacaauugaggcuggccggacccugagagugcucaaucuuguggaaaacuggcugaauaacaauacacaauuuugcaucaagguccugaaccccuauaugccuuccguuauugagaaaauggaaacccuccagcgcaaguacgggggagcccuggugcggaauccccuuucuagaaacagcacgcacgagauguacuggguguccaaugcgaccggcaacaucgucucuagcgugaauaugaucucccgcaugcugauuaaccgguucacaaugaaacacaagaaagccaccuaugagccugacguugaucucgggucuggaacaagaaacaucggcauugaaagcgagauccccaaucuggacauuaucggcaagcgcauugaaaagaucaaacaggagcaugaaaccuccuggcacuacgaccaggaucauccguauaagacaugggcuuaccacgggagcuaugagaccaaacaaacgggaucugccuccagcauggugaacggcgucgugcggcugcucacaaagccuugggacguugugcccauggucacccagauggcuaugaccgauacaacgccuuuugggcagcagagaguguucaaagagaagguggacacccgcacacaagaacccaaggagggaaccaagaaacuuaugagaaucacagccgaauggcuguggaaagagcugggcaaaaagaaaaccccucggauguguacacgcgaggaauuuaccagaaaaguccggucuaaugcugcccucggggcgauuuucacggaugagaacaaguggaaguccgccagagaagcuguugaggacggacgguuuugggaacugguggaucgcgagagaaaucuucaccuggagggcaaaugcgaaaccuguguguacaacaugaugggcaagcgggagaaaaagcucggggaguucggaaaagccaagggcagccgcgcuaucugguauauguggcugggggccagauuucuggaguucgaagcccucggauuucugaaugaggaccauugguucucucggggcaacucccuuagcggggucgagggcgaaggacugcaccgccucggcuacauucugagagauguggggaagaaagagggaggcgcgauguacgcugacgauacagccgggugggacacccggaucacacuugaagaccugaagaaugaggaaaugguuaccaaccauaugaaaggagagcacaagaaacucgccgaggcuauuuuuaagcugacguaucagaauaaggugguccgcgugcagagacccacaccgcggggcaccguuauggauaucaucucccgcagagaccagcgggggagcggccaagugggaacauacggccugaacaccuucacgaauauggaagcccagcucauucgccagauggagggggaaggaaucuucaaaucuauucaacaucugaccgucacagaggagaucgcugugcagaacuggcuugccagaguuggccgggaaagacugagccgcauggcgauuuccggggaugacugcguggucaagccuaucgaugaccgguuugccucugcucucaccgcccugaaugauaugggaaaagugagaaaggacauccagcagugggagcccagccgcggcuggaacgauuggacacaaguccccuucugcucccaccacuuucaugaacuugugaugaaagacgggcggguucugguggucccuuguagaaaccaggaugagcucauuggccgcgcucggaucucucagggagccggcuggagccugaaggaaaccgcgugccuggggaaguccuaugcccagauguggacacucauguacuuccacagacgcgaccugcggcuugcugccaaugcuauuuguucugccgugccgagccauugggugcccaccuccagaacgacauggagcauccacgcuaaacacgaguggaugaccaccgaggauaugcuggccguuuggaaccgcguguggauucaagaaaauccuuggauggaggacaagacacccgucgaaucuugggaggaagugccuuaucucggaaaacgggaggaccaguggugcggcucccugaucgggcuuaccagcagagcgacaugggccaagaacauucagacggcuaucaaucagguucggucucugaucggaaacgaggaauacaccgauuauaugcccuccaugaaaagauuucgccgggaggaagaggaagccggcgugcucugguga

SEQ ID NO: 20310 - RNA, 9876 nt, Artificial Sequence
  derived and/or modified CDS sequence (opt5) from DENV-2__HQ332189__SS-prME
accgccggcgugaucgucaugcugauucccaccgcuauggccuuccaccucacgaccagaaacggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaacuggauccugcgccaucccggguucaccauuauggccgcuauccucgccuacacaauuggaaccacccacuuucagagagcucugaucuucauucuucugacagccgucgcgccuagcaugacgaugcggugcaucggcauuuccaaucgcgauuuuguggaagggguuucuggaggcagcuggguggacaucguccucgagcacggguccugugugaccacaauggccaagaacaagcccacccuggauuucgaacuuaucaaaacagaggcuaagcagccugccacccugagaaaauauugcauugaagcuaagcucacgaauacaaccaccgagagccgguguccgacacaaggagagcccucucugaacgaagaacaggacaaacgcuuuaucugcaagcauuccaugguggauagaggcuggggcaauggguguggacuguucggcaaaggcgggauuguuaccugcgccauguuuacaugcaaaaagaacauggaagggaaaguugugcagccugagaaucucgaauacacgaucgugauuacaccccacagcggggaggagcaugcggucggaaacgacacaggcaagcacggcaaagaaaucaagaucaccccucagucuuccauuacagaggccgaacugaccggguauggaacggugaccauggaguguagcccccggacaggccuugauuucaaugaaaugguucugcuccaaauggaggacaaggcuuggcuggugcaccgccagugguuucuugaucugccgcucccuuggcugcccggggccgacacccagggaucuaacuggauccagaaggagacacuggucaccuucaagaauccucaugcuaaaaagcaagacgugguugugcucggcucccaggaaggggccaugcacacggcccugacaggcgcuaccgagauucagaugagcuccggaaaccuucuguuuacaggccaucucaaaugcagacugcggauggauaaacuucaacugaaagggaugucuuacagcauguguaccggaaaguucaagaucgucaaagaaauugcggagacccagcacggcacaaucgugaucagaguccaguaugagggggacggaucccccugcaagauucccuucgaaaucacggaucucgagaaacgccaugugcugggccggcugauuaccguuaacccuaucgugauugaaaaggacagcccggucaauaucgaggccgaacccccuuuuggggauucuuacgugauuaucggcguugagcccggacagcucaaacugaacugguucaagaagggcuccagcaucgggcaaauguuugagacaaccaugagaggagcuaaacgcauggccauucuuggcgacacagccugggauuucgggucucugggaggcguguuuaccagcaucgggaaggcucuccaccaggucuucggcgccauuuacggagcggcuuuuuccggcgugucuuggacgaugaaaauccugauuggggugguuaucacauggaucggaaugaauagccgguccaccagccugucugucucccuugugcucgugggcgucgugacccuguaucugggggccaugguucaggccgacagcggauguguggucucuuggaagaacaaagaacucaagugcggcuccgggauuuucaucacagauaaugugcacaccuggacagagcaguacaaguuucaaccugaaagccccuccaaacuggcuucugccauucagaaggcucaugaggaaggcaucuguggaauuagaagcguuacgcgccuugagaaccugauguggaaacagaucaccccggagcucaaucacauccuguccgaaaacgaggugaagcugacaauuaugaccggcgacacaaaagggaucaugcaggccggaaagcggucucuuagaccucaacccaccgaacucaaauauagcuggaagacguggggcaaggcgaaaaugcuguccaccgagagccauaaucagacauuccugauugaugggccugaaaccgccgagugccccaacacaaaucgcgcuuggaacucucucgaggucgaagacuacggauuuggcguguucaccacaaauaucuggcugaaacuucgggagaaacaggacgucuuuugugauuccaagcugaugagcgccgcuauuaaagacaacagagccgugcacgcggauaugggcuauuggaucgaaucugcccucaaugacaccuggaagauggagaaggcuuccuucaucgaggucaaaagcugccacuggccuaagucucauacgcuguggagcaacggggugcuggaauccgagaugauuauccccaaaaacuucgccggaccggugagccagcacaauuaccgcccuggcuaucauacacaaaccgcugggcccuggcaccuuggaaagcucgaaauggauuuugacuucugugagggcaccacagucguugugaccgaagauugcgggaaccggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaucuggugaacucccucgucacagccggccaugggcagauugauaauuuuucucugggagugcugggcauggcucuuuuccucgaagagaugcugagaacccgcguugggacgaaacacgcgauccugcucguggccgucagcuuugugacccugauuacaggaaacauguccuuccgggaccuuggcagaguuauggugauggucggcgcuaccaugacagaugacaucgggaugggagugaccuaucuggcccuccuggccgcuuuuaagguucgcccuacguucgccgcgggccugcuucugagaaaacucacaucuaaggagcugaugauggcuaccaucgggauuacacuccugagccaguccaccauccccgaaaccauucuugagcugacagaugcccucgcccugggaaugauggugcugaaaaucguccggaauauggaaaaguaccaacuugcugugacgauuauggccaucucuugcgugccuaacgcggucauccugcgcaaugcuuggaagguuagcuguaccauucucgccgccguguccgugagcccccugcuccugacaucuucccagcagaaagcugacuggaucccucuugcccugaccauuaagggccucaaccccacagcuaucuuucugaccacgcugagcagaacaucuaaaaagcgguccuggccgcuuaaugaggccauuauggcggucgggauggugagcauccuggccucuucccuccugaaaaacgacaucccuaugaccggaccccucguugcuggcggccugcuuaccgugugcuauguccugacagggcgcagcgccgaucuggaacucgagagagcugccgacgugaagugggaggaucaggccgaaauuuccggaagcucuccuauccugagcauuaccaucuccgaggacggcucuaugagcauuaaaaaugaagaggaggaacaaacacuuacgauccugauucggaccgggcuccugguuaucuccggaguguuccccgucucuaucccgauuacagcugcggccugguaccucugggaggugaagaagcagcgcgcuggcguccugugggaugugccuucucccccucccguugggaaagccgaacuugaggacggagccuauagaaucaagcagcggggcauucugggcuacucccagaucggggcuggaguguauaaagaaggcaccuuucacacaauguggcaugucacccgcggggccgugcugaugcacagaggaaagcggauugagcccuccugggcggauguuaaaaaggaccucaucagcuacggcgggggauggaagcuggagggcgaauggaaagagggcgaagaggugcaaguccuugcucuggaaccugggaagaacccgagagccgugcagacgaaacccggaaucuucaagaccaauacaggcaccauuggggccgugucccucgauuuuagcccuggaacaucuggcucccccaucguugaccgcaaagggaaggucgugggacuguacggcaacggcguggucacccggagcggggcuuaugugucugccauugcgcagacagagaaguccaucgaggauaacccugaaauugaggacgauaucuuccgcaagaagcgccucacgaucauggaccugcaucccggagcuggcaaaaccaagcgguaccuuccugccauuguuagagaagccaucaaacgcgggcugcggacacugauucucgcuccgaccagaguggucgccgcugagauggaagaggcccugcgcggacuucccauccgguaucagaccccugcgauuaaggccgagcacacaggcagagaaaucguggaccugaugugucaugcuacguucaccaugcggcuccugagccccguucgcgugccuaauuacaaccucauuaucauggaugaggcccacuuuacagaccccgcuuccaucgccgccagaggguauauuucuacccgggucgaaaugggcgaggcugcgggaaucuucaugacagccaccccgccuggcagccgcgaucccuuuccccaauccaaugcuccuauuauggacgaggaaagagagauccccgaacggagcuggaacucugggcacgagugggugacggauuucaagggaaaaacaguuugguuugugccuuccauuaaggccggcaaugacaucgccgcuugccugcgcaagaacgggaagaaagucauccagcuuagccgcaagaccuucgauucugaauacgugaagacccgggccaaugacugggauuuuguggucacaaccgacauuagcgagaugggagcgaacuucaaagcugagagaguuaucgauccgcgccgguguaugaagcccgugauucugacagacggcgaagagagagugauccuggccgggccuaugcccgucacccauuccucugccgcucagcgccggggcagaauuggacgcaauccuaaaaacgaaaaugaccaauauaucuacaugggcgagccccucgaaaacgaugaggacugcgcccacuggaaggaggcgaaaaugcugcuugauaauaucaacacgccggaagggauuaucccuagcauguuugagcccgaaagagagaagguggacgccauugauggagaauaccggcugcgcggcgaggcuagaaaaacauucguugaccucaugcggcgcggggaucugccuguguggcuggccuauaaggucgcugccgagggaaucaauuacgcugacagaaagugguguuuugauggcauuaaaaacaaccagauccucgaagagaauguggaaguugagauuuggaccaaggagggggaacggaagaaacuuaaacccagauggcuggacgcccgcaucuauuccgauccucuggcgcucaaagaguucaaggaguucgccgcuggccggaaaucucugacacuuaaccugaucaccgagaugggaagacuccccacguuuaugacccagaaggcccgcaaugcucuggacaaccuggccgugcuccauacagccgaagcuggcgggcgggcguacaaucacgcccuuagcgagcugccggagacccuggaaacacuccugcuucugacccuccuggcuacagucaccggaggcauuuuccuguuucucauguccgggaaaggaaucggcaagaugacgcuuggcaugugcugcauuaucacagccagcgugcugcugugguaugcccagauucaaccucacuggaucgcugccucuaucauucucgaguucuuucugaucguccuucugauucccgaacccgagaaacagagaaccccucaggauaaccagcucaccuacgugguuaucgcgauucugacagugguggccgcuaccauggccaaugaaaugggguuccuggagaagacaaagaaagaccucggacuuggcuccaucacgacccaagagagcgaauccaacauccuggacauugaucugcggccggcuucugccuggacacucuaugcggucgccaccacauuuguuacccccaugcugcgccauagcaucgaaaauagcucugugaacgugagccuuacggcuauugccaaucaggcuaccguccugauggggcucggaaagggcuggccucuguccaaaauggacaucggggugccccugcucgccauuggauguuacagccagguuaacccuaucacacuuaccgcugcccugcugcuccugguggcgcacuacgccauuaucggccccggccuucaggcuaaggccacaagagaagcucaaaaacgggccgccgcggggaucaugaagaauccuaccgucgauggaauuacggugaucgaccuggagccgauucccuaugauccuaaguucgaaaaacagcucggccaggucaugcugcugauccucugcgugacacagguucuuaugaugcgcaccacaugggcucugugugaggcccugacccucgcuaccgggcccauuucuacacugugggagggaaacccuggcagauuuuggaauacgaccaucgccguguccauggccaacaucuuccgggggagcuaccuugcuggagccggccugcucuuuucuauuaugaagaauacaaccaacacacgcagaggcaccgggaacaucggagaaacgcugggcgagaaauggaagucccggcugaaugcgcucgggaaaagcgaguuccaaauuuauaagaaaucuggaauccaggaggucgaccgcacacuugccaaggagggcauuaagagaggggaaaccgaucaucacgcugugagccggggauccgccaaacugagaugguuuguugagcgcaacauggugacccccgaaggcaaggucguggaccugggcugcgggcggggaggcuggucuuacuauugugggggacucaaaaaugugagagagguuaagggccugacaaaagggggaccgggccaugaagaaccuauccccaugagcaccuacggcuggaaccuuguccgccugcaguccgggguggauguguucuucacacccccugagaagugcgacacgcuccugugugauaucggagaaagcucccccucuccuaccauugaggcuggccggacacugagaguccucaaucuuguugaagacuggcugaacaauaacacccaauuuugcaucaaggugcugaauccguauaugcccagcgugauugagaaaauggaaacacuccagcgcaaguacgggggagcccugguccggaacccucuuuccagaaauucuacccacgagauguacugggugagcaacgcgacgggcaauaucguuuccucugugaacaugauuagccgcaugcugaucaaucgguucaccaugaaacacaagaaagccacauaugagcccgaugucgaccucggguccggaaccagaaacaucggcauugaaagcgagaucccuaaccuggacauuaucggcaagcgcauugaaaagaucaaacaggagcaugaaacaucuuggcacuacgaucaggaccauaccuauaagacaugggcuuaccacggguccuaugagaccaaacaaacgggaagcgccucuuccauggugaauggcguugugcggcugcucacaaagcccugggaugucgugccgauggugacccagauggcuaugaccgacacaacgccuuuugggcagcagagagucuucaaagagaagguugauacccgcacacaagaacccaaggagggaaccaagaaacuuaugagaauuacagccgaauggcuguggaaagagcugggcaaaaagaaaaccccucggauguguacacgcgaggaauuuaccagaaaagugcggagcaacgcugcccucggggcgaucuucacggacgagaauaaguggaagucugccagagaagcuguggaggauggacgguuuugggaacuggucgaccgcgagagaaaccuucaccuggagggcaaaugcgaaaccuguguguacaauaugaugggcaagcgggagaaaaagcucggggaguucggaaaagccaagggcucccgcgcuaucugguauauguggcugggggccagauuucuggaguucgaagcccucggauuucugaacgaggaucauugguucagccggggcaauucccuuagcgggguugagggcgaaggacugcaccgccucggcuacauucugagagacguggggaagaaagagggaggcgcgauguacgcugaugacacagccgggugggacacccggaucacacuugaagaucugaagaacgaggaaauggucaccaaucauaugaaaggagagcacaagaaacucgccgaggcuauuuuuaagcugacguaucagaacaaggugguucgcgugcagagacccacaccucggggcaccgucauggacaucauuucucgcagagaucagcgggggagcggccaagugggaacauacggccugaauaccuucacgaacauggaagcccagcucauccgccagauggagggggaaggaaucuucaaauccauucaacaucugaccgcuacagaggagaucgccguucagaauuggcuugcgagagugggccgggaaagacugucucgcauggccauuagcggggacgauugcgucgugaagcccaucgacgaucgguuugcuuccgcccucaccgcucugaacgacaugggaaaagucagaaaggauauucagcagugggagccgucucgcggcuggaaugacuggacacaagugccuuucugcagccaccacuuucaugaacuuguuaugaaagaugggcgggugcuggucgugcccuguagaaaccaggacgagcucaucggccgcgcccggaucucccagggagcgggcuggucucugaaggaaaccgccugccugggaaagagcuaugcucagauguggacacucauguacuuccacagacgcgaucugcggcuugccgcuaacgccauuuguuccgcugugcccagccauuggguuccuaccucuagaacgacaugguccauccacgccaaacacgaguggaugaccaccgaggacaugcuggcgguguggaaucgcgucuggauucaagaaaacccguggauggaggacaagacacccguggaaagcugggaggaaguuccuuaucucggaaaacgggaggaucaguggugcggcucucugaucgggcuuaccuccagagccacaugggcuaagaauauucagacggccaucaaccaggugcggagccugauuggaaaugaggaauacaccgacuauaugcccuccaugaaaagauuucgccgggaggaagaggaagccggcguccucugguga

SEQ ID NO: 20311 - RNA, 9876 nt, Artificial Sequence
  derived and/or modified CDS sequence (opt5) from DENV-2__JN368476__SS-prME
uccgcuggaaugaucauuaugcugauccccacagugauggcuuuccaccucacaacgagaaacggggagccucauaugauugucgggauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggaguccaaggcuuggcuggugcaccggcagugguuucuugaccugccgcucccuuggcugcccggggccgauaagcagggaagcaacuggauucagaaagagacccuggucacauucaagaauccucaugcuaaaaagcaagacgugguugugcucggcucccaggaaggggccaugcacaccgcccugacgggcgcuacagagauccagaugucuagcggaaaccuucuguuuaccggccaucucaaaugccgccugagaauggacaaacuucaacugaaggggauguccuacagcauguguacaggaaaauucaaggucgugaaagaaauugcggagacccagcacggcaccaucgucauucgggugcaguaugagggggauggaucucccugcaagauccccuucgaaaucauggaccucgagaaaagauacguucugggccgccugauuacagugaauccuaucgucacggaaaaggauuccccggugaacauugaggccgaacccccuuuuggggacagcuacaucauuaucggcguugagcccggacagcucaagcugaacugguucaaaaagggcucuagcauugggcaaauguuugagaccacaaugcggggagcuaaaagaauggccauccuuggcgauaccgccugggacuucgggucccugggaggcguguuuacaucuaucgggaaggcucuccaucaggucuucggcgccauuuauggagcggcuuuuagcggcguguccuggaccaugaaaauccugauuggggugaucauuacguggaucggaaugaauagccgcucuacaucccugagcguuucucuuguccucgugggcaucgugacccuguaccugggggucauggugcaggccgauuccggauguguugugagcuggaagaacaaggaacucaaaugcggcuccgggauuuucaucaccgacaauguccacacauggaccgagcaguauaaguuucaaccugaaucucccagcaaacuggccuccgcuauucagaaggcccaggaggaaggcaucuguggcauucggucugugacaagacuugagaaccugauguggaaacagaucacgccggagcucaaucacauccuggcugaaaacgagguuaagcugaccauuaugacaggcgauaucaaagggauuaugcaagccggaaagcgcagccuucggccucagcccaccgaacucaaguacuccuggaaaacauggggcaaggcgaaaaugcugagcaccgagucucauaaucagacguuccugaucgacgggccugaaaccgccgagugccccaacacaaauagagcuuggaacucccucgagguggaagauuauggauuuggcgucuucaccacaaauauuuggcugaaacuuaaagagaagcaggacgccuuuugugacagcaagcugaugucugcugccaucaaagauaaccgcgcggugcacgccgacaugggcuacuggaucgaauccgcucucaaugauaccuggaagauugagaaagccagcuucaucgagguuaagaacugccauuggccuaaaucucacacacuguggagcaauggggugcuggaauccgagaugauuauccccaagaaccuugcuggaccggucagccaacacaacuaucggccuggcuaccauacccagacggccgggcccuggcaccucggaaagcuggaaauggacuucgauuuuugugacggcacaaccgugauugugaccgaggauugcgggaauagaggacccucucugcgcacaaccacggccuccggcaaacucaucacagaauggugcugucggagcugcacccugccuccgcuuagauaccggggcgaggacggguguugguauggaauggagauucgcccccugaaggaaaaagaggaaaaccucgucaauucccugguuacagcuggccauggacagguggauaacuucucucugggagugcuuggcauggcgcucuuucuggaggaaaugcugagaacccgggucgggacaaagcacgccauccuccugguggcuguuagcuucgugacccuuaucacgggaaauauguccuuuaaagaccugggcagagucgugguuauggugggcaccacaaugaccgaugacauugggaugggagucacauaccucgcccugcuggccgcuuucaaggugcgcccuaccuuugccgcgggccuucugcuccggaagcugacgucuaaagagcucaugaugacaaccaucgggauuguucugcuuagccaauccacaauccccgagaccauucuggaacucaccgaugcucuggcccugggaaugauggugcuuaagaucgucagagacauggagaaauaucagcuggccgugacaaucauggcuauucucugcgugccuaacgccgucauccugcagaaugcguggaagguuucuuguacgauucucgcuguggugagcgucagcccccugcuucugaccagcucucagcagaagacagacuggaucccucucgcccugaccauuaagggccugaaccccacagccaucuuccuuaccacgcugucccgcacaaauaaaaagagaagcuggccgcucaacgaagcuaucauggccguggggaugguuucuauucuggcuuccagccuccugaagaaugauaucccuaugaccggaccccuuguggccggcggccugcugaccgucugcuacgugcucacagggcggucugcggaccuggagcuugaacgcgccaccgauguuaaaugggaggaccaggcugagauuuccggaagcuccccuauccugagcauuacaaucucugaagauggcagcauguccauuaagaacgaggaagaggagcagacgcucaccauccugaucagaacagggcuccuggugauuucuggacuuuuucccgucagcaucccgauuaccgccgcugccugguaucugugggaagugaaaaagcagcgggccggcguccugugggacgugccuucucccccucccauggggaaagcugagcucgaagauggagcguaccgcaucaagcaaaagggcauucugggcuauagccagaucggggccggaguuuacaaagagggcacauuccauaccauguggcacgugacgagaggggcuguccuuaugcacaagggaaaacggaucgaacccagcugggccgacgugaagaaagaucugauuuccuacggcgggggauggaagcucgagggcgaguggaaggaaggcgaggaaguucaggugcuggcccucgagccugggaaaaauccgcgcgcuguccagaccaagcccggacuguuuaaaacaaacaccggcacaaucggggccgugucucuugacuucagcccuggaaccuccggcagccccauuaucgauaagaaagggaaggugguuggacuguauggcaauggcgucgugacaagaucuggggcguacguguccgcuauugcccaaacggaaaagagcaucgaggacaacccugagaucgaagaugacauuuuucggaaacgcagacugaccaucauggaccuccaucccggagccggcaagacaaaacgguaucugccugcuauugucagagaggccaucaagcgcgggcuucggacccugauucucgcgccgaccagagugguugcugccgaaauggaggaagcccugcgcggacuccccauccgguaccagaccccugcuauuagagccgagcacacgggccgcgagaucguggaucugaugugucaugcuaccuucacaaugcggcuucugucucccgucagagugccuaacuauaaucugaucauuauggacgaagcccacuucaccgaucccgcguccaucgccgcucgcggguacauuagcacacggguugagaugggcgaagccgcuggaaucuuuaugaccgccacgccgccuggcuccagagaccccuucccccagucuaacgccccuauuaucgaugaggagcgggaaauccccgagcgcagcuggaauacagggcaugaaugggugaccgacuuuaaaggaaagaccgucugguucgugccuuccauuaaggcuggcaacgauaucgcggccugccuccgcaagaaugggaagaaaguuauucaacugagccggaagacauuugacucugaguaugugaaaacccgcacaaacgauugggacuucgucgugaccacggauaucuccgaaaugggagcuaauuuuaaggccgagagagugauugacccgcggagauguaugaaacccgucauccuuacagacggcgaggaacgcguuauccuggccgggccuaugcccgugacccacagcucugcugcccagcggagaggccgcauuggacggaacccuaagaaugagaacgaucaguacaucuacaugggcgaaccccucgagaaugacgaagauugcgcgcacuggaaggaggcuaaaaugcugcuggacaacauuaauacaccggaggggaucauuccuagcauguucgaacccgagagagaaaagguggaugccaucgacggagaguaucgccuccggggcgaagccagaaaaaccuuugucgaucuuaugcgcagaggggaccugccuguguggcuggcuuacaagguugccgcggagggaauuaacuaugccgaucggcgcugguguuucgacggcaucaaaaauaaccagauccucgaggaaaacguggaggucgaaauuuggacgaaggagggggagagaaagaaacugaagccccgguggcuugaugcucgcaucuacuccgacccucuggcccucaaagaauuuaaggaguucgcugccggcagaaaaucucugacccugaaucucauuacagaaaugggacggcuucccaccuucaugacacaaaagaccagagaugcucuggacaaccuggccgugcuccauacagcggaggccggcgggcgcgcuuauaaucacgcccugagcgaacuuccggagacccuggagacgcuccugcugcucacacuucuggcuaccguuaccggaggcaucuuucuguuccucauguccgggcggggaauuggcaagaugacacugggcaugugcugcaucaucaccgccucugugcuucugugguacgcccagauucagccucauuggaucgcugcgagcauuauccucgaauuuuuccugauuguccugcucauccccgagcccgaaaaacagagaacaccucaagacaaccagcuuacguauguggucaucgccauucugaccgugguugcugccacaauggccaaugagaugggguuucuggaaaagaccaaaaaggaucucggacugggcuccaucgcuacacagcagccggagagcaacauucuugacaucgaucugcgccccgccucugcguggacccucuacgccguggcuacgaccuucgugacaccuaugcugcggcacuccauugagaauagcuccgucaacguuucucugaccgccaucgcuaaucaagccacagugcucauggggcuuggaaaaggcuggccccugagcaagauggacauuggggugccucugcucgcgaucggauguuacucccaggucaaccccaucacccugacggccgcccuucugcuccugguggcccacuaugcuauuaucggcccuggccugcaggccaaggcuacaagagaagcccagaaacgggcggccgcugggauuaugaagaauccgaccguugauggaaucacagugauugaccucgaucccaucccuuacgaccccaaauuugagaagcaacuuggccaggucaugcugcugauccucugcgugacccagguccugaugaugcgcaccacaugggcccuuugugaagcucugacgcucgccaccgggccuauuucuacacugugggagggaaaccccggcagauucuggaauaccacaaucgccgugagcauggcgaacauuuuucggggguccuaucuggcuggagccggccuccuuuucagcaucaugaaaaauaccacgaacacacgcagaggcaccgggaauauuggagaaacccugggcgagaaguggaaaucucggcugaacgcucucgggaaguccgaguuucaaacauacaagaaaagcggaauccaggaaguugaucgcacccuggccaaggagggcaucaaaagaggggaaacagaccaucacgccgugucucggggauccgcuaaacuucgcugguucgucgagagaaacauggugacgccggagggcaaaguuguggaucugggcugcgggcggggaggcuggagcuauuacugugggggacucaagaaugucagagaagugaagggccugaccaaagggggaccuggccaugaggaacccauucccaugucuacauauggcuggaaccuggugcgccuccagagcgggguugacgucuuuuucaucccucccgagaagugcgauacccuucugugugacauuggagaauccucuccuaauccgacaguggaggccggccggacccugagagugcucaaccuggucgagaauuggcuuaacaauaacacgcaguucugcaucaaaguucugaaucccuacaugccuagcgugauugaaaagauggaggcgcuccaacgcaaauacgggggagcccuggugcggaacccccuguccagaaauagcacccacgaaauguauugggucuccaacgcuucuggcaauaucgugagcuccguuaacaugaucucucgcaugcucauuaaucgguuuacaaugagacauaagaaggccaccuacgagccugacguggaucuugggagcggaacacgcaacaucggcauugaauccgagauccccaaccuggacauuaucggcaaacggauugagaagaucaaagaggagcacgaaaccucuuggcacuaugaucaggaccauccguacaagacaugggcuuaucacgggagcuacgagaccaaacagacgggauccgccagcucuauggucaauggcgugguuagacugcucacaaagccuugggaugugcugcccaccgucacccagauggcgaugacagacacgaccccuuucgggcaacagcgcguguuuaaggaaaaaguggauacacggacccaggagcccaaggagggaaccaagaaacuuaugaaaaucaccgccgaauggcuguggaaggagcucggcaaaaagaagacaccuagaauguguacccgcgaagaguucacgagaaaaguccgguccaacgcugcccugggggcuauuuuuaccgacgagaauaaguggaaaagcgcccgcgaagcuguugaggauucuagauucugggaacugguggacaaggagcggaaccuccaucuggaaggaaaaugcgagacauguguguauaauaugaugggcaagagagagaagaaacuuggcgaauuugggaaggccaaaggaucccgggcgaucugguacauguggcugggcgcccgcuuccucgaguuugaagcucugggguuccuuaacgaggaucacugguuuagcagagaaaauucucuguccggagucgagggcgaggggcuccacaagcugggcuacauucugcgggacgugagcaaaaaggaaggaggcgccauguaugcugacgauaccgccgggugggacacacgcaucacccucgaggaucugaagaacgaagagaugguuacgaaucauauggaaggagagcacaagaaacuugccgaggcgauuuucaaacugacauaccagaacaaaguggucagagugcaacggcccaccccgcgcggcacaguuauggacaucaucuccagacgggaucagcgcgggagcggacaggugggcaccuaugggcucaauacguuuaccaacauggaagcucaacugauuagacagauggagggcgaaggagucuucaaaaauauccagcaucuuacagugaccgaggaggccgccguucagaacuggcuggcucgggugggccgcgaaagacucucucggauggccauuagcggggacgauugcgucgugaagccucuggacgaucgcuucgcuaaugcccugacagcgcucaacgacaugggaaagaucagaaaagauauucaacagugggagcccuccaagggcuggaacgacuggacccagguccccuuuugcucucaccauuuccacgaacugaucaugaaagaugggcgggugcuuguugugccuuguagaaaucaggacgagcugaucggacgcgcccggauuagccaaggcgcuggguggucccucagagaaacagccugccugggcaagucuuacgcucagauguggagccuuauguauuuucaccgccgggaccugagacucgccgcgaacgccaucuguuccgcugucccgucucauugggugcccaccagccgcacgacaugguccauucacgccaaacaugaguggaugaccaccgaggauaugcugacaguguggaaucggguuuggaucagagaaaacccuuggauggaggacaagacccccguggaaagcugggaggaaauuccuuaccugggaaagcgcgaggaucaguggugcggcucucucaucgggcugacaucccgggcuacgugggccaaaaauauucaggcugccaucaaccaagucagaagccuuaucggaaaugaggaauauaccgacuacaugcccucuaugaagcgcuuccggagagaggaagaggaagcgggcgugcugugguga

SEQ ID NO: 20312 - RNA, 9876 nt, Artificial Sequence
  derived and/or modified CDS sequence (opt5) from DENV-2__JF260983__SS-prME
accgccggcuuccugaucauggugauucccacagucauggcuuuucaccucacgaccagaaacggggagccucauaugaucguuagcaagaaugaaaaaggaaagggccugcuuuucaaaacagagaacgggauuaauaugugcacccugauggccauggaccucggagaacugugugaggauacagugaccuacaagugcccguuucuuaaacagaacgaacccgaggacaucgauuguuggugcaauuccacaucuaccugggugacguauggcaccuguagcuccacaggggagcaccggcgcgaaaagagaucugucgcgcuggugccucauguuggaaugggccucgagacccggacagaaaccuggaugagcuccgagggcgcuuggaagcaagcccagcgcauugagacguggauccugagacaccccggguucacacugauggccgcugugcucgccuacaccaucggaacaacccauuuucagcgggcucugauuuucauccuucugaccgccgucgcgccuucuaugacaaugcgcugcauuggcaucagcaacagagacuuuguggaagggguuuccggaggcagcuggguggauauuguccucgagcacgggucuugugugacgaccauggccaaaaauaagcccacacuggacuucgaacuuaucaaaaccgaggcuaagcagccugccacacugcggaaauuuugcauugaagcuaagcucaccaacacgacaaccgagucccgcuguccgacccaaggagagcccagccugguggaagagcaggauaagagauucgucugccggcacucuaugguugaccgcggcuggggcaauggguguggacuguuuggcaaagggggaaucgugacaugcgccauguucaccugccucaagaaaauggaaggcaaggugguccagccugagaaccuggaauauacaaucgugauuacgccccauuccggggaggagcacgcgguuggaaaugauaccggcaaacauggcaaggaagugaaaaucacaccucagagcucuauuuccgagaccgaacuuacagacuacgggaccaucacgauggaguguagccccagaaccggacuggauuuuaacgaaaugguccuccugcaaauggaguccaaggccuggcuugugcaccggcagugguuccuggaccucccgcugccuuggcugcccggcgcugauacacaggggucuaauuggauucagaaggagaugcucguuaccuucaaaaacccucacgccaagcgccaagacguggucgugcugggaagccaggaaggcgcuaugcauacagcccuuaccggggccacggagauccagaugucccugggcaauauccucuuuaugggacaccugaaaugcagacuucggauggacaagcugcaacucaaaggcaugagcuauucuauguguacagggaaguucaaggucgugaaagaaauugcugagacccagcauggaacaaucguuauuagagugcaguacgagggcgaugacucccccugcaagauccccuuugaaauuauggaucuggagaaaaagcacguccuggggcgccucaucaccgugaacccuaucguuaccgaaaaagacagcccgauuaacaucgaggcggaacccccuuucggagauucuuauauugugaucggcgucgagcccgggcagcugaagcuuaauugguuuaagaaaggcagcuccauuggacaaauguucgagacaacgaugcggggcgccaagagaauggcuauccugggggacaccgccugggauuuuggaucuauuggcgggguguucacaagcgugggaaaagcccuccaucagguuuuuggcgcuaucuacggggccgcguucuccggcgucagcuggaccaugaagauccugauuggaguggugaucacauggauuggcaugaacucucgcuccaccagccugucugucacgcuugugcucguugggaucgugacacuguaccugggagucauggugcaggcugacuccggcuguguugugagcuggaaaaauaaggaacucaagugcggguccggaauuuuugucaccgauaacgugcacaccuggacagagcaguauaaauuccaaccugacucucccagcaagcuggccuccgccauccagaaagcucacgaagagggcaucugugggauucggucuguuaccagacuugaaaaucugauguggaagcagaucacaccggagcucaaccauauucugagcgagaaugaagugaaacugacgaucaugaccggcgagauuaagggaaucaugcaggccggccgccggucccuuaaaccucaacccacagaacucagauacagcuggaagaccugggggaaggcuaaaguccugucuacagagcugcagaaccagaccuuucucaucgauggaccugaaacgaccgagugccccaauuccaaccgcgccuggaauagccuggagguggaagacuauggcuucgggauuuucacaaccaacaucuggcuuaagcugcgggagaaacaggacaugauuugugauucuaagcucauguccgcggccgugaaagacgauagagcuguccacgccgacaugggauacuggaucgaaagccgccugaaugauacauggaagauggagaaggcuucuuuuauugagguuaaaagcugcuauuggccucggucccauacccuguggagcaacggcgugcuugaaucugagaugaucauccccaagaaucucgccggcccggugucccaacacaacuacagaccuggguauuacacacagaccgcgggacccuggcaccugggcaaacuggaaauggacuucgaguuuugugaagggacgacagucgugguuaccgaggauugcggaaaccggggccccagccuccgcaccacaaccgccuccgggaagcugauuacggaguggugcuguagaucuugcacacuuccuccgcugcgguacagaggagaagacggcuguugguauggcauggagauccgcccccucaaagaacgggaggaaaaucuggugaacagccuggucaccgcugggcauggacagauugauaauuucucccuuggcauccucgggauggcccugcugcucgaggagaugcugagaacacgcgugggaaccaagcacgcucuucugcucguugccauuucuuuugugacacugaucaccggcaacaugagcuucaaggaccuggggagagucauuaucauggugggagccgcuaugacggaugaaaugggcaugggcguuaccuaccuugcgcugcucgccgcuuuucgggugcgcccuacauucgccgucgggcugcuccugagaaaacuuaccuccaaggagcugcucauggccacaaucggaguggugcugcugucucaaagcaauauucccggcaccguccuugaacugacggacgcuaucgcccucgggauuaugguucugaaaaucaugcgguccauggagaaguaucagcucgcggugacagugauggcuaugcugugcauuccuaacgucaugauccuucagcaugccuggaaagugggauguaccauccuggccgcuguuagcgugucuccccuccugcugacauccagccagcaaaagaccgauuggauuccucuugcccugaccaucaagggccucaaucccacagcgauuuuucugacgacccucucucgcccguccaaaaucagaagcuggccucugaacgaagcuauuauggccgucgggauggugucuauccuugccuccagccugcugaagaaugacauccccaugacaggaccucucguugcuggcggccugcuuaccgugugcuacguccugacagggcgguccgccgaccucgagcuggagaaagcugccgaagugaagugggaggaucaggcggaaauuagcggaucuagccccauccucuccauuaccaucucugaggacggcagcauguccauuaaaaacgaggaagaggaacagacgcugacaauccuuauucgcaccgggcugcuggucaucucuggacucuucccggugagcaucccuauuaccgccgcugccugguaucugugggagacaaagaaacagagagcuggcguucuuugggaugugcccuccccuccccccauggggaaggccgaacuggaggacggagccuaccggaucaagcaacgcggcauuuuuggcuauucucagaucggggcuggagucuacaaagagggcaccuuccacacaauguggcaugugacgagaggggcgguucucgugcacaagggaaaacggcuggaaccuagcugggccgaugucaagaaagaccucauuuccuacggcgggggauggaagcuggagggcgaauggaaggauggcgaggaagugcaggugcuugcucuggagccggggaaaaaucccagagccguucagaccaagccuggacuguuuaaaacaaacaccggcacaaucggggccgucagccucgacuucucucccggaaccuccggcagcccuaucauugaucgcaaggggaaaguggugggacuguauggcaauggcgucgugacgcggucugggaccuacguuuccagcaucgcucaaacagagaaguccguggaagacaaccccgagauugaagaugacaucuucagaaagaaacgccuuaccauuauggaucugcacccuggagccggcaagacaaaacgguaucucccggcgaucgucagagaggcuauccgccgggggcugagaacccucauucuggcccccacacgcgugguugccgcugaaauggaggaggcccuucggggacugccuaucagauaccagacgcccgcgauuaaggcugaacauaccggccgggagaucguggaccugaugugucacgccacauuuaccaugcgccuccugucuccuauuagaguccccaauuauaaccuuaucauuauggacgaagcccauuucaccgauccggcuagcaucgccgcucggggguacaucuccacacgcguggagaugggcgaggccgcgggaauuuuuaugacggccaccccucccggcagcagagaccccuucccucagucuaacgcucccaucauggaugaagagcgggaaauuccugagagauccuggaauagcgggcacgaauggaucacaaacuuuaaaggaaagaccguuugguucgugccgucuauucgcgccggcaaugacaucgcugccugccugcggaagaacgggaaaagagucauccaacucagccgcaagacauuugauaccgaguauacgaaaacacggaccaaugacugggauuucguggugaccacagacauuuccgagaugggagccaacuuuaaggcugaaagagucaucgauccccgccgguguaugaaaccuguuauucugaccgacggcgaggaaagaguggugcuggcggggcccaugccugucacacauucuagcgccgcucagcgcagaggccggaucggacgcaaucccaagaacgagaaugaucaguacauuuacaugggcgaaccgcucgagaacgacgaggacugcgcccacuggaaggaagccaaaaugcuucuggauaauaucaacaccccugaggggaucauucccuccauguucgaaccugagagagaaaagguggacgcuaucgauggagaguaucggcugcgcggcgaggccagaaaaacguuuguugaccucaugaagcggggggaucugcccguguggcuugcguacaaagucgcuucugaaggaauuaauuaugccgacagaaagugguguuucgauggcauccgcaacaaucagauucuggaggaaaacaucgagguggagguuuggacaaaagaaggggagcggaagaagcucaaaccuagauggcuggacgcccgcaccuacagcgauccccuggcucucaaggaauucaaagaguuugccgcgggccggaagucccuuacacugagccugauuaccgaaaugggaagacucccgacguucaugacccaaaaaacacgggacgcccuggauaaccuugcugugcugcacucugccgagaugggcgggcgcgcuuauaaucaugcccucuccgagcugccugaaacccuggagacacuccuucugcugggacuccuggcuaccgucacaggcgggaucuuucuuuuccugaugagcggaagaggcgugggcaagaugacccucgggaugugcugcaucauuacggccuccggacugcugugguacgcgcagauccagccccacuggauugccgcuucuaucauucucgaauuuuuccuuaucguccugcugauccccgagccugaaaagcagcggacaccgcaagacaaccagcucaccuaugugguuauugccauccugacccuuguggcugccacaauggccaaugagaugggcuuucuggagaaaaccaagaaagaucucgggcugggaggcuucacaaugcagcagcccgaaauuaacauccuggacauugaccuccgcccugcuagcgcguggacgcuuuacgccguggcuaccacauuugucacccccaugcugagacauuccaucgagaauucuagcguuaacgugucccugacagccaucgccaaucaagcuaccgugcucauggggcugggaaagggcuggccucuuagcaaaauggauauuggcgucccccugcucgccaucggguguuacucucaggugaacccuauuacgcugaccgcggcccugcuccuucugguugcucacuaugccaucauuggaccgggccugcaggcuaaggccacacgggaagcgcagaagcgcgccgcugccgggaucaugaaaaaucccaccguggacggaauuacagucaucgaucucgagccuauccccuacgacccuaaguucgaaaaacaacugggccaggugaugcuucugguccucugcgugacccagguucugaugaugagaacgacaugggcucugugugaggcccucacccuugcuacagggcccauuuccacccugugggagggaaacccgggcaaguuuuggaauaccacaaucgccgugagcauggcgaacauuuuccggggcucuuaucuggccggggcuggacuccuguuuuccaucaugcgcaauacgaccagcgccagacggggcacagggaccauuggagaaacacuuggcgagaaauggaagucuagacugaacgcucucgggcgcagcgaauuccaaaucuacaagaaauccggaauccaggaggucgaucggacccuggccaaggagggcauuaaaagaggcgaaacggaccaccaugccgugucucgcgggagcgcgaagcugcggugguucguugagagaaauaugguggcuccugaaggaaaagucguggaucucggcugcgggcgcggaggcugguccuauuacugugggggacuuaagaacgugcgggagguuaaaggccugacaaagggcgggcccggacacgaagagcccaucccuaugagcaccuauggcuggaaucuggucagacuccaguccgggguggacguguuuuucacccccccugagcgcugcgauacacugcuuugugacauuggagaaucuagcccgaaccccaccgucgaggccggccggacacugagaguucucaaccugguggaaaauuggcugggguccaacacgcaguuuugcaucaaggugcucaauccuuacaugcccucugucauugagcgcauggaaacccuucaacggaaauucggaggcgcucuggugagaaacccucugagccgcaauuccacacaugagauguacuggguuucuaacgccagcggcaauaucguguccagcgucaacaugaucucuagaaugcucauuaaucgguuuaccaugcgccacaagaaagccacauaugagcccgauguggaccugggguccggaaccagaaacaucggcauugaaugugagacgccgaauauggauaucauugggaagcggaucgaaaaaaucaagcaggagcaugaagcuagcuggcacuacgaccaggaccacccuuauaagaccugggccuaccauggaucuuaugagacaaaacagaccggcuccgcgagcucuaugguuaacgggguggucagacuucugacaaagcccugggaugugauuccuauggugacccaaauggccaugacagacaccacgcccuucggacagcagcgggucuuuaaagagaagguugauacacgcacccaggaaccuaaagagggcaccaagaagcucaugagaaucacagcugaauggcuguggggcgagcuggggcggcgcaaaaagcccagaauuugcacgcgggccgaguucuguaauaaagugcgcuccaacgcugcccucggagcgguguuuaccgacgaaaauaaguggaaaagcgccagagaggcugucgaagaugagcgguucugggaacugguggagaaggagcgcaaccuucaccuggacggcaagugcgaaacaugcguuuacaacaugauggggaaaagagagaagaaacucggagaauuuggcaaggccaaagggucccgggcuaucugguauauguggcugggcgcccgcuuccuugaguuugaagcucugggauuccucaaugaggaucauugguucagcagagagaacucucugagcggcguggaaggggagggacugcacaagcucggcuacauucugcgggacaucucccgcaaagccgggggagcgauguacgccgaugacaccgcuggcugggauacaagaauuaccucugaagaccuuaagaaugaggaaaugaucacagaccaaauggaggggcggcacaagaaacuggccgaggcuaucuuuagacucaccuaucagaacaaggucgugcgcguucagcggccgacgccuagaggcaccgugauggauauuaucagccgccgggaccaaagaggauccggccaggucgggacauacggacugaauaccuucacaaacauggaagcccagcuuauucgccagauggagggcgaagggcuguuuaaaucuauccuccaucugaccccccaagaggagacggccgugcacgcguggcugguucgggaaggaagagagcgccucgcucggauggccauuagcggcgaugacuguguggucaagccccuggaugacagauucgcccgcgcucuuacagcccugaaugauauggggaaagugcggaaggacauccagcagugggaaccuuccaagggcuggucugauuggacccaggucccguuuugcagccaucacuuccaugagcucaucaugaaagacggaagaaagcuggugguucccugucggaaccaagaugaacuuauuggcagagcucgcaucucccagggggccggauggagccugcgggagacagcgugccucggcaaaucuuaugcccagauguggucccugauguacuuucacagacgcgaccugagacucgcugccaaugcuauuuguagcgccgugccuucucacuggguccccaccucccggacgaccuggagcauccaugcgucccacgaguggaugacaaccgaagauaugcuggccguguggaaccgcguguggauucaggacaauccuuggauggaggacaagacacccguugaaucuugggaggauaucccuuaucuugggaaaagagaagaccaauggugcggaagccugaucggccucaccucccgggcuacaugggccaagaacauucagaccgcuaucaaucaggugcgcgcccugauuggggaggaggaauacauggauuauaugcccagcaugaagagauuccggucugaggaagaggaauccggcguccuuugguga

SEQ ID NO: 20313 - RNA, 9876 nt, Artificial Sequence
  derived and/or modified CDS sequence (opt5) from DENV-2__AF119661__SS-prME
acagugggcgucaucauuaugcugauccccacagccauggcuuuccaccucacgaccagaaauggggagccucauaugauuguugggcggcaggaaaagggcaaaucccugcuuuuuaagacagaggacggggugaauaugugcacccugauggccaucgaucucggggaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcgucgcgcucgugccucauguuggaaugggccuggagaccagaacggaaacauggauguccucugagggcgcuuggaaacacgcccagcggaucgagaccuggauucugcgccaucccggguucaucauuauggccgcuauccucgccuacacaauuggaaccacccacuuucagagagcucugaucuucauucuucugacagccguggcgccuagcaugacgaugcggugcaucggcgucuccaaccgcgauuuuguggaagggguuucuggaggcagcuggguggacaucguccucgagcacggguccugugugaccacaauggccaagaauaagcccacccuggauuucgaacuuauuaaaacagaggcuaagcagccugugacccugagaaaauauugcaucaaggccaaacucacgaacacaaccaccgaaagccgguguccgacacaaggagagcccucucugaaugaggaacaggacaagcgcuuugucugcaagcauuccaugguugauagaggcuggggcaacggguguggacuguucggcaaagggggaauugugaccugcgcuacauuuacgugcaagaaaaauauggagggcaagaucgugcagccugaaaaccucgaguacaccauugucaucacaccccacagcggggaggaacaugccgugggaaaugacaccggcaaacacggcaaggagaucaaaauuacaccucagucuuccaucaccgaagcggagcugacgggguauggaaccguuacaauggaauguagcccccggaccggccuugauuucaacgagauggugcugcuccaaauggaagacaaggccuggcugguccaccgccagugguuucuugaucugccgcucccuuggcugcccggggcugacacacagggaucuaauuggauucagaaggagacccuggugacguucaaaaacccucaugccaagaaacaagacguugugguccucggcucccaggagggggcuaugcacacagcccugaccggcgccacagaaauccagaugagcuccggaaaucuucuguuuaccggccaucucaagugcagacugcggauggauaaacuucaacugaaggggaugucuuacagcauguguaccggaaaguucaaaauugugaaggagaucgcugaaacacagcacggcacgaucgucauuagagugcaguaugagggggacggaucccccugcaaaauccccuucgagauuauggaucucgaaaagcgccauguucugggccggcugaucaccgugaacccuauugucacagagaaagacagcccggugaacaucgaagcggagcccccuuuuggggauucuuacauuaucaucggcguugaacccggacagcucaagcugaauugggugaagaaaggcuccagcauugggcaaauguucgagaccacaaugagaggagccaagcgcauggcuauccuuggcgacaccgccugggauuuugggucucugggaggcgucuucacgagcauugggaaagcccuccaccagguguuuggcgcuaucuacggagccgcguucuccggcgugucuuggacaaugaagauucugaucgggguuaucauuaccuggaucggaaugaacagccgguccaccagccugucugucucccuugugcucgugggcgucauuacacuguaucugggggcuauggugcaggccgacagcggauguguugugucuuggaaaaauaaggagcucaagugcggcuccgggaucuuuauuaccgauaacguccacacauggacggaacaguacaaauuccaaccugagagccccuccaagcuggccucugcuauccagaaagcccaugaagagggcaucuguggaauuagaagcgugacccgccuugaaaaucugauguggaagcagaucacaccggagcucaaccacauucuguccgagaaugaaguuaaacugaccaucaugacaggcgacauuaaggggaucaugcaggcuggaaaacggucucuuagaccucaacccaccgagcucaaguauagcuggaagacguggggcaaagccaagaugcuguccaccgaaagccauaaccagacauuucugaucgaugggccugagaccgcggaaugccccaauacaaaccgcgccuggaacucucucgagguggaggacuacggauucggcgucuuuaccacaaacauuuggcugaaacuucgggaaaagcaggacguguucugugauuccaaacugaugagcgcugccaucaaggacaauagagcuguucacgccgauaugggcuauuggauugagucugcgcucaacgacaccuggaagauggaaaaagccuccuuuaucgaggugaaguccugccacuggccuaaaucucauacgcuguggagcaaugggguccuggaguccgaaaugauuauccccaagagcuucgcuggaccggugucucagcacaacuaccgcccuggcuauuacacacaaaccgccgggcccuggcaucuuggaaaacucgagauggauuucgacuuuugugaaggcaccacaguggucguuaccgaggauugcgggaaccggggacccucccugagaacgacaaccgcuagcggcaagcugauuacagaauggugcugucgguccugcacccucccuccgcugcgcuacagaggcgaggacggguguugguauggaauggagauccggccccuuaaggaaaaagaggaaucucugguggauagccucgugacagccggccacgggcagaucgacaauuucucccugggaguccugggcauggcccuuuuucucgaggaaaugcugagaacccgcguggggacgaagcaugcuauucugcucguugcggugucuuucgucacccugaucacaggaaacaugagccuucgggaucugggcagagugaugguuauggugggcgccaccaugacagacgauauugggaugggagucaccuaccucgcucugcuggccgccuuuaaagugcgcccuacguucgcugccggccuucugcucagaaagcugacauccaaagagcucaugauggcgaccaucgggauugcucugcuuucucagagcacaauccccgagaccauccuggaacucaccgacgcccuggcccugggaaugaugguucuuaagauugugcggaauauggagaaguaucaacuggcugucacaaucauggccauuuccugcgugccuaacgcggugauccuccagaaugcuuggaaagucagcuguacgauucuggccgccguuucugugagcccccuccugcuuaccagcucucagcagaaggcugacuggaucccucuggcccucacaaucaaaggccugaaccccaccgcuauuuuucugacaacccuugcccgcacguccaagaaaagaagcuggccgcugaaugaagcgaucauggccguggggauggucucuauucucgcuuccagccugcucaagaacgauaucccuaugacaggaccccugguggccggcggccuucugaccguuugcuacgugcugaccgggcgguccgcugaccucgagcuggaacgcgccacagaugucaaaugggaggaccaagccgagauuagcggaucuagcccuauccuuuccauuaccaucucugaagauggcagcauguccaucaagaaugaggaagaggagcagacacugacgauucucaucagaaccgggcugcucgugauuucuggacuguuccccguuagcaucccgauuacagcugcggccugguaucuuugggaagugaagaaacagcgggcuggcguccugugggacgugccuucucccccucccgucgagaaggccgaacuggaggauggggccuaccgcaucaaacagaagggaauccucggcuauagccaaauuggcaccgggguguacaaagaaggaacauuucacaccauguggcacguuacgagaggcgcugugcugaugcaucgggggaagcgcaucgagcccagcugggccgacgucaagaaagaucuuauuuccuacggaggcggguggaagcuggagggagaauggaaagagggcgaagaggugcagguucucgcgcuggaaccuggcaagaacccgagagcugugcagaccaaacccggacucuucaagacaaauaccggaacaaucggcgccgucagccuggacuuuucuccugggaccuccggaagccccauuguggaucggaagggcaaagugguugggcuuuauggaaacggcgucgugacaagaucuggcgccuacguguccgcuaucgcccagacggaaaagagcaucgaggacaauccugaaauugaggaugacaucuuccgcaaaaagcggcugaccauuauggaccugcaccccggggcgggaaaaacaaagagauaucucccugcuaucguccgcgaagccauuaagcggggccugagaacccuuauccuggccccgacccgcgugguugcugccgagauggaagaggcucuccgggggcugcccauuagauaccaaaccccugccauccgcgcggagcauacgggacgggaaaucguggaucucaugugucacgccaccuuuacaaugagacugcuuucccccguccgggugccuaacuauaaucugauuaucauggacgaggcucauuucaccgaucccgccaacauugcugcccgcggcuacaucucuacaagaguugaaaugggggaggccgcuggcauuuucaugaccgcgacgccgccuggaagccgggaccccuuuccccaguccaacgccccuaucauggaugaggaacgcgagauccccgaaagaagcuggaacucuggccacgagugggugacagacuucaaagggaagaccgucugguuugugccuuccauuaaagcuggaaacgauaucgccgccugccugcggaagaauggcaaaaagguuauucagcucagcagaaagaccuucgacucugaauaugugaaaacacgcaccaacgauugggacuuugucgugacaaccgauaucagcgagaugggggcuaauuucaaggccgagcgggugauugacccgagacgcuguaugaaacccgucauccugacggacggagaggagcggguuauccuugcgggcccuaugcccgugacacacuccucugcugcccaaagacgcgggcggauuggcagaaacccuaagaaugaaaacgaucaguacaucuacaugggagagccccuggaaaaugacgaggauugcgcccauuggaaagaggcuaagaugcuccuggacaacauuaauaccccggaaggcaucauuccuagcauguuugagcccgaacgcgagaaaguggaugccaucgacggggaauauagacugcggggagaggcgcgcaagacauucgucgaucucaugagacggggcgaccuuccuguguggcuggccuaccgcguugcugccgaggggauuaacuaugcugauagacggugguguuuugacggagugaagaauaaccagauccuggaagagaaugucgaaguggagaucuggaccaaagagggcgaaagaaagaaacucaagccccgcuggcuggaugcccggauuuacuccgacccucuugcucugaaagaguucaaggaauuugccgcggggagaaagucucucacgcugaaccugaucaccgagaugggccgccuccccacauucaugacccagaaagcccgggaugcucuugacaaccuggccguucugcacacagcugaagccggaggcagagccuauaaucaugcucucagcgagcugccggagacccuugaaacacugcuccugcugacccuccuugcgacggugacagggggaauuuuccuguuucugauguccggcaagggggucggaaaaaugacccucggcaugugcugcaucauuaccgccagcauccugcuuugguacgcucaaauccagccucacuggauugccgccucuaucauucuggaguucuuucucauggugcugcugauccccgaacccgagaagcagcggacaccucaggacaaccaacucaccuaugucgugauugcuauccuuacaguuguggccgcgacgauggccaaugaaaugggcuuccuggagaaaaccaagaaggaucuggggcucggauccaucgcuacacaggagccggaaagcaacauucuggacaucgaucuucgccccgccuccgcuuggacccuguacgccguggcgacaaccuuugucacgccuaugcucagacacucuauugagaauagcuccguuaacgugucucugaccgccaucgcuaaucaggccacagugcugaugggccucgggaaaggauggccccuuagcaagauggacauuggcgucccucugcuggcuaucggguguuacucccaggugaaccccauuacccucacagccgcucugcuucugcucguugcccauuaugcgaucaucggaccuggccugcaagccaaagcuacccgggaagcccagaagcgcgcugccgccggcauuaugaaaaauccgacgguggaugggaucacagucauugaccuggaucccaucccuuacgaccccaaguucgagaagcagcucggacaggugaugcuucugauucugugcgucacccaagugcucaugaugagaacaaccugggcgcugugugaagcucuuacccuggccacaggcccuaucagcacgcucugggaggggaaccccggacgguuuuggaauaccacaaucgcuguuucuauggccaacauuuuccgcggcuccuaucuggccggggcuggacugcucuuuuucaucaugaaaaauaccacaaacaccagacggggcacgggcaauauuggggagacacuuggagaaaaguggaaaagccgccugaacgcccugggcaagucugaguuucagaucuacaaaaaguccgggauucaggaaguggauagaacccucgcgaaagagggaaucaagcggggcgagaccgaccaccaugccgucagcagagggucugcuaagcugcgcugguucguggaacggaauaugguuacaccggagggaaaaguggucgaucuuggcugcggcagagggggauggagcuauuacuguggcgggcugaagaacgugcgcgaagugaaaggacucaccaagggcgggccuggacacgaggaacccauccccauguccacauauggcuggaaccugguucggcugcaaucuggcgucgacguguuuuucacgccucccgagaaaugcgauacccuccuuugugacauuggggagagcuccccuaauccgacaaucgaagccggaagaacccugcgcgugcugagccucgucgagaacuggcugaauaacgacacacaguucugcauuaagguucuuaaucccuacaugccuuccgugaucgaaaagauggagacccugcagcggaaauacggcggggcucucgugagaaacccccugucucgcaauagcacgcaugaaauguauugggucuccaacgccaccggaaauauugugucuagcguuaacaugaucucccggaugcugaucaauagauuuacaaugaagcacaaaaaggcgaccuacgagccugauguggaccucggcucugggacacgcaacauuggaaucgagagcgaaauucccaaucuugauaucauuggcaaacggaucgagaagauuaagcaggaacacgagaccuccuggcauuaugaccaagaucacccguacaaaacaugggccuaucauggcagcuacgaaaccaagcagacggggucugcuuccagcauggucaacggagugguuagacugcugacaaaaccuugggacgugguccccauggugacccagauggccaugaccgauacaacgccuuucggccagcaacgcguguuuaaggagaaagucgacaccagaacacaggagcccaaggaagggaccaagaaacucaugaagaucacagcugaguggcuguggaaagaacuuggaaagaaaaagaccccucggauguguacacgcgaggaguucaccagaaaaguucggucuaaugccgcucugggcgccaucuuuacggaugaaaacaaguggaaguccgcgagagaggccguggaagacaaccgguucugggagcucguggauaaagaacgcaaucugcaccuggaggggaagugcgagaccugugucuauaacaugaugggaaaaagagaaaagaaacucggcgaguuuggcaaggcuaaggggagccgggccauuugguacauguggcugggagcucgcuuccuugaauuugaggcccugggcuuccucaaugaagaccacugguuuucuagagagaacucccugagcgggguggagggagaaggccuucauaaacugggguacauccuccgggacguuuccaagaaagagggcggagccauguaugcggaugacacagcuggcugggauacccgcauuacacuggaagaccugaagaaugaggaaauggugaccaaccacauggagggggagcauaaaaagcucgccgaagccaucuucaagcugacguaccagaauaaagcugucagagugcagcggcccacaccgcgcggaaccguuauggauauuaucagcagacgggaccaacgcggcucuggacaggugggaacauauggccuuaacaccuuuacgaauauggaggcccagcugaucagacaaauggaaggggagggcauuuucaagagcauccagcaccucaccgucacagaggaaauugcugugcagaacuggcuggcccggguuggacgcgagagacuuucccggauggcgaucucuggcgaugacugcguggucaaaccucuggaugacagauucgccagcgcucucaccgcccugaaugauauggggaaggugcgcaaagacauucagcaaugggaacccucccggggauggaacgauuggacacagguccccuuuugcucucaucacuuccacgagcugaucaugaaggacggcagagugcucguugugccuugucgcaaucaggacgaacugaucgggcgggcuagaauuagccagggagccggcuggucccuuaaggagaccgcgugccuggggaaaucuuacgcccaaauguggagccucauguauuuucaucgccgggaucugagacuugcugccaacgcuaucuguuccgccgucccgagccacugggugcccacaucucgcaccacgugguccauucaugcuaagcacgaguggaugacaaccgaagacaugcugaccguguggaaucggguuuggauccaggagaacccuuggauggaagauaaaacacccguggagagcugggaagaggucccuuaccucggcaagagagaggaccaguggugcggaucucugauuggccugaccucccgcgccacaugggcgaaaaacauccagacggccauuaaucaagugcggagccucaucgggaacgaagaguauaccgauuacaugcccuccaugaagagauuccggagagaagaggaagaggcuggaguucugugguga

SEQ ID NO: 20314 - RNA, 9876 nt, Artificial Sequence
  derived and/or modified CDS sequence (opt5) from DENV-2__EU056810__SS-prME
accgccggcaucauuaucaugcugauucccacagugauggcuuuccaccucacgaccagaaacggggagccucauaugaucgucagccggcaggaaaagggaaaaucccugcuuuuuaagacagaggacggcguuaauaugugcacccugauggccauggaucucggggaacugugugaggacacaauuaccuacaacugcccgcuucugcgccaaaaugaacccgaggauaucgacuguuggugcaacucuacaagcaccugggugacguauggaaccuguacagcgaccggcgagcacagacgggaaaaacgcuccguggcucucgucccucauguggggaugggacuggagacaagaaccgaaacguggaugucuagcgagggcgccuggaagcacgcccagcggaucgagacauggauucugcgccaucccggcuucaccaucauggcugccauucucgcuuacacaaucgggaccaccuauuuucagagaguucugauuuucauccuucugacagccguggcgccuuccaugacgaugcggugcauuggaaucucuaaucgcgauuuugucgaaggcgugagcgggggauccuggguugacaucgugcucgagcacggcagcugugucaccacaauggccaaaaacaagcccacccuggauuucgaacuuauuaagacagaggcuaaacagccugccacccugagaaaguacugcaucgaagcuaaacucacgaauacaaccaccgccucucgguguccgacacaaggggagcccucccugaacgaggaacaggacaagcgcuuugugugcaaacacagcaugguggauagaggauggggcaauggcugugggcuguucggaaagggcgggauugucaccugcgcgauguuuacaugcaagaaaaacauggagggaaagguugugcagccugaaaaucucgaguauacgaucgugauuaccccccauucuggcgaagagaacgccgucgggaaugacacaggaaaacacggcaaggagaucaaaaucaccccucaguccagcauuacagaagcugagcugaccggcuacgggacggugaccauggaauguucuccccggacaggacuugauuucaacgagaugguucugcuccaaauggaaaauaaggccuggcuggugcaucgccagugguuucuugaccugccgcucccuuggcugcccggcgcugauacccagggguccaacuggauccagaaagagacacuggucaccuucaagaacccucacgccaagaaacaagacgugguugugcucggaagccaggagggcgccaugcacacggcucugacaggggcgaccgaaauucagauguccucuggcaaucuucuguuuacaggacaucucaagugcagacugcggauggacaaacuucaacugaagggcaugagcuauuccauguguaccgggaaauucaaggucgugaaggagaucgccgaaacccagcacggaacaauugucgugagaguucaguacgagggcgaugggagccccugcaaaauccccuucgagaucauggaccucgaaaagcgccaugugcugggacggcugauuacggucaacccuaucgugaccgagaaagauucuccgguuaauauugaagcugagcccccuuuuggcgacuccuacaucauuaucgggguggaacccggccagcucaagcugaacugguucaaaaagggaagcucuauuggccaaauguuugagacaaccaugagaggggccaagcgcauggccauccuuggagauacagcuugggacuucggcagccuggggggagucuuuaccuccaucggcaaagcccuccaccagguguucggggcgauuuauggcgcugccuuuucuggagugagcuggacgaugaagauccugauuggcguugucaucacauggauugggaugaauucccggagcaccucucuguccgugagccuugugcucgucggagugguuacccuguaccugggcgugaugguccaggccgauucugggugugugguuuccuggaaaaacaaggagcucaaaugcggaagcggcaucuucgugacagacaauguccauaccuggacagaacaguauaaguuucaaccugagucccccucuaagcuggcuagcgccauccagaaagcucacgaagaggggauuuguggcaucagauccgugacgcgccuugaaaaccugauguggaagcagauuaccccggagcucaaucacauccugucugagaacgaaguuaaacugacaauuaugaccggagauaucaagggcaucaugcaggccgggaaacggagccuuagaccucaacccacagagcucaaguacuccuggaaaaccuggggaaaggcgaagaugcugagcacggaacugcauaaucagaccuuccucauugacggcccugagacagccgaaugccccaacaccaaucgcgcuuggaacucucuggagguggaggauuauggguuuggagucuucacaaccaauaucuggcuuaaacugaaggaacggcaggacguguuuugugacuccaaacucaugagcgccgcuauuaaggauaacagagccgugcacgcggacaugggcuacuggaucgagucugcccugaacgauacauggaaaauugaaaaggcuuccuucaucgaggucaagagcugccauuggccuaaaucucacacccuguggagcaauggcguucuugaguccgaaaugaucauucccaagaacuucgccgggccggugagccagcacaauuaucgcccuggauaccauacgcaaacagcuggccccuggcaccucgggaaacuggagguggacuuuaacuucugugaaggaaccaccgucgugguuacaggcgauugcgggaaucggggacccucucugagaaccacgacagccuccggcaagcucaucaccgaguggugcugucggagcugcacacugccuccgcuucgcuacagaggcgaagacggguguugguauggaauggagauucggccccugaaagagaaggaagagaaccucgugaauucccuggucaccgccggccaugggcagaucgauaacuuuucucugggagugcuuggcauggcucucuuccuggaagagaugcugagaacacgcguugggaccaagcacgcgauucuccugguggccgucagcuuugugacgcuuaucaccggaaauauguccuuccgggaccugggcagaguuauggugauggucggcgcuacaaugaccgaugacauugggaugggagugacauaccucgcccugcuggccgcuuuuaaagugcgcccuaccuucgccgcgggccuucugcucagaaagcugacgucuaaagaacucaugaugacaaccaucgggaucguccugcuuagccaguccacaauucccgagaccguucuggagcucaccgaugcucuggcccugggaaugauggugcuuaagaucgugcggaacauggaaaaauaucaacuggccgucacaauuauggcuauccucugcgugccuaaugccguuauucugcagaacgcguggaaggugucuuguacgauccucgcugucgugagcguuuccccccugcuucugaccagcucucagcagaaggccgacuggaucccucucgcccugacaauuaaaggccugaaucccaccgcuaucuuucuuacaacccugucccgcacgagcaagaaaagaucuuggccgcucaacgaggccauuauggcuguggggauggucuccauccuggccagcucucuccugaagaaugauauuccuaugacaggaccccuuguggcgggcggccugcugaccgucugcuacgugcucaccgggcgguccgccgaccuggaacuugagcgcgcugccgacguuagaugggaagaucaagcugagaucagcggauccagcccuauccugucuauuacaaucagcgaggacggcuccaugucuauuaaaaacgaagaggaagagcagacccucacaauccugauucggacggggcuccuggugaucagcggacuuuuccccgucuccauuccgaucaccgccgccgcuugguaucugugggaggugaagaaacagcgcgcgggcguucugugggaugugccuucucccccucccgucgggaaggccgaacucgaggacggagcuuacagaaucaagcagaaaggcauucugggcuauagccaaaucggggccggaguguacaaggaaggcacauuucauaccauguggcacgugacacggggggccguucuuaugcacaaaggaaagcgcauugagcccuccugggcugaugucaaaaaggaccugaucucuuacggcgggggauggaagcucgaaggcgaguggaaagagggcgaagaggugcaggugcuggcccucgaaccugggaagaacccgagagcgguccagaccaaacccggacuguucaagacgaauaccggcacaauuggggcugugagccuugauuuuuccccuggaaccagcggcucucccaucguugacaaaaaggggaagguggucggacuguauggcaacggcgugguuacacgguccgggaccuacgugagcgccaucgcccagacagagaaaucuauugaagauaauccugagaucgaggacgauauuuucagaaagaaacgccugacgaucauggaccuccaucccggagcuggcaagaccaaacgguaucugccugccauugucagagaagcgaucaagcgcgggcuucggacacugauccucgcuccgaccagagugguugccgccgagauggaagaggcucugcgcggacuccccauucgguaccaaaccccugccaucagagcugaacacacaggccgcgagauuguggaucugaugugucaugccacguucaccaugcggcuucugucccccgucagagugccuaacuauaaucugaucauuauggacgaggcgcacuuuacagaccccgccagcaucgcugcccggggguacauuuccacccgcguggaaaugggcgaggcugccggaaucuucaugacagccaccccgccuggcucuagagaucccuuuccccagagcaacgcuccuaucauggacgaagagcgggagauucccgaacgcuccuggaauagcgggcaugagugggucacggauuucaagggaaaaacaguuugguuugugccuucuaucaaggcgggcaacgacauugccgcuugccucagaaaaaaugggaagaaagugauccagcugucccggaagaccuucgauagcgaauauauuaagaccagaacaaacgacugggauuuugucgugaccacagacaucucugagaugggagccaauuucaaagccgaacgcguuaucgauccgcggagauguaugaagcccgugauucuuaccgacggcgaggagcgcgucauccuggcugggccuaugcccgugacgcacagcuccgccgcgcaacggagaggccgcauuggacggaacccuaaaaaugaaaacgaucaguacaucuacaugggcgagccccucgaaaaugacgaggacugcgcucacuggaaggaagccaaaaugcugcuggauaacauuaacacaccggaggggaucaucccuucuauguuugagcccgaaagagagaagguugacgccauugauggagaauaucgccucagaggcgaggcucggaaaaccuucguggaccuuaugcgcagaggggaucugccugucuggcuggccuaccggguggcggccgaaggaaucaauuaugcugaccgcagaugguguuuugauggcauuaagaacaaucagauccucgaggagaacgucgaaguggagauuuggacaaaggaaggggagcggaaaaagcugaaacccagauggcuugacgcccgcaucuacagcgauccucuggcucucaaggaguucaaagaauucgccgcuggccggaagucccugacccugaaucucauuacggagaugggaagacuucccaccuuuaugacacagaaggcccgcaacgcgcuggacaaucuggccguucuccauaccgcugaagccggcgggcgggcuuauaaccacgcccugucugagcuuccggaaacacuggagacccuccugcugcucacacuucuggccaccgugacgggaggcaucuuccuguuucucaugagcgggaaaggaaucggcaagaugacacugggcaugugcugcauuaucaccgcuuccauucuucugugguacgcgcaaauccagccucauuggauugccgcuagcaucauccucgaguucuuucugauugugcugcucauccccgaacccgagaaacagagaaccccucaggauaaucaacuuacauaugucguuauugccauccugaccgugguggccgcuacaauggccaacgaaaugggguuccuggagaagacgaaaaaggacuuuggacucggcucuauugcgacccagcagccggaauccaauauccuggauaucgaccuucggcccgccagcgcuuggacacuguacgccgucgcuaccacauucauuaccccuaugcuccgccacuccaucgagaacucuagcgugaauguuucccugacggccauugcgaaccaggccaccgugcugauggggcucggaaagggcuggccccuuucuaaaauggacaucggggucccucugcuggcuauuggauguuacagccaagugaaucccaucacacucaccgccgcucugcuucugcucgucgcccacuaugcuauuaucggcccuggccugcaggccaaggcgacaagagaggcccagaaacgggcugccgcugggaucaugaagaacccgaccguggauggaauuacgguuaucgaccuggaucccauuccuuacgaccccaaauuugaaaagcagcucggccaagugaugcuucugguccugugcgugacacagguucucaugaugcgcaccacaugggcccugugugaggcccuuacccuggcgaccgggccuaucuccacacucugggaaggaaaucccggcagauucuggaacacgaccauugcugugagcauggccaacaucuuucgggggucuuaucuggcuggagccggccugcucuucuccaucaugaagaauacagccaacacccgcagaggcacagggaauaccggagagacgcuuggcgaaaaauggaagaaccggcugaaugcucuggggaaaagcgaguuucagauuuacaagaaaucuggaauccaagaggucgaucgcacacucgccaaggaaggcauuaaaagaggggagaccgaccaucacgcggugucccggggaagcgccaagcugagaugguucguggaacgcaaccuuguuaccccggagggcaaggucguggaucugggcugcgggcggggaggcuggucuuauuacugugggggacucaaaaaugugagagaggucaagggccugacaaaagggggaccuggccaugaagagcccauccccaugagcaccuauggcuggaaccugguucgccuccaguccgggguggacguguucuuuacaccucccgaaaagugcgauacgcuucugugugacauuggagagucuagcccuaauccgaccaucgaagcuggccggacacugagaguccucaaccugguggagaauuggcuuaacaauaacacccaguucugcaucaaaguucugaaucccuacaugccuuccgugauugagaagauggaagcccuccagcgcaaguacgggggagcucugguccggaacccccugagcagaaacuccacacacgagauguauugggugucuaaugccagcggcaacaucguuuccucugugaauaugauuagccgcaugcucaucaaccgguuuaccaugagacauaaaaaggcgacguacgaaccugaugucgaccuuggguccggaacccgcaauauuggcaucgagucugaaacacccaaccuggauaucauuggcaaacggaucgagaagauuaaacaagagcacgaaaccagcuggcacuaugaccaggaccauccguacaagacaugggccuaucacggguccuacgagaccaagcagacaggaagcgcuucuuccauggugaauggcguggucagacugcucaccaaaccuugggauguuauccccacggugacacagauggccaugaccgacaccacaccuuucgggcaacagcgcguguuuaaggaaaaagucgauacgagaacccaggagcccaaggaaggaacaaaaaagcugaugaagauuaccgcugaguggcuuuggaaagagcugggcaagaaaaagacaccucggauguguacccgcgaagaguucacaagaaaagugcggagcaacgccgcucucggggccaucuuuaccgacgaaaauaaguggaaaucugcgagagaggccguugaggauucccgguucugggaacugguggacaaggagcgcaaccugcaucucgaaggaaagugcgagacgugugucuauaauaugaugggcaaaagagaaaagaaacugggcgaguuugggaaggcuaaaggaagccgggccauuugguacauguggcuuggcgcucgcuuccuggaguuugaagcccucggguuccugaacgaggaucacugguuuucuagagaaaauucccuuagcggaguggagggcgaagggcugcacaagcucggcuacauccugcgggacguuuccaagaaagagggaggcgccauguaugcggaugacaccgcugggugggauacacgcaucacccuggaggaccucaagaacgaagagauggugacaaaucauauggaaggagagcacaaaaagcuggccgaagccauuuucaaacuuaccuaccagaacaaggucgugagaguucaacggcccacgccgcgcggcacagugauggacaucauuagcagacgggaucagcgcgggucuggacaggucggcaccuaugggcugaacacauucaccaauauggaggcucaacucaucagacagauggagggcgaaggaguguuuaagagcauucagcaucugacggucaccgaggaaaucacagugaaaaacuggcuugcccggguuggccgcgagagacugucccggauggcuaucucuggggacgauugcguggucaagccucucgacgauagauucgccagcgcgcugaccgcccugaaugacaugggaaaagugcgcaaggauauucagcaaugggagcccucccggggcuggaacgacuggacacaggugcccuuuugcucucaccauuuccacgaacucaucaugaaagaugggagaguucugguggucccuugucgcaaucaggacgagcuuauuggacgggcuagaaucagccagggcgccggguggucccugcgcgaaaccgcuugccucggcaagucuuacgcccaaauguggagccugauguauuuucaccggagagaucuucgccuggcggccaacgcuauuuguuccgccgugccgagccauuggguucccacaucucggaccacgugguccauccacgcuagacaugaguggaugacaaccgaagacaugcucaccguguggaaucgcgucuggauccaggagaacccuuggauggaggauaagacacccguggaaagcugggaggaaauuccuuaccugggaaaacgggaggaccaguggugcggcucucugaucgggcucaccuccagagccacaugggcuaagaauauucagacggccaucaaccaaguccggagccugauuggaaaugaagaguauaccgacuacaugcccuccaugaaaagauuccgccgggaggaagaggaagcgggcgugcuuugguga

SEQ ID NO: 20315 - RNA, 9876 nt, Artificial Sequence
  derived and/or modified CDS sequence (opt5) from DENV-2__EU056811__SS-prME
accgccggcaugaucauuaugcugauccccacagugauggcuuuccaccucacgaccagaaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagagaagcgguccguggcgcuggugccucaugucgggaugggacucgaaacgcgcacagagaccuggaugucuagcgaaggcgcuuggaagcacgcccagagaaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaauggaggauaaggccuggcucguucaccggcagugguuccuggaccuuccgcugccuuggcuccccggcgcugacacgcaggggucuaauuggauucagaaagaaacacuggugaccuuuaagaacccucaugccaaaaagcaagaugucgugguucugggaucccaggagggcgcuaugcacacagcccucaccggggccaccgagauccagaugagcuccggcaaucugcuuuucacaggacaucugaaaugccgccucagaauggacaagcugcaacuuaagggcaugucuuacagcauguguacggggaaauucaagauugugaaagaaaucgcugagacccagcacggaacaauugucauccgggugcaguaugaaggcgaugggucccccugcaagauccccuuugagauuauggaccuggagaaaagacauguccucggacgccugaucaccgugaacccuauuguuacagaaaaggauagcccggugaacaucgaggcggaacccccuuucggcgacucuuacauuaucauuggggucgagcccggccagcugaagcucgauugguuuaaaaagggauccagcaucggccaaauguucgaaaccacgaugcggggggccaaaagaauggcuauccugggagacacagccugggauuuuggcucucuugggggaguguucaccagcauuggcaaggcccugcaccagguuuuuggggcuaucuacggcgccgcguucuccggagugucuuggaccaugaaaauucucaucggcgucauuaucacauggaucgggaugaauagccgcuccaccagccugucugugucccuggugcuuguuggaauugucacacucuaucugggcgugauggugcaggcugacagcgggugugucgugucuuggaagaacaaggagcugaaaugcggauccggcaucuuuguuacggauaaugugcacaccuggacagagcaguacaaguuccaaccugaaagccccuccaaacucgccucugccauucagaaggcucaugaggaagggaucuguggcauucggagcgucaccagacuggagaaccuuauguggaaacagaucacauccgaacugaaucacauccucucugagaacgaggugaagcugaccauuaugacgggagacaucaaaggcauuaugcagguugggaagcgcagccugcggccgcaaccuaccgaacuuagauauuccuggaagacauggggaaaagccaagaugcucagcaccgagcugcauaaucagacauuucugaucgacggccccgaaaccgcugagugcccuaacacaaaucgcgccuggaacucucucgaaguggaggauuacggguucggagucuuuaccacgaauauuuggcugcggcuuagagagaaacaggacgcguucugugauuccaagcugaugagcgccgcuaucaaagacaaccgcgccgugcacgcugauaugggcuauuggaucgaaucugcccucaaugacacauggaagauugagaaggcguccuucaucgaaguuaaaagcugccacuggcccaagucucauacccuguggagcaacggcgugcuggaguccgagauggucauuccuaaaaauaucgccgggcccgugagccagcacaacaaccggccgggauaccauacccaaacagcuggcccuuggcaccuugggaagcucgaaauggauuuugacuucugugagggaaccacgguggucguuacagaagagugcggcaauagagggcccucucugcggaccacaaccgccuccggaaaacugauuacagaauggugcugucgcagcugcacccuccccccucugagauaucggggcgaggauggcuguugguacgggauggagaucagaccgcuuaaggaaaaggaggaaaaccugguguccucucucgugacggcuggacauggccagauugacaauuuuagccuggggauccugggaauggcccuuuuccucgaggaaaugcugcgcacccgggucggcacaaaacacgccauccugcucguggcuguuuccuuucugacccuuauuacagggaacaugucuuucagagaucugggacgcgugauggucauggugggcgcgaccaugacggacgauaucggcauggggguuacauaccucgcccugcuggcugccuuuaaggugagacccaccuucgccgcuggacuucugcuccggaaacugacaagcaaggagcucaugaugaccaccauuggcaucguccugcuuucccagucuagcauuccugagacaauccuggaacucacggacgcccuggcgcuggggaugauggugcuuaaaaugguucgcaauauggagaaguaucaacuggcugugaccaucauggccauucucugcguccccaacgccgugauccugcagaaugcuuggaagguguccuguacaacccucgccgucguuagcgugucuccucugcuucugacauccagccagcagaaagcggacuggauuccccucgcucugaccaucaagggacugaacccuacggccauuuuucuuacaacccugaccagaacaucuaaaaagcgguccuggccccucaaugaagccaucauggcugugggcauggucagcauccuggccucuucccuccugaaaaacgauauuccgaugaccgggccucuuguggcuggaggccugcugacaguuugcuacgugcucacgggccgcagcgccgaccuggagcuugaaagagcgaccgaugucaagugggacgaucaagccgagaucuccgggagcucucccauucugagcaucacaauuuccgaggacggaucuaugagcaucaaaaaugaagaggaagagcagacccucacaauucugauccggaccggccuccuggugaucuccgggcuuuucccuguuucuauucccaucacggcugccgcuugguaucugugggaggugaagaagcagcgcgccggaguccugugggaugugccgagcccucccccugucggcagagccgaacucgaggacggggcuuaccggauuaaacagaagggaauccugggcuauucccaaauuggcgcggggguguacaaagaaggaaccuuucacacaauguggcauguuacccgcggcgccgugcuuaugcacaaggggaaaagaaucgagcccucuugggcugaugucaagaaggaccugaucagcuauggaggcggguggaaacucgaaggagaguggaaggagggcgaagaggugcagguucuggcccucgaacccggcaaaaacccucgggccgugcagacaaagccggggcuguucagaaccaauacaggaacgauuggcgcugucucccuugauuuuagccccgggaccucuggauccccuaucguggacaaaaagggcaaggugguugggcuguacggaaacggcgucgugacacgcggcggggccuacgugagcgcgauugcucagaccgagaaaggaaucgaagauaaucccgagauugaggacgacaucuuccggaagagacgccugaccaucauggaucuccauccuggcgccgggaaaacaaagcgguaucugcccgccauugucagagaagcuaucaaacgcggacuucggacgcugauucucgccccuaccagagugguugcggcugagauggaagaggcccugcgcggccucccgauccgguaccaaacacccgccauuagagcugaacacaccgggcgggagaucguggaccugaugugucaugccacauucaccaugcgccuucugucuccuauuagaguccccaacuauaaccugaucaucauggaugaggcucacuuuacggacccugccuccauugcggcccggggcuacaucagcacacgcguggaaaugggagaggcugccggcauuuucaugaccgcuacccccccgggguccagagauccuuuuccccagucuaaugcccccaucauggacgaagagcgggagauuccugaaagaagcuggaacuccggacacgaguggguuacagauuucaagggcaagaccgugugguuuguccccagcaucaaaacagggaaugacaucgccgcuugccuccgcaagaacggaaaacgggugauucagcugucuagaaagaccuucgauuccgaauauguuaaaacgcgcacaaaugacugggauuuuguggucaccacagacaucagcgagaugggcgcgaacuucaaggccgaacgggugauugacccuagacgcuguaugaagccggugauccuuaccgauggggaggagcgggucauucuggcuggccccaugccuguuacgcauucuagcgccgcccaaagacgcggaagaaucggccggaauccccgcaacgaaaaugaccaguacaucuauaugggggagccucucgaaaacgaugaggacugcgcucacuggaaagaagccaagaugcugcuggauaauauuaacacccccgagggaaucauuccguccauguuugagccugaaagagagaaaguggacgcgaucgauggcgaauaccggcuccgcggggaggcuagaaagacauucguggaccuuaugcggagaggagaucugcccgucuggcuggccuacaaaguggccgcugaaggcauuaauuaugccgaccgccggugguguuuugaugggaccagaaacaaucagauccucgaggagaacguugaaguggagauuuggacaaaggaaggcgagcgcaaaaagcugaagccucgguggcuugacgcgagaaucuacucugauccccuggcccucaaagaguucaaggaauucgcugccggacggaaaagccugacccugaaccucaucacagagaugggccgccuuccuaccuuuaugacgcagaaggcuagagacgcccuggacaaucuggcuguccuccauacagccgaagcggggggaaaagccuauaaccacgcucuguccgagcuucccgaaacccuggagacccuccugcugcucacacuucuggccaccgugacaggcgggauuuuccuguuucucaugucuggacggggcaucggcaagaugacgcuggggaugugcugcauuaucaccgcuagcauucuucugugguacgcccaaauccagccgcacuggaucgccgcuuccauuauccucgaguucuuucugauuguucugcucaucccugaacccgagaagcagcgcacaccccaggauaaucaacuuaccuaugugauuaucgcgauccugacagucguggccgcuaccauggccaacgaaaugggauuccuggagaaaacgaagaaagaccucggccuggggcauauugccacccagcagccugaaagcaauauccuugauauugaccugagaccggcuucugccuggacacucuacgcggucgccaccacauuuaucacccccaugcugcggcacuccauugagaacagcuccgugaauguuucucugacggcuaucgccaaccaggcuacagugcucaugggacuuggcaagggguggccucugagcaaaauggauauuggagugccccugcucgccaucggcuguuauucccaagucaauccuaucacccugacagcggcccuucugaugcucguugcucauuacgccauuaucggccccgggcugcaggcuaaggccacccgcgaggcucagaagagagccgcggccggaauuaugaaaaacccuaccguggacggcaucacagugauugaucuggacccgauccccuacgauccuaaguucgaaaaacagcucgggcaagucaugcuucuggugcugugcguuacgcaggugcucaugaugcggaccacaugggcucugugugaggcccuuacccuggcuacaggacccgucucuacccucugggaaggcaauccugggcgcuuuuggaacacgacaaucgccgugagcauggccaauauuuucagaggauccuaucuggcgggcgcuggccugcucuuuagcaucaugaagaacaccaccucuacacggagagggaccggaaauaugggcgagacacuuggggaaaaauggaagaaccgccugaaugcccugggaaaguccgaguuccagauuuacaaaaagagcggcauccaagaggucgaccggacgcucgcuaaagaagggauuaagagaggagagaccgaucaccaugccgugucucgcggcuccgccaaacugcggugguuuguugaaagaaaccuugugacacccgagggcaaggucguggaccuggggugcggacgcggcggguggagcuauuacuguggaggccucaaaaacguucgggaggugaaggggcugaccaagggaggcccgggccacgaagagccuauccccaugucuacauauggguggaaucuggucagacuccagagcggaguggauguguucuucguucccccugaaaaaugcgacacccuucugugugacaucggcgaguccucucccaacccuacggucgaagcugggcgcacccugcgggugcucaaucugguggagaacuggcuuaauaacaauacacaguuuugcgucaagguucugaacccguacaugcccagcgugauugagagaauggaaacccuccagcgcaaauauggaggcgcccuggugcggaauccucuguccagaaacagcacacacgagauguacugggucuccaaugcgucugggaacaucgugagcuccguuaauaugauuucucgcaugcucaucaacagauucaccaugcggcauaagaaagccacauacgaacccgauguggaccuuggaagcggcacccgcaauauuggcaucgaguccgaaacgccuaaccuggauaucauugggaagagaaucgagaagauuaaacaagagcacgaaacaucuuggcauuaugaccaggaucaccccuacaagaccugggcuuaucacggaagcuacgagaccaaacagacaggcuccgccagcucuauggucaacggggugguucggcugcucacgaagccgugggacgugaucccuauggucacccagauggcuaugacagauaccacacccuuuggacaacagagaguguucaaagaaaagguggacacccggacacaggagccuaaggaaggcaccaaaaagcugaugaaaauuacggccgaguggcuuuggaaggagcuggggaaaaagaagaccccccgcauguguacaagagaagaguuuaccaaaaagguccgguccaaugcggcccucggagcuaucuucacagaugaaaacaaauggaagagcgcccgcgaggcuguugaggacaauagauuuugggaacugguggauaaagagcggaaccugcaucucgaaggcaagugcgagaccuguguguauaauaugaugggcaaacgcgaaaagaagcugggggaguucggaaaagccaagggcucuagagcuauuugguacauguggcuuggggcccgguuucuggaguucgaagcgcucggauuucugaacgaggaccacugguucucccgcgaaaauagccuuucuggcgucgagggggaaggccugcauaaacucggauauauccugagagagguguccaagaaagagggcggggccauguacgcugacgauacggccggaugggacacacggaucaccauugaagaucugaagaacgaggaaaugaucacaaaucacauggcuggcgagcauaagaaacucgccgaagccauuuuuaagcugaccuaccagaacaaaguugugcgcguccaaagaccuacgccccgggggaccgugauggacaucauuagccgcagagaucagcggggauccggccagguugugacauaugggcuuaauaccuucacaaacauggaggcgcaacugaucagacagauggagggcgaaggagucuucaagagcauccagcaccucaccgcuucugaggaaauugccgugcaggacuggcugguucgcgugggccgggagagacuuagccgcauggccaucuccggggaugacugcgucgugaaaccgcuggaugaccgguuugcuaaggcccucacagcucugaaugauaugggaaaggucagaaaagacauucaacagugggagccuucucgcggcuggaacgauuggacccaggugcccuucugcagccaccauuuucacgaacugaucaugaaggacgggcggacgcucguugugcccuguagaaaucaggacgagcugauuggacgcgcccggaucucccaaggcgcgggguggucucuuagagaaacagccugccugggcaaaagcuacgcucagauguggucccucauguauuuccaucgccgggaucugagacuugccgcuaacgccaucuguucugcggucccuagccacugggugccgaccucccggaccacauggagcauucacgccucucaugaguggaugaccacagaagacaugcugacgguguggaacagaguuuggauccucgagaaucccuggauggaggauaagaccccuguggaauccugggaggaaauucccuaccugggaaaacgcgaggaccaguggugcggcagccugaucgggcucacaucucgggcuaccugggccaagaacauucagacagcuaucaaucaagucagaucccugauuggaaacgaagaguauaccgauuacaugccuagcaugaagcgcuuuagacgggaggaagaggaagccggcgugcuuugguga

SEQ ID NO: 20316 - RNA, 9876 nt, Artificial Sequence
  derived and/or modified CDS sequence (opt5) from DENV-2__DQ645545__SS-prME
accgccggcgugaucauuaugaugauccccacagucguugcuuuccaccugacgacccggaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuuagacaaaacgaacccgaggacauugauuguuggugcaauucuacaagcaccugggucacguauggaaccuguacagcgaccggcgagcaccggcgggaaaaacgcuccguggcucugguuccucauguggggaugggacucgagacaagaaccgaaacguggaugucuagccagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggagggcgucagcgggggauccuggguggauauugugcuggaacacggcagcugugucaccacaauggccaaaaauaagcccacccucgacuucgagcugaucaagacagaagcuaaacacccugccacccuuagaaaguacugcaucgaggcuaaacugacgaacacaaccaccgccucucgguguccgacacaaggggaacccucccucaaugaggagcaggauaagcgcuuuguuugcaaacauagcaugguggacagaggauggggcaacggcugugggcuguucggaaagggcgggauugugaccugcgcgauguuuacaugcaagaaaaauauggaaggaaaggucgugcagccugagaaccuggaauauacgaucguuauuacaccccacucuggcgaggaaaaugccguggggaacgauacaggaaaacauggcaaggagaucaaagucaccccucaguccagcauuacagaggcugaacucaccggcuacgggacggugaccauggaguguucuccccggacaggacuggacuucaaugaaaugguucuucugcaaauggaggauaaggccuggcucgugcaccgccagugguuucuggaccuuccgcugccuuggcuccccggcgcugauacccagggguccaacuggauccagaaagaaacacuggucaccuucaagaacccucacgccaagaaacaagacguggucgugcugggaagccaggagggcgccaugcauacggcucucacaggggcgaccgagauccagauguccucuggcaaucugcuuuuuacaggacaccugaagugcagacuccggauggacaaacugcaacuuaagggcaugagcuauuccauguguaccgggaaauucaagguugugaaggaaauugccgagacccagcauggaacaaucgucauuagagugcaguacgaaggcgaugggagccccugcaaaauccccuucgagauuauggaccuggagaagcgccacguucucggacggcugaucacggugaacccuaucgucaccggcaaagauucuccggugaauauugaagcugagcccccuuuuggggacuccuacaucauuaucggcguggaacccggacagcugaagcucagcugguucaaaaagggcucuagcauugggcaaauguuugagacaaccaugagaggagccaagcgcauggccauccugggcgauacagcuugggacuucgggucccuuggaggcguuuuuaccucuauugggaaagcccugcaucaggucuucggcgcgaucuauggagcugccuuuagcggcguguccuggacgaugaagauccucauugggguggucaucacauggauuggaaugaacagccggucuaccucccugagcgugucucugguucuugugggcgucgugacccucuaccuggggguuauggugcaggccgauuccggaugugucgugagcuggaaaaauaaggaacugaaaugcggcuccgggaucuucauuacagacaacguucacaccuggacagagcaguauaaguuucaaccugagucucccagcaagcucgcuuccgccauccagaaagcucacgaagagggcaucuguggaauuagaucugugacgcgccuggaaaaucuuauguggaagcagaucaccccggagcugaaccauauucucagcgaaaaugaggucaaacugacaaucaugaccggcgauauuaaggggaucaugcaggccggaaaacggucccugagaccucaacccacagagcuuaaguacagcuggaaagcguggggcaaggccaagaugcucucuaccgaacugcacaaccauacguuccugaucgacgggccugagaccgcugaaugccccaauacaaaccgcgccuggaauagccucgagguggaagauuauggauuuggcguguucaccacaaacauuuggcugaaacuuaaggagcggcaggacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggggugcuggaaagcgagaugaucauccccaagaauuucgcuggaccggucucucagcacaacuaucgcccuggcuaccauacccagacggccgggcccuggcaccuuggaaaacucgagauggacuuugauuucugugaaggcacaaccgugguugugaccgaggacugcgggaaucggggacccucccugagaacaaccacggccagcggcaagcugauuacagaauggugcugucgguccugcacccucccuccgcugcgcuacagaggcgaggauggguguugguauggaauggaaauccggccccuuaaagagaaggaggaaaaccuggucaauucucucgugacagcuggccaugggcaaauugacaacuuuagccugggaguucugggcauggcgcuuuuccucgaggaaaugcugagaacccgcguggggacaaagcacgccauccugcucgucgcuguguccuuuguuacccugauuacgggaaauaugucuuuccgggaucuuggcagagugauggucauggugggcgccaccaugacagacgauaucgggaugggagugaccuaccuggcccuccuggcugccuuuaaaguccgcccuacauucgcggcuggccugcuucugagaaagcucaccagcaaagagcugaugaugacgacaauugggaucguucuccugucccagucuaccauccccgaaacaauucuugagcugaccgacgcccucgcccugggaaugauggugcugaagaucgugcggaacauggagaaauaucagcuugcugucaccauuauggccauccugugcgugccuaaugcgguuauucuccaaaacgcuuggaaggugagcuguacaauccuggccgucguguccguuagcccccuccugcuuacgucuucccagcagaaggccgauuggaucccucuggcucucaccauuaaaggccugaaucccacagccaucuuucugaccacacuuagccgcaccucuaagaaaagauccuggccgcugaacgaagcuauuauggccguggggauggucagcauccucgcgucuucccugcucaagaaugacauuccuaugacgggaccccugguggccggcggccuucugacagucugcuacgugcugaccgggcggagcgcugaccucgagcuggaacgcgccgcugauguuagaugggaggaacaggccgagaucuccggaagcucuccuauccuuagcauuaccaucuccgaggacggcucuaugagcauuaaaaacgaagaggaggaacaaacacugaccauccucauucggacagggcugcucgugaucuccggacuguuccccgucucuauuccgaucacggccgcugcgugguaucuuugggaggugaagaaacagcgcgccggcguucugugggaugugccuucucccccucccgucgggaaggcugaacuggaggacggagccuacagaaucaagcagaaaggcauucucggcuauucccagaucggggccggaguguacaaggaaggcaccuuucacacaauguggcaugugaccagaggggcuguucugaugcacaaaggaaagcgcauugagcccuccugggccgaugucaaaaaggaccuuaucagcuacggcgggggauggaagcuggaaggcgaguggaaagagggcgaagaggugcaagugcucgcgcuggaaccugggaagaauccgagagcuguccagacaaaacccggacucuucaagaccaacacgggcaccauuggggccgugucccuggauuuuagcccuggaacaucuggcucccccaucguugacaaaaaggggaagguggucggacuuuauggcaacggcgugguuacccggagcgggacauacgugucugccaucgcucagaccgagaaauccauugaagauaauccugagaucgaggacgauauuuucagaaagaaacgccugacaaucauggaccugcaucccggagccggcaagacgaaacgguaucucccugcgauugucagagaagcuaucaagcgcgggcugcggacccuuauccuggccccgacaagagugguugccgcugagauggaagaggcccuccgcggacugcccauucgguaccagaccccugcuaucagagccgaacacaccggccgcgagauuguggaucucaugugucaugcgacauucacgaugcggcugcuuagccccaucagagucccuaacuauaaucugauuaucauggacgaggcccacuuuaccgaccccgcuuccauugccgcucggggguacaucucuacacgcguggaaaugggcgaggccgccggaaucuucaugaccgcuacaccgccuggcagcagagaucccuuuccccaauccaacgcgccuauuauggacgaagaacgggagauccccgaacgcagcuggaacucugggcacgagugggugaccgauuucaagggaaaaacggucugguuuguuccuuccauuaaggccggcaacgacaucgcugccugccugcgcaaaaaugggaagaaagugauucagcucagccggaagacauucgauucugaauaugugaagaccagaaccaacgacugggauuuugucgugacaaccgacaucagcgagaugggagccaauuucaaagcugaacgcguuaucgauccgcggagauguaugaagcccgugauucugacagacggcgaggagcgcgucauccuugccgggccuaugcccgugacccauuccucugcggcucagcggagaggccgcguuggacggaacccuaaaaaugaaaacgaucaauacauuuacaugggcgagccccuggaaaaugacgaggacugcgcccacuggaaggaagccaaaaugcuccuggauaacaucaauacgccggaggggauuaucccuagcauguuugagcccgaaagagagaagguggacgcuaucgauggagaauaucgccugagaggcgaggcccggaaaacauucgucgaccucaugcgcagaggggaucuuccuguguggcuggcguaccgggucgccgcugaaggaauuaacuaugccgaccgcagaugguguuuugauggcgugaagaacaaucagauccuggaggagaacguugaaguggagauuuggaccaaggaaggggagcggaaaaagcucaaacccagauggcuggacgcucgcaucuacuccgauccucuugcccugaaggaguucaaagaguucgcugccggccggaagucucucacacugaaucugauuaccgagaugggaagacuccccacguuuaugacccagaaggcgcgcaacgcccuugacaaucuggcugugcugcauacagccgaagcuggcgggcgggccuauaaccacgcccucagcgagcugccggaaacccuugagacacugcuccugcugacccuccuugcuacagucaccggaggcaucuuccuguuucugauguccgggaaaggaauuggcaagaugacgcucggcaugugcugcaucaucacagcgagcguucugcuuugguacgcccagauucaaccucacuggaucgcugccucuauuauccuggaguucuuucucauugugcugcugauccccgaacccgagaaacagagaaccccucaggauaaucagcucaccuauguggucaucgccauucuuacagugguugcugccaccauggcgaacgaaaugggguuccuggagaagaccaaaaaggacuuuggacugggcgggaucgccacgcaacagccggaauccaauauucucgauaucgaccugcggcccgcuagcgccuggacccuuuacgcuguggccacaaccuucauuacaccuaugcugcgccauuccaucgagaacucuagcgucaaugugucccucaccgcgaucgccaaccaggcuacgguccugaugggacugggcaagggguggccccucucuaaaauggacauuggagugccucuucuggccaucggcuguuacagccagguuaaucccauuacccugacagcugcccuccugcuucugguggcucacuaugccaucauuggcccugggcuccaagcgaaggccaccagagaggcucagaaacgggccgcugccggaaucaugaagaacccgacagucgauggcauuaccgugaucgaccuggaucccaucccuuacgaccccaaauuugaaaagcagcuggggcagguuaugcuccuugugcugugcgucacgcaagugcugaugaugcgcacaaccugggcccucugugaggcgcugacacuugcuaccggaccuauuuccacccugugggaaggcaaucccgggagauucuggaacacaacgaucgccgugagcauggcuaauauuuuucggggaucuuaucucgccggcgccggccugcuguucuccaucaugaagaacaccgcuaacacacgcagagggaccggaaauacaggcgagacccucggggaaaaauggaagaaccggcuuaaugcccugggaaaaagcgaguuucagauuuacaagaaaucuggcauccaggagguugaucgcacgcuggcgaaggaagggaucaaaagaggagagacagaccaucacgccgucucccggggcagcgcuaagcucagaugguucguggaacgcaaccuggugaccccggagggcaaggucauggaucuugggugcggacggggcggguggucuuauuacuguggaggccugaaaaauguuaaggaggugaaagggcucaccaagggaggcccuggccaugaggaacccauucccaugagcacauauggguggaaccuggugagacugcaauccggagucgacguguucuuuaccccucccgaaaaaugcgauacacuccuuugugacaucggcgagucuagcccuaauccgacgguugaagccgggcgcacccugcgggugcugaaccucgucgagaauuggcugaacaauaacacacaguucugcauuaaggugcuuaaucccuacaugccuuccguuaucgagaagauggaagcucugcagagaaaauacggaggcgcccucgugcgcaacccccugagcagaaauuccacccacgagauguauugggucucuaacgcgagcgggaacauuguguccucugugaauaugaucagcagaaugcugaucaaccgcuuuacaaugcggcacaagaaagccaccuacgaaccugaugucgaccucggauccggcacgagaaauauuggcaucgagucugaaacccccaaccuugauauuaucgggaagcgcauugagaaaaucaagcaggagcaugaaacaagcuggcacuaugaccaagaccauccguacaagaccugggcuuaucacggauccuacgagacaaaacagaccggcagcgccucuuccaugguuaaugggguggugcggcugcugacaaagccuugggaugucauccccauggugacccagauggcuaugacggacacaaccccuuucggacagcaaagaguuuuuaaagaaaagguggauacccgcacacaggagcccaaagaaggcacgaagaagcucaugaaaauuaccgccgaguggcuguggaaggagcuugggaaaaagaaaacaccuagaauguguacccgggaagaguucacacgcaaggucagaagcaacgcugcccugggagcgaucuuuaccgacgaaaauaaauggaagucugcccgggaggcuguggaggauuccggcuucugggaacucguugacaaggagagaaaccugcaccuggaaggcaaaugcgagacauguguguauaauaugauggggaagcgggagaaaaagcucggagaguuuggcaaagccaaggggagccgcgcuauuugguacauguggcugggagccagauuccuugaguuugaagcccugggcuuccucaacgaggaucauugguuuucucgggaaaauucccugagcggggucgagggcgaaggacuucacaagcugggcuacauccuccgcgacguguccaaaaaggaaggcggggcgauguaugcugaugacaccgccgggugggauacgagaauuacccuggaggaccugaaaaacgaagagaugguuacaaaucauauggaaggggagcacaagaaacucgccgaagcuaucuucaagcugaccuaccagaacaaggugguccgggugcagcgccccacaccgagaggaaccgucauggacauuaucagccggcgcgaucaaagaggcucuggacaggugguuacguauggccuuaauacauucaccaacauggaggcccagcugauccggcaaauggagggagaaggcguguuuaaaagcauucagcagcucacagcuaccgaggaaaucgccgucaagaacuggcuggcgcgcguggggagagagcggcuuucccgcauggccauuucuggagacgauugcgugguuaaaccucuggacgauagauucgcuagcgcccucacggcucugaaugacaugggcaaggugcggaaagauauccagcaaugggagcccuccagaggguggaacgacuggacccagguccccuuuugcucucaucacuuccacgaacugauuaugaaggauggacgcgugcucguugugccuugucggaaucaggacgagcugaucggcagagcccgcaucagccagggggcgggcuggucccuucgggaaacagccugccugggaaagucuuacgcucaaauguggagccucauguauuuucauagacgcgaucugcggcuugccgcuaacgccauuuguuccgcugucccgagccacugggugcccaccucuagaacaaccugguccauccaugccacacacgaguggaugaccacggaagacaugcugacagucuggaaucgcguguggauucaggagaacccuuggaucgaggauaaaacccccguugaaagcugggaggaaauuccuuaccucggcaagcgggaggaccaguggugcgggucucugaucggacugaccuccagagcgacaugggccaaaaauauccagaccgcuauuaaccaagugcgcagccucaucggcaaugaagaguauacagacuacaugcccuccaugaagcgguucagacgggaggaagaggaagccgggguccugugguga

SEQ ID NO: 20317 - RNA, 9876 nt, Artificial Sequence
  derived and/or modified CDS sequence (opt5) from DENV-2__DQ645546__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuacaagaaaucuggaauccaggagguugaucgcacgcuggcgaaggaaggcaucaaaagaggggagacagaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucaccaaaggcgggccugggcaugaagaacccauucccaugagcacauauggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauacgggggagcccucgugcgcaacccccugagcagaaauuccacccacgagauguauugggucucuaacgcgagcggcaacauuguguccucugugaauaugaucagcagaaugcugaucaaccgcuuuacaaugcggcacaagaaagccaccuacgaaccugaugucgaccucggguccggaacgagaaauauuggcaucgagucugagacccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguauaauaugaugggcaagcgggagaaaaagcucggggaauuuggaaaagccaagggcagccgcgcuauuugguacauguggcugggggccagauuccuugaguuugaagcccugggauuccucaacgaggaucauugguuuucucgggaaaauucccugagcggcgucgagggggagggccuucacaagcugggauacauccuccgcgacguguccaaaaaggaaggcggggcgauguaugcugaugacaccgccggaugggauacgagaauuacccuggaggaccugaaaaacgaagagaugguuacaaaucauauggaaggcgagcacaagaaacucgccgaggcuaucuucaagcugaccuaccagaacaaggugguccgggugcagcgccccacaccgagagggaccgucauggacauuaucagccggcgcgaucagagaggaucuggccaagugguuacguaugggcuuaauacauucaccaacauggaagcccagcugauccggcagauggagggcgaaggaguguuuaaaagcauucaacagcucacagcuaccgaggagaucgccgucaagaacuggcuggcgcgcgugggcagagaacggcuuucccgcauggccauuucuggggacgauugcgugguuaaaccucuggacgauagauucgcuagcgcccucacggcucugaaugacaugggaaaggugcggaaagauauccagcagugggagcccuccagaggcuggaacgacuggacccaaguccccuuuugcucucaucacuuccacgaacugauuaugaaggaugggcgcgugcucguugugccuugucggaaucaggacgagcugaucggacgggcccgcaucagccagggcgcgggguggucccuucgggaaacagccugccugggcaagucuuacgcucagauguggagccucauguauuuucauagacgcgaucugcggcuugccgcuaacgccauuuguuccgcugucccgagccacugggugcccaccucuagaacaaccugguccauccaugccacacacgaguggaugaccacggaggacaugcugacagucuggaaucgcguguggauucaagaaaacccuuggaucgaggauaaaacccccguugaaagcugggaggaaauuccuuaccucggaaagcgggaggaccaguggugcggcucucugaucgggcugaccuccagagcgacaugggccaaaaauauccagaccgcuauuaaccaggugcgcagccucaucggaaaugaggaauauacagacuacaugcccuccaugaagcgguucagacgggaggaagaggaagccggcguccugugguga

SEQ ID NO: 20318 - RNA, 9876 nt, Artificial Sequence
  derived and/or modified CDS sequence (opt5) from DENV-2__DQ645547__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaaguacgccauccugcucgucgcuguguccuuuguuacccugauuacggggaauaugucuuuccgggaucuuggaagagugauggucauggugggcgccaccaugacagacgauaucggcaugggggugaccuaucuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaccagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuaugugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaccuuugggaggugaagaaacaacgcgccggaguucugugggaugugccuucucccccucccgucggcaaggcugaacuggaggacggggccuauagaaucaagcagaaaggcauucucggcuacucccagaucggcgccgggguguacaaggaaggaaccuuucacacaauguggcacgugacccggggcgcuguucugaugcauaaagggaagcgcauugagcccuccugggccgaugucaaaaaggaccuuaucagcuauggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuacggaaacggcgugguuacccggagcggcacauaugugucugccaucgcucagaccgagaaauccauugaggauaauccugaaaucgaggacgauauuuucagaaagaaacgccugacaaucauggaccugcaccccggggccggaaagacgaaacgguaccucccugcgauugucagagaagcuaucaagcgcggccugcggacccuuauccuggccccgacaagagugguugccgcugagauggaagaggcccuccgcgggcugcccauucgguaucagaccccugcuaucagagccgagcauaccggacgcgaaauuguggaucucaugugucacgcgacauucacgaugcggcugcuuagccccaucagagucccuaacuacaaucugauuaucauggacgaggcccauuuuaccgaccccgcuuccauugccgcucggggcuauaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauacgugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccacuccucugcggcucagcggagagggcgcguuggccggaacccuaaaaaugaaaacgaucaguacauuuauaugggagagccccuggaaaaugacgaggacugcgcccauuggaaggaggccaaaaugcuccuggauaacaucaauacgccggaaggcauuaucccuagcauguuugagcccgaaagagagaagguggacgcuaucgauggggaauaccgccugagaggagaggcccggaaaacauucgucgaccucaugcgcagaggcgaucuuccuguguggcuggcguaucgggucgccgcugaggggauuaacuacgccgaccgcagaugguguuuugauggagugaagaacaaucaaauccuggaagagaacguugaaguggagauuuggaccaaggagggcgaacggaaaaagcucaaacccagauggcuggacgcucgcaucuauuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcacacagccgaagcuggaggccgggccuacaaccaugcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguaugcccagauucagccucacuggaucgcugccucuauuauccuggaguucuuucucauugugcugcugauccccgaacccgagaaacaaagaaccccucaggauaaucagcucaccuacguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccacuccaucgaaaacucuagcgucaaugugucccucaccgcgaucgccaaccaggcuacgguccugauggggcugggaaagggcuggccccucucuaaaauggacauuggggugccucuucuggccaucggauguuauagccagguuaaucccauuacccugacagcugcccuccugcuucugguggcucauuacgccaucauuggcccuggccuccaggcgaaggccaccagagaggcucaaaaacgggccgcugccgggaucaugaagaacccgacagucgauggaauuaccgugaucgaccuggaucccaucccuuaugaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaccucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuauaagaaaucuggaauccaggagguugaucgcacgcuggcgaaggaaggcaucaaaagaggggagacagaccaccaugccgucucccggggaagcgcuaagcucagaugguucguggagcgcaaccuggugaccccggaaggcaaggucauggaucuuggcugcgggcggggaggcuggucuuacuauugugggggacugaaaaauguuaaggaggugaaaggccucaccaaaggcgggccugggcacgaagaacccauucccaugagcacauacggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauaugggggagcccucgugcgcaacccccugagcagaaauuccacccaugagauguacugggucucuaacgcgagcggcaacauuguguccucugugaauaugaucagcagaaugcugaucaaccgcuuuacaaugcggcacaagaaagccaccuaugaaccugaugucgaccucggguccggaacgagaaauauuggcaucgagucugagacccccaaccuugauauuaucggcaagcgcauugagaaaaucaagcaggagcacgaaacaagcuggcauuacgaccaggaccacccguauaagaccugggcuuaccauggguccuaugagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguacaauaugaugggcaagcgggagaaaaagcucggggaauuuggaaaagccaagggcagccgcgcuauuugguacauguggcugggggccagauuccuugaguuugaagcccugggauuccucaacgaggaucacugguuuucucgggaaaauucccugagcggcgucgagggggagggccuucauaagcugggauauauccuccgcgacguguccaaaaaggaaggcggggcgauguacgcugaugacaccgccggaugggauacgagaauuacccuggaggaccugaaaaacgaagagaugguuacaaaucacauggaaggcgagcauaagaaacucgccgaggcuaucuucaagcugaccuaucagaacaaggugguccgggugcagcgccccacaccgagagggaccgucauggacauuaucagccggcgcgaucagagaggaucuggccaagugguuacguacgggcuuaauacauucaccaacauggaagcccagcugauccggcagauggagggcgaaggaguguuuaaaagcauucaacagcucacagcuaccgaggagaucgccgucaagaacuggcuggcgcgcgugggcagagaacggcuuucccgcauggccauuucuggggacgauugcgugguuaaaccucuggacgauagauucgcuagcgcccucacggcucugaaugacaugggaaaggugcggaaagauauccagcagugggagcccuccagaggcuggaacgacuggacccaaguccccuuuugcucucaccauuuccacgaacugauuaugaaggaugggcgcgugcucguugugccuugucggaaucaggacgagcugaucggacgggcccgcaucagccagggcgcgggguggucccuucgggaaacagccugccugggcaagucuuaugcucagauguggagccucauguacuuucacagacgcgaucugcggcuugccgcuaacgccauuuguuccgcugucccgagccauugggugcccaccucuagaacaaccugguccauccacgccacacaugaguggaugaccacggaggacaugcugacagucuggaaucgcguguggauucaagaaaacccuuggaucgaggauaaaacccccguugaaagcugggaggaaauuccuuaucucggaaagcgggaggaccaguggugcggcucucugaucgggcugaccuccagagcgacaugggccaaaaauauccagaccgcuauuaaccaggugcgcagccucaucggaaaugaggaauacacagacuacaugcccuccaugaagcgguucagacgggaggaagaggaagccggcguccugugguga

SEQ ID NO: 20319 - RNA, 9876 nt, Artificial Sequence
  derived and/or modified CDS sequence (opt5) from DENV-2__DQ645549__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuacaagaaaucuggaauccaggagguugaucgcacgcuggcgaaggaaggcaucaaaagaggggagacagaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucaccaaaggcgggccugggcaugaagaacccauucccaugagcacauauggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauacgggggagcccucgugcgcaacccccugagcagaaauuccacccacgagauguauugggucucuaacgcgagcggcaacauuguguccucugugaauaugaucagcagaaugcugaucaaccgcuuuacaaugcggcacaagaaagccaccuacgaaccugaugucgaccucggguccggaacgagaaauauuggcaucgagucugagacccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagugaaggucgauacccgcacacaagaacccaaagagggaacgaagaagcucaugaaaauuaccgccgaguggcuguggaaggaacuuggcaaaaagaaaacaccuagaauguguacccgggaggaguucacacgcaaggugagaagcaacgcugcccugggggcgaucuuuaccgacgagaauaaauggaagucugcccgggaggcuguugaagauuccggauucugggagcucguggacaaggaaagaaaccugcaccuggagggcaaaugcgaaacaugugucuauaauaugaugggcaagcgggagaaaaagcucggggaguuuggaaaagccaagggcagccgcgcuauuugguacauguggcugggggccagauuccuugaauuugaggcccugggauuccucaacgaagaucauugguuuucucgggaaaauucccugagcggcguggaaggggagggccuucacaagcugggauacauccuccgcgacguuuccaaaaaggagggcggggcgauguaugcugaugacaccgccggaugggauacgagaauuacccuggaagaccugaaaaacgaggaaauggugacaaaucauauggagggcgaacacaagaaacucgccgaggcuaucuucaagcugaccuaccagaacaaggucgugcggguccagcgccccacaccgagagggaccgugauggacauuaucagccggcgcgaucagagaggaucuggccaaguugugacguaugggcuuaauacauucaccaacauggaggcccagcugauccggcagauggaaggcgagggagucuuuaaaagcauucaacagcucacagcuaccgaagagaucgccgugaagaacuggcuggcgcgcgugggcagagagcggcuuucccgcauggccauuucuggggacgauugcguugugaaaccucuggacgauagauucgcuagcgcccucacggcucugaaugacaugggaaagguccggaaagauauccagcagugggaacccuccagaggcuggaacgacuggacccaagugcccuuuugcucucaucacuuccacgagcugauuaugaaggaugggcgcguucucguggucccuugucggaaucaggacgaacugaucggacgggcccgcaucagccagggcgcgggguggucccuucgggagacagccugccugggcaagucuuacgcucagauguggagccucauguauuuucauagacgcgaucugcggcuugccgcuaacgccauuuguuccgcugugccgagccacuggguccccaccucuagaacaaccugguccauccaugccacacacgaauggaugaccacggaggacaugcugacaguguggaaucgcguuuggauucaagagaacccuuggaucgaagauaaaacccccguggagagcugggaagagauuccuuaccucggaaagcgggaagaccaguggugcggcucucugaucgggcugaccuccagagcgacaugggccaaaaauauccagaccgcuauuaaccagguccgcagccucaucggaaaugaggaguauacagacuacaugcccuccaugaagcgguucagacgggaagaggaagaggccggcgugcugugguga

SEQ ID NO: 20320 - RNA, 9876 nt, Artificial Sequence
  derived and/or modified CDS sequence (opt5) from DENV-2__DQ645550__SS-prME
accgccggagugaucauuaugaugauccccacggugguugcuuuccaccugacgaccagaaauggggaaccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaagaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagacucuggaacacaacgaucgccgugagcauggcuaauauuuuccgggggucuuaucuggccggagccggccugcucuuuuccaucaugaagaacaccgcuaacacacgcagaggcaccgggaauacaggagagacccuuggcgagaaauggaagaaccggcugaaugcccuggggaaaagcgaguuccaaauuuacaagaaaucuggaauccaggagguugaucgcacgcucgcgaaggaaggcaucaaaagaggggagacagaccaucacgccgucucccggggaagcgcuaagcugagaugguuuguggagcgcaaccuugugaccccggaaggcaaggucauggaucugggcugcgggcggggaggcuggucuuauuacugugggggacucaaaaauguuaaggaggugaaaggccugaccaaaggcgggccugggcaugaagaacccauucccaugagcacauauggcuggaaccuggugagacuccaguccggggucgacguguucuucaccccucccgaaaaaugcgauacacuucugugugacaucggagagucuagcccuaauccgacgguugaggccggccgcacccugcgggugcucaaccuggucgaaaauuggcuuaacaauaacacacaauuuugcauuaaggugcugaaucccuacaugccuuccguuaucgagaagauggaagcucuccagagaaaauacgggggagcccuggugcgcaacccccugagcagaaauuccacccacgagauguauugggucucuaacgcgagcggcaacauuguguccucugugaauaugaucagcagaaugcucaucaaccgcuucacaaugcggcacaagaaagccaccuacgaaccugaugucgaccuuggguccggaacgagaaauauuggcaucgagucugagacccccaaccuggauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcucacaaagccuugggaugucauccccauggugacccagauggcuaugacggacacaaccccuuuugggcagcagagaguuuucaaagugaaggucgauacccgcacacaagaacccaaagagggaacgaagaagcugaugaaaauuaccgccgaguggcuuuggaaggaacugggcaaaaagaaaacaccuagaauguguacccgggaggaauuuacacgcaaggugagaagcaacgcugcccucggggcgaucuucaccgacgagaauaaauggaagucugcccgggaggcuguugaagauuccggauuuugggagcugguggacaaggaaagaaaccugcaccucgagggcaaaugcgaaacaugugucuauaauaugaugggcaagcgggagaaaaagcugggggaguucggaaaagccaagggcagccgcgcuauuugguacauguggcuuggggccagauuucuggaguucgaggcccucggauuucugaacgaagaucauugguucucucgggaaaauucccuuagcggcguggaaggggagggccugcacaagcucggauacauccugcgcgacguuuccaaaaaggagggcggggcgauguaugcugaugacaccgccggaugggauacgagaauuacccuggaagaccucaaaaacgaggaaauggugacaaaucauauggagggcgaacacaagaaacuggccgaggcuaucuuuaaacuuaccuaccagaacaaggucgugcggguccagcgccccacaccgagagggaccgugauggacauuaucagccggcgcgaucagagaggaucuggccaaguugugacguaugggcugaauacauucaccaacauggaggcccagcucauccggcagauggaaggcgagggagucuucaaaagcauucaacagcugacagcuaccgaagagaucgccgugaagaacuggcuugcgcgcgugggcagagagcggcugucccgcauggccauuucuggggacgauugcguugugaaaccucucgacgauagauuugcuagcgcccugacggcucugaaugacaugggaaagguccggaaagauauccagcagugggaacccuccagaggcuggaacgacuggacccaagugcccuucugcucucaucacuuucacgagcucauuaugaaggaugggcgcguucugguggucccuugucggaaucaggacgaacuuaucggacgggcccgcaucagccagggcgcgggguggucccugcgggagacagccugccucggcaagucuuacgcucagauguggagccugauguauuuccauagacgcgaucuucggcuggccgcuaacgccauuuguuccgcugugccgagccacuggguccccaccucuagaacaaccugguccauccaugccacacacgaauggaugaccacggaggacaugcucacaguguggaaucgcguuuggauucaagagaacccuuggaucgaagauaaaacccccguggagagcugggaagagauuccuuaccugggaaagcgggaagaccaguggugcggcucucugaucgggcucaccuccagagcgacaugggccaaaaauauccagaccgcuauuaaccagguccgcagccugaucggaaaugaggaguauacagacuacaugcccuccaugaagcgguuuagacgggaagaggaagaggccggcgugcuuugguga

SEQ ID NO: 20321 - RNA, 9876 nt, Artificial Sequence
  derived and/or modified CDS sequence (opt5) from DENV-2__DQ645551__SS-prME
accgccggagugaucauuaugaugauccccaccgugguugcuuuccaccugacgaccagaaauggggagccucauaugauugugagccggcaggaaaagggaaaaucccuccuguuuaagacggagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuauaccgaccgcagaugguguuuugauggagugaagaacaaucaaauccuggaagagaacguugaaguggagauuuggacaaaggagggcgaacggaaaaagcucaaacccagauggcuggacgcccgcaucuacuccgauccucuugcucugaaggaguucaaagaguucgccgcugggcggaagucucucacccugaaucugauuacggagaugggcagacuccccaccuuuaugacacagaaggcccgcaacgcgcuugacaaucuggccgugcugcauaccgcugaagccggaggccgggcuuauaaccacgcccucagcgagcugccggagacacuugaaacccugcuccugcugacacuccuugccaccgucacaggcgggaucuuccuguuucugauguccgggaaagggauuggaaagaugacacucggcaugugcugcaucaucaccgcuagcguucugcuuugguacgcgcagauucagccucacuggaucgccgcuucuauuauccuggaguucuuucucauugugcugcugauccccgaacccgagaaacaaagaaccccucaggauaaucagcucacauauguggucaucgccauucuuaccgugguugccgcuacaauggccaacgaaaugggcuuccuggagaagacgaaaaaggacuuugggcugggaggcaucgcgacccagcaaccggaguccaauauucucgauaucgaccugcggcccgccagcgcuuggacacuuuacgccguggcuaccacauucauuaccccuaugcugcgccauuccaucgaaaacucuagcgucaaugugucccucacggccaucgcgaaccaggccaccguccugauggggcugggaaagggcuggccccucucuaaaauggacauuggggugccucuucuggcuaucggauguuacagccagguuaaucccauuacacugaccgccgcucuccugcuucugguggcccacuaugcuaucauuggcccuggccuccaggccaaggcgacaagagaggcccaaaaacgggcugccgcugggaucaugaagaacccgaccgucgauggaauuacggugaucgaccuggaucccaucccuuacgaccccaaauuugaaaagcagcugggccagguuaugcuccuugugcugugcgucacacaggugcugaugaugcgcaccacaugggcccucugugaggcccugacccuugcgaccgggccuauuuccacacugugggaaggaaaucccggcagauucuggaacacgaccaucgcugugagcauggccaauauuuuucgggggucuuaucucgcuggagccggccugcuguucuccaucaugaagaacacagccaacacccgcagaggcacagggaauaccggagagacgcucggcgagaaauggaagaaccggcuuaaugcucuggggaaaagcgaauuucaaauuuacaagaaaucuggaauccaggagguugaucgcacacuggccaaggaaggcaucaaaagaggggagaccgaccaucacgcggucucccggggaagcgccaagcucagaugguucguggagcgcaaccuggugaccccggaaggcaaggucauggaucuuggcugcgggcggggaggcuggucuuauuacugugggggacugaaaaauguuaaggaggugaaaggccucacaaaagggggaccuggccaugaagaacccauucccaugagcaccuauggcuggaaccuggugagacugcaguccggggucgacguguucuuuacaccucccgaaaaaugcgauacgcuccuuugugacaucggagagucuagcccuaauccgaccguugaggcuggccgcacacugcgggugcugaaccucgucgaaaauuggcugaacaauaacacccaauucugcauuaaggugcuuaaucccuacaugccuuccguuaucgagaagauggaagcccugcagagaaaauacgggggagcucucgugcgcaacccccugagcagaaauuccacacacgagauguauugggucucuaacgccagcggcaacauuguguccucugugaauaugaucagcagaaugcugaucaaccgcuuuaccaugcggcacaagaaagcgacguacgaaccugaugucgaccucggguccggaaccagaaauauuggcaucgagucugagacacccaaccuugauauuaucggcaagcgcauugagaaaaucaagcaggagcaugaaaccagcuggcacuaugaccaggaccauccguacaagacaugggccuaucacggguccuacgagaccaaacaaacaggaagcgcuucuuccaugguuaauggcguggugcggcugcugaccaagccuugggaugucauccccauggugacgcagauggccaugacagacaccaccccuuucgggcagcagagaguuuuuaaagaaaagguggauacacgcacgcaagagcccaaagagggaaccaagaagcucaugaaaauuacagcugaauggcuguggaaggagcuuggcaaaaagaaaaccccuagaauguguacacgggaagaguucacccgcaaggucagaagcaacgccgcucugggggccaucuuuacagacgagaauaaauggaagucugcgcgggaagccguggaggauuccggauucugggaacucguugacaaggagagaaaccugcaccuggaaggcaaaugcgagaccuguguguauaauaugaugggcaagcgggagaaaaagcucggggaauuuggaaaagcuaagggcagccgcgccauuugguacauguggcugggggcuagauuccuugaguuugaagcccugggauuccucaacgaggaucauugguuuucucgggaaaauucccugagcggcgucgagggggagggccuucacaagcugggauacauccuccgcgacguguccaaaaaggaaggcggggccauguaugcggaugacacggcuggaugggauaccagaauuacacuggaggaccugaaaaacgaagagaugguuaccaaucauauggaaggcgagcacaagaaacucgccgaggccaucuucaagcugacauaccagaacaaggugguccgggugcagcgccccaccccgagagggacggucauggacauuaucagccggcgcgaucagagaggaucuggccaagugguuacauaugggcuuaauaccuucacaaacauggaagcucagcugauccggcagauggagggcgaaggaguguuuaaaagcauucaacagcucaccgccacggaggagaucgcugucaagaacuggcuggcccgcgugggcagagaacggcuuucccgcauggcgauuucuggggacgauugcgugguuaaaccucuggacgauagauucgccagcgcucucaccgcccugaaugacaugggaaaggugcggaaagauauccagcagugggagcccuccagaggcuggaacgacuggacacaaguccccuuuugcucucaucacuuccacgaacugauuaugaaggaugggcgcgugcucguugugccuugucggaaucaggacgagcugaucggacgggcucgcaucagccagggcgccggguggucccuucgggaaaccgcgugccugggcaagucuuacgcccagauguggagccucauguauuuucauagacgcgaucugcggcuugcugccaacgcuauuuguuccgccgucccgagccacugggugcccacaucuagaaccacaugguccauccaugcuacccacgaguggaugacgacagaggacaugcugaccgucuggaaucgcguguggauucaagaaaacccuuggaucgaggauaaaacccccguugaaagcugggaggaaauuccuuaccucggaaagcgggaggaccaguggugcggcucucugaucgggcugacauccagagccaccugggcgaaaaauauccagacagccauuaaccaggugcgcagccucaucggaaaugaggaauauacggacuacaugcccuccaugaagcgguucagacgggaggaagaggaagcuggcguccugugguga

SEQ ID NO: 20322 - RNA, 9876 nt, Artificial Sequence
  derived and/or modified CDS sequence (opt5) from DENV-2__DQ645552__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuacaagaaaucuggaauccaggagguugaucgcacgcuggcgaaggaaggcaucaaaagaggggagacagaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucaccaaaggcgggccugggcaugaagaacccauucccaugagcacauauggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauacgggggagcccucgugcgcaacccccugagcagaaauuccacccacgagauguauugggucucuaacgcgagcggcaacauuguguccucugugaauaugaucagcagaaugcugaucaaccgcuuuacaaugcggcacaagaaagccaccuacgaaccugaugucgaccucggguccggaacgagaaauauuggcaucgagucugagacccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguauaauaugaugggcaagcgggagaaaaagcucggggaauuuggaaaagccaagggcagccgcgcuauuugguacauguggcugggggccagauuccuugaguuugaagcccugggauuccucaacgaggaucauugguuuucucgggaaaauucccugagcggcgucgagggggagggccuucacaagcugggauacauccuccgcgacguguccaaaaaggaaggcggggcgauguaugcugaugacaccgccggaugggauacgagaauuacccuggaggaccugaaaaacgaagagaugguuacaaaucauauggaaggcgagcacaagaaacucgccgaggcuaucuucaagcugaccuaccagaacaaggugguccgggugcagcgccccacaagcagagggaccgucauggacauuaucucucggcgcgaucagagaggaagcggccaagugguuacguaugggcuuaauacauucaccaacauggaagcccagcugauccggcagauggagggcgaaggaguguuuaaauccauucaacagcucacagcuaccgaggagaucgccgucaagaacuggcuggcgcgcgugggcagagaacggcuuucucgcauggccauuagcggggacgauugcgugguuaaaccgcuggacgauagauucgcuuccgcccucacggcucugaaugacaugggaaaggugcggaaagauauccagcagugggagccuucuagaggcuggaacgacuggacccaaguccccuuuugcagccaucacuuccacgaacugauuaugaaggaugggcgcgugcucguugugcccugucggaaucaggacgagcugaucggacgggcccgcaucucccagggcgcgggguggucucuucgggaaacagccugccugggcaagagcuacgcucagauguggucccucauguauuuucauagacgcgaucugcggcuugccgcuaacgccauuuguagcgcugucccuucucacugggugccgaccuccagaacaaccuggagcauccaugccacacacgaguggaugaccacggaggacaugcugacagucuggaaucgcguguggauucaagaaaaccccuggaucgaggauaaaaccccuguugaaucuugggaggaaauucccuaccucggaaagcgggaggaccaguggugcggcucccugaucgggcugaccagcagagcgacaugggccaaaaauauccagaccgcuauuaaccaggugcgcucccucaucggaaaugaggaauauacagacuacaugccuucuaugaagcgguucagacgggaggaagaggaagccggcguccugugguga

SEQ ID NO: 20323 - RNA, 9876 nt, Artificial Sequence
  derived and/or modified CDS sequence (opt5) from DENV-2__DQ645553__SS-prME
accgccggagugaucauuaugaugauccccacggugguugcuuuccaccugacgaccagaaauggggagccucauaugauugugagccggcaggaaaagggaaaaucccuccuguuuaagaccgagaauggcgugaauaugugcacccuuauggccauggaccugggggaacucugugaggauacaaucaccuacaauugcccccugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcuccccugggggaguuuuuaccucuauuggcaaagcccuucaucaagucuucggggcgaucuauggcgcugccuuuagcggaguguccuggacgaugaagauccugauuggcguggucaucacauggauugggaugaacagccggucuaccucccucagcgugucucugguucuggugggagucgugacccuuuaccucggcguuauggugcaggccgauuccgggugugucgugagcuggaaaaauaaggagcugaaaugcggauccggcaucuucauuacagacaacguucacaccuggacagaacaguauaaguuucagcccgagucuccgagcaagcuggcuuccgccauccaaaaagcucacgaagaggggaucuguggcauuagaucugugacgcgccucgaaaaucugauguggaagcagaucaccccugagcuuaaccauauucugagcgagaaugaagucaaacucacaaucaugaccggagauauuaagggcaucaugcaggccgggaaacggucccugagaccccagccuacagagcugaaguacagcuggaaagcguggggaaaggccaagaugcuuucuaccgaacuccacaaccauacguuccugaucgacggccccgagaccgcugaaugcccuaauacaaaccgcgccuggaacucccuggagguggaggauuauggguuuggaguguucaccacaaacauuuggcucaaacugaaggaacggcaagacgucuuuugugacagcaaacuuaugucugcugccaucaaggauaauagagcgguucacgccgacaugggcuacuggauugaguccgcucugaacgauaccuggaaaaucgaaaaggccagcuucauugaggugaagucuugccacuggcccaaaagccauacacucugguccaacggcgugcuggagagcgaaaugaucaucccgaagaauuucgcugggccugucucucagcacaacuaucgccccggauaccauacccagacggccggccccuggcaccuggggaaacuugagauggacuuugauuucugugaaggaacaaccgugguugugaccgaggacugcggcaaucgggggccuucccucagaacaaccacggccagcggaaagcugauuacagaauggugcugucgguccugcacccugccgccccuccgcuacagaggcgaggauggcuguugguaugggauggagauccggccucugaaagaaaaggaggaaaaccuugucaauucucuggugacagcuggacauggccagauugacaacuuuagccucgggguucugggaauggcgcuguuccuugaggaaaugcucagaacccgcgugggcacaaagcacgccauccugcuggucgcuguguccuuuguuacccucauuacggggaauaugucuuuccgggaucugggaagagugauggucauggugggcgccaccaugacagacgauaucggcaugggggugaccuaccuugcccugcucgcugccuuuaaaguccgccccacauucgcggcuggacugcugcuuagaaagcugaccagcaaagagcucaugaugacgacaauuggcaucguucugcucucccaaucuaccaucccugagacaauucuggaacuuaccgacgcccuggcccucgggaugauggugcugaagaucgugcggaacauggagaaauaucagcuggcugucaccauuauggccauccuuugcgugcccaaugcgguuauucugcagaacgcuuggaaggugagcuguacaauccucgccgucguguccguuagcccucugcuccugacgucuucccaacagaaggccgauuggaucccccuugcucugaccauuaaaggacucaauccgacagccaucuuucugaccacacugagccgcaccucuaagaaaagauccuggccucuuaacgaagcuauuauggccgugggcauggucagcauccuggcgucuucccuccugaagaaugacauucccaugacggggccucucguggccggaggccugcuuacagucugcuacgugcugaccggccggagcgcugaccuggagcucgaacgcgccgcugauguuagaugggaggagcaggccgaaaucuccgggagcucucccauccugagcauuaccaucuccgaggacggaucuaugagcauuaaaaacgaagaggaggaacagacacuuaccauccugauucggacaggccuccuggugaucuccggacucuucccggucucuauuccuaucacggccgcugcgugguaucugugggaggugaagaaacaacgcgccggaguucuuugggaugugcccagcccuccgcccgucggcaaggcugaacuggaggacggggccuacagaaucaagcagaaaggcauucugggcuauucccagaucggcgccgggguguacaaggaaggaaccuuucacacaauguggcaugugacccggggcgcuguucucaugcacaaagggaagcgcauugagccuucuugggccgaugucaaaaaggaccugaucagcuacggaggcggguggaaacuugagggagaauggaaagagggcgaagagguccaggugcuggcgcucgaaccgggcaagaaucccagagcuguccaaacaaaaccugggcuguucaagaccaacacgggaaccauuggcgccgugucccucgauuuuagccccgggacaucuggauccccuaucguugacaaaaagggcaagguggucgggcuguauggaaacggcgugguuacccggagcggcacauacgugucugccaucgcucagaccgagaaauccauugaggauaaucccgaaaucgaggacgauauuuucagaaagaaacgccuuacaaucauggaccugcauccuggggccggaaagacgaaacgguaucugccggcgauugucagagaagcuaucaagcgcggccuccggacccugauccuugcccccacaagagugguugccgcugagauggaagaggcccugcgcgggcucccuauucgguaccagacccccgcuaucagagccgagcacaccggacgcgaaauuguggaucugaugugucaugcgacauucacgaugcggcuccugagcccuaucagaguccccaacuauaaucuuauuaucauggacgaggcccacuuuaccgacccggcuuccauugccgcucggggcuacaucucuacacgcguggaaaugggggaggccgccggcaucuucaugaccgcuacaccucccggaagcagagaucccuuuccucaguccaacgcgcccauuauggacgaggaacgggagaucccugaacgcagcuggaacucuggccacgagugggugaccgauuucaaggggaaaacggucugguuuguuccguccauuaaggccggaaacgacaucgcugccugccugcgcaagaauggcaagaaagugauucaacugagccggaagacauucgauucugaauaugugaagaccagaaccaacgacugggauuuugucgugacaaccgacaucagcgagaugggggccaauuucaaagcugagcgcguuaucgauccccggagauguaugaagccugugauucucacagacggagaagaaagagucauccuggccggccccaugccugugacccauuccucugcggcucagcggagagggcgcguuggccggaaccccaaaaaugaaaacgaucaguacauuuacaugggagagccgcuugaaaaugacgaggacugcgcccacuggaaggaggccaaaaugcugcucgauaacaucaauacgccugaaggcauuauccccagcauguuugagccugaaagagagaagguggacgcuaucgauggggaauaucgccugagaggagaggcccggaaaacauucgucgaccugaugcgcagaggcgaucuccccguguggcuugcguaccgggucgccgcugaggggauuaacuaugccgaccgcagaugguguuuugauggagugaagaacaaucaaauccuggaagagaacguugaaguggagauuuggaccaaggagggcgaacggaaaaagcugaaaccuagauggcucgacgcucgcaucuacuccgauccccuggcccuuaaggaguucaaagaguucgcugccgggcggaagucucugacacucaaucugauuaccgagaugggcagacugccgacguuuaugacccagaaggcgcgcaacgcccucgacaaucuugcugugcugcauacagccgaagcuggaggccgggccuauaaccacgcccugagcgagcucccugagacccuggaaacacuucugcuccugacccugcucgcuacagucaccgggggaaucuuccuuuuucugauguccggcaaagggauuggaaagaugacgcugggcaugugcugcaucaucacagcgagcguucuccugugguacgcccagauucagccccacuggaucgcugccucuauuauccuugaguucuuucugauugugcuccugauccccgaaccugagaaacaaagaaccccgcaggauaaucagcugaccuauguggucaucgccauucucacagugguugcugccaccauggcgaacgaaaugggcuuccuugagaagaccaagaaggacuuugggcugggaggcaucgccacgcagcaacccgaguccaauauucuggauaucgaccuccggccugcuagcgccuggacccuguacgcuguggccacaaccuucauuacacccaugcuucgccauuccaucgaaaacucuagcgucaaugugucccugaccgcgaucgccaaccaggcuacgguccucauggggcugggaaagggcuggccucugucuaaaauggacauuggggugccccuccuugccaucggauguuacagccagguuaauccuauuacccugacagcugcccugcuccugcuuguggcucacuaugccaucauuggcccgggccugcaggcgaaggccaccagagaggcucaaaaacgggccgcugccgggaucaugaagaaccccacagucgauggaauuaccgugaucgaccucgauccuauccccuacgacccuaaauuugaaaagcagcugggccagguuaugcugcucgugcuuugcgucacacaggugcugaugaugcgcacaaccugggcccugugugaggcgcucacacuggcuaccgggcccauuuccacccuuugggaaggaaauccgggcagauucuggaacacaacgaucgccgugagcauggcuaauauuuuucgggggucuuaucuggccggagccggccuccuguucuccaucaugaagaacaccgcuaacacacgcagaggcaccgggaauacaggagagacccugggcgagaaauggaagaaccggcucaaugcccuugggaaaagcgaauuucaaauuuacaagaaaucuggaauccaggagguugaucgcacgcuggcgaaggaaggcaucaaaagaggggagacagaccaucacgccgucucccggggaagcgcuaagcugagaugguucguggagcgcaaccucgugaccccugaaggcaaggucauggaucugggcugcgggcggggaggcuggucuuauuacugugggggacuuaaaaauguuaaggaggugaaaggccugaccaaaggcgggcccgggcaugaagaacccauuccuaugagcacauauggcuggaaccucgugagacugcaguccggggucgacguguucuuuacacccccugaaaaaugcgauacacugcucugugacaucggagagucuagcccgaaucccacgguugaggccggccgcacccuucgggugcugaaccuggucgaaaauuggcucaacaauaacacacaauucugcauuaaggugcugaauccuuacaugcccuccguuaucgagaagauggaagcccuucagagaaaauacgggggagcccuggugcgcaacccucucagcagaaauuccacccacgagauguauugggucucuaacgcgagcggcaacauuguguccucugugaauaugaucagcagaaugcugaucaaccgcuuuacaaugcggcacaagaaagccaccuacgaacccgaugucgaccugggguccggaacgagaaauauuggcaucgagucugagaccccgaaccucgauauuaucggcaagcgcauugagaagaucaagcaggagcaugaaacaagcuggcacuaugaccaggaccauccuuacaagaccugggcuuaucacggguccuacgagacaaaacaaaccggaagcgccucuuccaugguuaauggcguggugcggcuucugacaaagcccugggaugucaucccuauggugacccagauggcuaugacggacacaacccccuucgggcagcagagaguuuuuaaagaaaagguggauacccgcacacaagagccuaaagagggaacgaagaagcugaugaaaauuaccgccgaauggcucuggaaggagcugggcaaaaagaaaacacccagaauguguacccgggaagaguucacacgcaaggucagaagcaacgcugcccuuggggcgaucuuuaccgacgagaauaaauggaagucugcccgggaagcuguggaggauuccggauucugggaacugguugacaaggagagaaaccuccaccuggaaggcaaaugcgagacauguguguauaauaugaugggcaagcgggagaaaaagcugggggaauuuggaaaagccaagggcagccgcgcuauuugguacauguggcucggggccagauuccuggaguuugaagcccuuggauuccugaacgaggaucauugguuuucucgggaaaauucccucagcggcgucgagggggagggccugcacaaacuuggauacauccugcgcgacguguccaaaaaggaaggcggggcgauguaugcugaugacaccgccggaugggauacgagaauuacccucgaggaccugaaaaacgaagagaugguuacaaaucauauggaaggcgagcacaagaaacuggccgaggcuaucuucaagcucaccuaccagaacaaggugguccgggugcagcgcccgacaccuagagggaccgucauggacauuaucagccggcgcgaucagagaggaucuggccaagugguuacguaugggcugaauacauucaccaacauggaagcccagcuuauccggcagauggagggcgaaggaguguuuaaaagcauucaacagcugacagcuaccgaggagaucgccgucaagaacuggcucgcgcgcgugggcagagaacggcugucccgcauggccauuucuggggacgauugcgugguuaaaccccuugacgauagauucgcuagcgcccugacggcucucaaugacaugggaaaggugcggaaagauauccagcagugggagcccuccagaggcuggaacgacuggacccaagucccuuuuugcucucaucacuuccacgaacugauuaugaaggaugggcgcgugcugguugugccgugucggaaucaggacgagcucaucggacgggcucgcaucagccagggcgcgggguggucccugcgggaaacagccugccuuggcaagucuuacgcucagauguggagccugauguauuuucauagacgcgaucuccggcuggccgcuaacgccauuuguuccgcuguccccagccacugggugccuaccucuagaacaaccugguccauccaugccacacacgaguggaugaccacggaggacaugcuugcggucuggaaucgcguguggauucaagaaaaccccuggaucgaggauaaaacaccuguugaaagcugggaggaaauucccuaccugggaaagcgggaggaccaguggugcggcucucucaucgggcugaccuccagagccaccugggcuaaaaauauccagacagccauuaaccaggugcgcagccugaucggaaaugaggaauauaccgacuacaugccuuccaugaagcgguucagacgggaggaagaggaagccggcguccucugguga

SEQ ID NO: 20324 - RNA, 9876 nt, Artificial Sequence
  derived and/or modified CDS sequence (opt5) from DENV-2__DQ645554__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuacaagaaaucuggaauccaggagguugaucgcacgcuggcgaaggaaggcaucaaaagaggggagacagaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucaccaaaggcgggccugggcaugaagaacccauucccaugagcacauauggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauacgggggagcccucgugcgcaacccccugagcagaaauuccacccacgagauguauugggucucuaacgcgagcggcaacauuguguccucugugaauaugaucagcagaaugcugaucaaccgcuuuacaaugcggcacaagaaagccaccuacgaaccugaugucgaccucggguccggaacgagaaauauuggcaucgagucugagacccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguauaauaugaugggcaagcgggagaaaaagcucggggaauuuggaaaagccaagggcagccgcgcuauuugguacauguggcugggggccagauuccuugaguuugaagcccugggauuccucaacgaggaucauugguuuucucgggaaaauucccugagcggcgucgagggggagggccuucacaagcugggauacauccuccgcgacguguccaaaaaggaaggcggggcgauguaugcugaugacaccgccggaugggauacgagaauuacccuggaggaccugaaaaacgaagagaugguuacaaaucauauggaaggcgagcacaagaaacucgccgaggcuaucuucaagcugaccuaccagaacaaggugguccgggugcagcgccccacaccgagagggaccgucauggacauuaucagccggcgcgaucagagaggaucuggccaagugguuacguaugggcuuaauacauucaccaacauggaagcccagcugauccggcagauggagggcgaaggaguguuuaaaagcauucaacagcucacagcuaccgaggagaucgccgucaagaacuggcuggcgcgcgugggcagagaacggcuuucccgcauggccauuucuggggacgauugcgugguuaaaccucuggacgauagauucgcuagcgcccucacggcucugaaugacaugggaaagauccggaaagauauucagcagugggagcccuccagaggcuggaacgacuggacccaagugcccuuuugcucucaucacuuccacgaacugaucaugaaggaugggcgcguccucgugguuccuugucggaaucaggacgagcugaucggacgggcccgcauuagccagggcgcgggguggucccuucgggaaacagccugccugggcaagucuuacgcucagauguggagccucauguauuuucauagacgcgaucugcggcuugccgcuaacgccaucuguuccgcugugccgagccacuggguccccaccucuagaacaaccugguccauucaugccacacacgaguggaugaccacggaggacaugcugacaguguggaaucgcgucuggauccaagaaaacccuuggauugaggauaaaacccccguggaaagcugggaggaaaucccuuaccucggaaagcgggaggaccaguggugcggcucucugaucgggcugaccuccagagcgacaugggccaaaaauauucagaccgcuaucaaccagguucgcagccucauuggaaaugaggaauauacagacuacaugcccuccaugaagcgguucagacgggaggaagaggaagccggcgugcugugguga

SEQ ID NO: 20325 - RNA, 9876 nt, Artificial Sequence
  derived and/or modified CDS sequence (opt5) from DENV-2__DQ645555__SS-prME
accgccggagugaucauuaugaugauccccacagucguugcuuuccaccugacgaccagaaauggggaaccucauaugauugugagccggcaggaaaagggaaaaucccuccuguuuaagacagagaauggcgugaacaugugcacccuuauggccauggaccugggggaacucugugaggauacaaucaccuacaauugcccgcugcuuagacaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagccagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggagggcgucagcgggggauccuggguggauauugugcuggaacacggcagcugugucaccacaauggccaaaaauaagcccacccucgacuucgagcugaucaagacagaagcuaaacacccugccacccuuagaaaguacugcaucgaggcuaaacugacgaacacaaccaccgccucucgguguccgacacaaggggaacccucccucaaugaggagcaggauaagcgcuuuguuugcaaacauagcaugguggacagaggauggggcaacggcugugggcuguucggaaagggcgggauugugaccugcgcgauguuuacaugcaagaaaaauauggaaggaaaggucgugcagccugagaaccuggaauauacgaucguuauuacaccccacucuggcgaggaaaaugccguggggaacgauacaggaaaacauggcaaggagaucaaagucaccccucaguccagcauuacagaggcugaacucaccggcuacgggacggugaccauggaguguucuccccggacaggacuggacuucaaugaaaugguucuucugcaaauggaggauaaggccuggcucgugcaccgccagugguuucuggaccuuccgcugccuuggcuccccggcgcugauacccagggguccaacuggauccagaaagaaacacuggucaccuucaagaacccucacgccaagaaacaagacguggucgugcugggaagccaggagggcgccaugcauacggcucucacaggggcgaccgagauccagauguccucuggcaaucugcuuuuuacaggacaccugaagugcagacuccggauggacaaacugcaacuuaagggcaugagcuauuccauguguaccgggaaauucaagguugugaaggaaauugccgagacccagcauggaacaaucgucauuagagugcaguacgaaggcgaugggagccccugcaaaauccccuucgagauuauggaccuggagaagcgccacguucucggacggcugaucacggugaacccuaucgucaccgaaaaagauucuccggugaauauugaggcugaacccccuuuuggcgacuccuacaucauuaucgggguggagcccggccagcugaagcucagcugguucaaaaagggaucuagcauuggccaaauguuugaaacaaccaugagaggggccaagcgcauggccauccugggagauacagcuugggacuucggcucccuugggggaguuuuuaccucuauuggcaaagcccugcaucaggucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagagcaguauaaguuucaaccugaaucucccagcaagcucgcuuccgccauccagaaagcucacgaggaagggaucuguggcauuagaucugugacgcgccuggagaaucuuauguggaagcagaucaccccggaacugaaccauauucucagcgagaaugaggucaaacugacaaucaugaccggagauauuaagggcaucaugcaggccgggaaacggucccugagaccucaacccacagaacuuaaguacagcuggaaagcguggggaaaggccaagaugcucucuaccgagcugcacaaccauacguuccugaucgacggcccugaaaccgcugagugccccaauacaaaccgcgccuggaauagccucgaaguggaggauuauggguuuggaguguucaccacaaacauuuggcugaaacuuaaggagcggcaggacgucuuuugugacagcaaacugaugucugcugccaucaaggauaauagagcgguucacgccgacaugggcuacuggauugaauccgcucucaacgauaccuggaaaaucgagaaggccagcuucauugaagugaagucuugccacuggccuaaaagccauacacugugguccaacggcgugcuggagagcgagaugaucauccccaagaauuucgcugggccggucucucagcacaacuaucgcccuggauaccauacccagacggccggccccuggcaccuugggaaacucgaaauggacuuugauuucugugagggaacaaccgugguugugaccgaagacugcggcaaucgggggcccucccugagaacaaccacggccagcggaaagcugauuacagaguggugcugucgguccugcacccucccuccgcugcgcuacagaggcgaagauggcuguugguaugggauggagauccggccccuuaaagagaaggaagagaaccuggucaauucucucgugacagcuggacauggccaaauugacaacuuuagccuggggguucugggaauggcgcuuuuccucgaagagaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagaacugaugaugacgacaauuggcaucguucuccugucccagucuaccauccccgagacaauucuugagcugaccgacgcccucgcccuggggaugauggugcugaagaucgugcggaacauggaaaaauaucagcuugcugucaccauuauggccauccugugcgugccuaaugcgguuauucuccaaaacgcuuggaaggugagcuguacaauccuggccgucguguccguuagcccccuccugcuuacgucuucccagcagaaggccgauuggaucccucuggcucucaccauuaaaggacugaaucccacagccaucuuucugaccacacuuagccgcaccucuaagaaaagauccuggccgcugaacgaggcuauuauggccgugggcauggucagcauccucgcgucuucccugcucaagaaugacauuccuaugacggggccccugguggccggaggccuucugacagucugcuacgugcugaccggccggagcgcugaccucgaacuggagcgcgccgcugauguuagaugggaagaacaggccgagaucuccgggagcucuccuauccuuagcauuaccaucuccgaagacggaucuaugagcauuaaaaacgaggaagaggagcaaacacugaccauccucauucggacaggccugcucgugaucuccgggcuguuccccgucucuauuccgaucacggccgcugcgugguaucuuugggaagugaagaaacagcgcgccggaguucugugggaugugccuucucccccucccgucggcaaggcugagcuggaagacggggccuacagaaucaagcagaaaggcauucucggcuauucccagaucggcgccgggguguacaaggagggaaccuuucacacaauguggcaugugacccggggcgcuguucugaugcacaaagggaagcgcauugaacccuccugggccgaugucaaaaaggaccuuaucagcuacggaggcggguggaagcuggagggagaguggaaagaaggcgaggaagugcaagugcucgcgcuggagccuggcaagaauccgagagcuguccagacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgaaaaauccauugaggauaauccugagaucgaagacgauauuuucagaaagaaacgccugacaaucauggaccugcaucccggggccggaaagacgaaacgguaucucccugcgauugucagagaggcuaucaagcgcggccugcggacccuuauccuggccccgacaagagugguugccgcugaaauggaggaagcccuccgcgggcugcccauucgguaccagaccccugcuaucagagccgagcacaccggacgcgagauuguggaucucaugugucaugcgacauucacgaugcggcugcuuagccccaucagagucccuaacuauaaucugauuaucauggacgaagcccacuuuaccgaccccgcuuccauugccgcucggggcuacaucucuacacgcguggagaugggggaagccgccggcaucuucaugaccgcuacaccgccuggaagcagagaucccuuuccccaauccaacgcgccuauuauggacgaggagcgggaaauccccgagcgcagcuggaacucuggccacgaaugggugaccgauuucaaggggaaaacggucugguuuguuccuuccauuaaggccggaaacgacaucgcugccugccugcgcaagaauggcaagaaagugauucagcucagccggaagacauucgauucugaguaugugaagaccagaaccaacgacugggauuuugucgugacaaccgacaucagcgaaaugggggccaauuucaaagcugagcgcguuaucgauccgcggagauguaugaagcccgugauucugacagacggagaggaacgcgucauccuugccggcccuaugcccgugacccauuccucugcggcucagcggagagggcgcguuggccggaacccuaaaaaugagaacgaucaauacauuuacaugggagaaccccuggagaaugacgaagacugcgcccacuggaaggaggccaaaaugcuccuggauaacaucaauacgccggagggcauuaucccuagcauguuugaacccgagagagaaaagguggacgcuaucgauggggaguaucgccugagaggagaagcccggaaaacauucgucgaccucaugcgcagaggcgaucuuccuguguggcuggcguaccgggucgccgcugaggggauuaacuaugccgaccgcagaugguguuuugauggagugaagaacaaucagauccuggaggaaaacguugagguggaaauuuggaccaaggagggcgagcggaaaaagcucaaacccagauggcuggacgcucgcaucuacuccgauccucuugcccugaaggaguucaaagaguucgcugccgggcggaagucucucacacugaaucugauuaccgaaaugggcagacuccccacguuuaugacccagaaggcgcgcaacgcccuugacaaucuggcugugcugcauacagccgaggcuggaggccgggccuauaaccacgcccucagcgaacugccggagacccuugagacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucaaccucacuggaucgcugccucuauuauccuggaguucuuucucauugugcugcugauccccgagcccgaaaaacagagaaccccucaggauaaucagcucaccuauguggucaucgccauucuuacagugguugcugccaccauggcgaacgagaugggcuuccuggaaaagaccaaaaaggacuuugggcugggaggcaucgccacgcaacagccggaguccaauauucucgauaucgaccugcggcccgcuagcgccuggacccuuuacgcuguggccacaaccuucauuacaccuaugcugcgccauuccaucgagaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaagcgaaggccaccagagaagcucagaaacgggccgcugccgggaucaugaagaacccgacagucgauggaauuaccgugaucgaccuggaucccaucccuuacgaccccaaauuugagaagcagcugggccagguuaugcuccuugugcugugcgucacgcaagugcugaugaugcgcacaaccugggcccucugugaagcgcugacacuugcuaccgggccuauuuccacccugugggagggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagaaacccucggcgagaaauggaagaaccggcuuaaugcccuggggaaaagcgaguuucagauuuacaagaaaucuggaauccaggaaguugaucgcacgcuggcgaaggagggcaucaaaagaggggaaacagaccaucacgccgucucccggggaagcgcuaagcucagaugguucguggagcgcaaccuggugaccccggagggcaaggucauggaucuuggcugcgggcggggaggcuggucuuauuacugugggggacugaaaaauguuaaggaagugaaaggccucaccaaaggcgggccugggcaugaggaacccauucccaugagcacauauggcuggaaccuggugagacugcaauccggggucgacguguucuuuaccccucccgagaaaugcgauacacuccuuugugacaucggagaaucuagcccuaauccgacgguugaggccggccgcacccugcgggugcugaaccucgucgagaauuggcugaacaauaacacacaguucugcauuaaggugcuuaaucccuacaugccuuccguuaucgaaaagauggaggcucugcagagaaaauacgggggagcccucgugcgcaacccccugagcagaaauuccacccacgaaauguauugggucucuaacgcgagcggcaacauuguguccucugugaauaugaucagcagaaugcugaucaaccgcuuuacaaugcggcacaagaaagccaccuacgagccugaugucgaccucggguccggaacgagaaauauuggcaucgaaucugagacccccaaccuugauauuaucggcaagcgcauugagaaaaucaagcaggaacaugagacaagcuggcacuaugaccaagaccauccguacaagaccugggcuuaucacggguccuacgaaacaaaacagaccggaagcgccucuuccaugguuaauggcguggugcggcugcugacaaagccuugggaugucauccccauggugacccagauggcuaugacggacacaaccccuuucgggcagcaaagaguuuuuaaagagaagguggauacccgcacacaggaacccaaagagggaacgaagaagcucaugaaaauuaccgccgaguggcuguggaaggaacuuggcaaaaagaaaacaccuagaauguguacccgggaggaguucacacgcaaggucagaagcaacgcugcccugggggcgaucuuuaccgacgagaauaaauggaagucugcccgggaggcuguggaagauuccggauucugggagcucguugacaaggaaagaaaccugcaccuggagggcaaaugcgaaacauguguguauaauaugaugggcaagcgggagaaaaagcucggggaguuuggaaaagccaagggcagccgcgcuauuugguacauguggcugggggccagauuccuugaauuugaggcccugggauuccucaacgaagaucauugguuuucucgggaaaauucccugagcggcgucgaaggggagggccuucacaagcugggauacauccuccgcgacguguccaaaaaggagggcggggcgauguaugcugaugacaccgccggaugggauacgagaauuacccuggaagaccugaaaaacgaggaaaugguuacaaaucauauggagggcgaacacaagaaacucgccgaggcuaucuucaagcugaccuaccagaacaaggugguccgggugcagcgccccacaccgagagggaccgucauggacauuaucagccggcgcgaucaaagaggaucuggccaggugguuacguaugggcuuaauacauucaccaacauggaggcccagcugauccggcaaauggaaggcgagggaguguuuaaaagcauucagcagcucacagcuaccgaagagaucgccgucaagaacuggcuggcgcgcgugggcagagagcggcuuucccgcauggccauuucuggggacgauugcgugguuaaaccucuggacgauagauucgcuagcgcccucacggcucugaaugacaugggaaaggugcggaaagauauccagcaaugggaacccuccagaggcuggaacgacuggacccagguccccuuuugcucucaucacuuccacgagcugauuaugaaggaugggcgcgugcucguugugccuugucggaaucaggacgaacugaucggacgggcccgcaucagccagggcgcgggguggucccuucgggagacagccugccugggcaagucuuacgcucaaauguggagccucauguauuuucauagacgcgaucugcggcuugccgcuaacgccauuuguuccgcugucccgagccacugggugcccaccucuagaacaaccugguccauccaugccacacacgaauggaugaccacggaggacaugcugacagucuggaaucgcguguggauucaggagaacccuuggaucgaagauaaaacccccguugagagcugggaagagauuccuuaccucggaaagcgggaagaccaguggugcggcucucugaucgggcugaccuccagagcgacaugggccaaaaauauccagaccgcuauuaaccaagugcgcagccucaucggaaaugaggaguauacagacuacaugcccuccaugaagcgguucagacgggaagaggaagaggccggcguccugugguga

SEQ ID NO: 20326 - RNA, 9876 nt, Artificial Sequence
  derived and/or modified CDS sequence (opt5) from DENV-2__DQ645556__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuuguuugcaaacauagcaugguggacagaggauggggcaacggcugugggcuguucggaaagggcgggauugugaccugcgcgauguuuacaugcaagaaaaauauggagggaaaggucgugcagccugaaaaccuggaguauacgaucguuauuacaccccacucuggcgaagagaaugccguggggaacgauacaggaaaacauggcaaggagaucaaagucaccccucaguccagcauuacagaagcugagcucaccggcuacgggacggugaccauggaauguucuccccggacaggacuggacuucaaugagaugguucuucugcagauggaagauaaggccuggcucgugcaccgccaaugguuucuggaccuuccgcugccuuggcuccccggcgcugauacccagggguccaacuggauccagaaagagacacuggucaccuucaagaacccucacgccaagaaacaggacguggucgugcugggaagccaagagggcgccaugcauacggcucucacaggggcgaccgaaauccagauguccucuggcaaucugcuuuuuacaggacaccugaagugcagacuccggauggacaaacugcagcuuaagggcaugagcuauuccauguguaccgggaaauucaagguugugaaggagauugccgaaacccaacauggaacaaucgucauuagagugcaguacgagggcgaugggagccccugcaaaauccccuucgagauuauggaccuggaaaagcgccacguucucggacggcugaucacggugaacccuaucgucaccgagaaagauucuccggugaauauugaagcugagcccccuuuuggcgacuccuacaucauuaucgggguggaacccggccagcugaagcucagcugguucaaaaagggaucuagcauuggccagauguuugagacaaccaugagaggggccaagcgcauggccauccugggagauacagcuugggacuucggcucccuugggggaguuuuuaccucuauuggcaaagcccugcaucaagucuucggggcgaucuauggcgcugccuuuagcggaguguccuggacgaugaagauccucauuggcguggucaucacauggauugggaugaacagccggucuaccucccugagcgugucucugguucuugugggagucgugacccucuaccugggcguuauggugcaggccgauuccgggugugucgugagcuggaaaaauaaggagcugaaaugcggauccggcaucuucauuacagacaacguucacaccuggacagaacaguauaaguuucagccugagucucccagcaagcucgcuuccgccauccaaaaagcucacgaagaggggaucuguggcauuagaucugugacgcgccuggaaaaucuuauguggaagcagaucaccccggagcugaaccauauucucagcgagaaugaagucaaacugacaaucaugaccggagauauuaagggcaucaugcaggccgggaaacggucccugagaccucagcccacagagcuuaaguacagcuggaaagcguggggaaaggccaagaugcucucuaccgaacugcacaaccauacguuccugaucgacggcccugagaccgcugaaugccccaauacaaaccgcgccuggaauagccucgagguggaggauuauggguuuggaguguucaccacaaacauuuggcugaaacuuaaggaacggcaagacgucuuuugugacagcaaacugaugucugcugccaucaaggauaauagagcgguucacgccgacaugggcuacuggauugaguccgcucucaacgauaccuggaaaaucgaaaaggccagcuucauugaggugaagucuugccacuggccuaaaagccauacacugugguccaacggcgugcuggagagcgaaaugaucauccccaagaauuucgcugggccggucucucagcacaacuaucgcccuggauaccauacccagacggccggccccuggcaccuugggaaacucgagauggacuuugauuucugugaaggaacaaccgugguugugaccgaggacugcggcaaucgggggcccucccugagaacaaccacggccagcggaaagcugauuacagaauggugcugucgguccugcacccucccuccgcugcgcuacagaggcgaggauggcuguugguaugggauggagauccggccccuuaaagaaaaggaggaaaaccuggucaauucucucgugacagcuggacauggccagauugacaacuuuagccuggggguucugggaauggcgcuuuuccucgaggaaaugcugagaacccgcgugggcacaaagcacgccauccugcucgucgcuguguccuuuguuacccugauuacggggaauaugucuuuccgggaucuuggaagagugauggucauggugggcgccaccaugacagacgauaucggcaugggggugaccuaccuggcccuccuggcugccuuuaaaguccgcccuacauucgcggcuggacugcuucugagaaagcucaccagcaaagagcugaugaugacgacaauuggcaucguucuccugucccaaucuaccauccccgagacaauucuugaacugaccgacgcccucgcccuggggaugauggugcugaagaucgugcggaacauggagaaauaucagcuugcugucaccauuauggccauccugugcgugccuaaugcgguuauucuccagaacgcuuggaaggugagcuguacaauccuggccgucguguccguuagcccccuccugcuuacgucuucccaacagaaggccgauuggaucccucuggcucucaccauuaaaggacugaaucccacagccaucuuucugaccacacuuagccgcaccucuaagaaaagauccuggccgcugaacgaagcuauuauggccgugggcauggucagcauccucgcgucuucccugcucaagaaugacauuccuaugacggggccccugguggccggaggccuucugacagucugcuacgugcugaccggccggagcgcugaccucgagcuggaacgcgccgcugauguuagaugggaggagcaggccgaaaucuccgggagcucuccuauccuuagcauuaccaucuccgaggacggaucuaugagcauuaaaaacgaagaggaggaacagacacugaccauccucauucggacaggccugcucgugaucuccgggcuguuccccgucucuauuccgaucacggccgcugcgugguaucuuugggaggugaagaaacaacgcgccggaguucugugggaugugccuucucccccucccgucggcaaggcugaacuggaggacggggccuacagaaucaagcagaaaggcauucucggcuauucccagaucggcgccgggguguacaaggaaggaaccuuucacacaauguggcaugugacccggggcgcuguucugaugcacaaagggaagcgcauugagcccuccugggccgaugucaaaaaggaccuuaucagcuacggaggcggguggaagcuggagggagaauggaaagagggcgaagagguccaggugcucgcgcuggaaccuggcaagaauccgagagcuguccaaacaaaacccggacucuucaagaccaacacgggaaccauuggcgccgugucccuggauuuuagcccugggacaucuggaucccccaucguugacaaaaagggcaagguggucgggcuuuauggaaacggcgugguuacccggagcggcacauacgugucugccaucgcucagaccgagaaauccauugaggauaauccugaaaucgaggacgauauuuucagaaagaaacgccugacaaucauggaccugcaucccggggccggaaagacgaaacgguaucucccugcgauugucagagaagcuaucaagcgcggccugcggacccuuauccuggccccgacaagagugguugccgcugagauggaagaggcccuccgcgggcugcccauucgguaccagaccccugcuaucagagccgagcacaccggacgcgaaauuguggaucucaugugucaugcgacauucacgaugcggcugcuuagccccaucagagucccuaacuauaaucugauuaucauggacgaggcccacuuuaccgaccccgcuuccauugccgcucggggcuacaucucuacacgcguggaaaugggggaggccgccggcaucuucaugaccgcuacaccgccuggaagcagagaucccuuuccccaguccaacgcgccuauuauggacgaggaacgggagauccccgaacgcagcuggaacucuggccacgagugggugaccgauuucaaggggaaaacggucugguuuguuccuuccauuaaggccggaaacgacaucgcugccugccugcgcaagaauggcaagaaagugauucaacucagccggaagacauucgauucugaauaugugaagaccagaaccaacgacugggauuuugucgugacaaccgacaucagcgagaugggggccaauuucaaagcugagcgcguuaucgauccgcggagauguaugaagcccgugauucugacagacggagaagaaagagucauccuugccggcccuaugcccgugacccauuccucugcggcucagcggagagggcgcguuggccggaacccuaaaaaugaaaacgaucaguacauuuacaugggagagccccuggaaaaugacgaggacugcgcccacuggaaggaggccaaaaugcuccuggauaacaucaauacgccggaaggcauuaucccuagcauguuugagcccgaaagagagaagguggacgcuaucgauggggaauaucgccugagaggagaggcccggaaaacauucgucgaccucaugcgcagaggcgaucuuccuguguggcuggcguaccgggucgccgcugaggggauuaacuaugccgaccgcagaugguguuuugauggagugaagaacaaucaaauccuggaagagaacguugaaguggagauuuggaccaaggagggcgaacggaaaaagcucaaacccagauggcuggacgcucgcaucuacuccgauccucuugcccugaaggaguucaaagaguucgcugccgggcggaagucucucacacugaaucugauuaccgagaugggcagacuccccacguuuaugacccagaaggcgcgcaacgcccuugacaaucuggcugugcugcauacagccgaagcuggaggccgggccuauaaccacgcccucagcgagcugccggagacccuugaaacacugcuccugcugacccuccuugcuacagucaccgggggaaucuuccuguuucugauguccggcaaagggauuggaaagaugacgcucggcaugugcugcaucaucacagcgagcguucugcuuugguacgcccagauucagccucacuggaucgcugccucuauuauccuggaguucuuucucauugugcugcugauccccgaacccgagaaacaaagaaccccucaggauaaucagcucaccuauguggucaucgccauucuuacagugguugcugccaccauggcgaacgaaaugggcuuccuggagaagaccaaaaaggacuuugggcugggaggcaucgccacgcagcaaccggaguccaauauucucgauaucgaccugcggcccgcuagcgccuggacccuuuacgcuguggccacaaccuucauuacaccuaugcugcgccauuccaucgaaaacucuagcgucaaugugucccucaccgcgaucgccaaccaggcuacgguccugauggggcugggaaagggcuggccccucucuaaaauggacauuggggugccucuucuggccaucggauguuacagccagguuaaucccauuacccugacagcugcccuccugcuucugguggcucacuaugccaucauuggcccuggccuccaggcgaaggccaccagagaggcucaaaaacgggccgcugccgggaucaugaagaacccgacagucgauggaauuaccgugaucgaccuggaucccaucccuuacgaccccaaauuugaaaagcagcugggccagguuaugcuccuugugcugugcgucacacaggugcugaugaugcgcacaaccugggcccucugugaggcgcugacacuugcuaccgggccuauuuccacccugugggaaggaaaucccggcagauucuggaacacaacgaucgccgugagcauggcuaauauuuuucgggggucuuaucucgccggagccggccugcuguucuccaucaugaagaacaccgcuaacacacgcagaggcaccgggaauacaggagagacccucggcgagaaauggaagaaccggcuuaaugcccuggggaaaagcgaauuucaaauuuacaagaaaucuggaauccaggagguugaucgcacgcuggcgaaggaaggcaucaaaagaggggagacagaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucaccaaaggcgggccugggcaugaagaacccauucccaugagcacauauggcuggaaccuggugagacugcaguccggggucgacguguucuuuaccccucccgaaaaaugcgauacacuccuuugugacaucggagagucuagcccuaauccgacgguugaggccggccgcacccugcgggugcugaaccucgucgaaaauuggcugaacaauaacacacaauucugcauuaaggugcuuaaucccuacaugccuuccguuaucgagaagauggaagcucugcagagaaaauacgggggagcccucgugcgcaacccccugagcagaaauuccacccacgagauguauugggucucuaacgcgagcggcaacauuguguccucugugaauaugaucagcagaaugcugaucaaccgcuuuacaaugcggcacaagaaagccaccuacgaaccugaugucgaccucggguccggaacgagaaauauuggcaucgagucugagacccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguauaauaugaugggcaagcgggagaaaaagcucggggaauuuggaaaagccaagggcagccgcgcuauuugguacauguggcugggggccagauuccuugaguuugaagcccugggauuccucaacgaggaucauugguuuucucgggaaaauucccugagcggcgucgagggggagggccuucacaagcugggauacauccuccgcgacguguccaaaaaggaaggcggggcgauguaugcugaugacaccgccggaugggauacgagaauuacccuggaggaccugaaaaacgaagagaugguuacaaaucauauggaaggcgagcacaagaaacucgccgaggcuaucuucaagcugaccuaccagaacaaggugguccgggugcagcgccccacaccgagagggaccgucauggacauuaucagccggcgcgaucagagaggaucuggccaagugguuacguaugggcuuaauacauucaccaacauggaagcccagcugauccggcagauggagggcgaaggaguguuuaaaaacauucaacagcucacagcuaccgaggagaucgccgucaagaauuggcuggcgcgcgugggcagagaacggcuuagccgcauggccauuuccggggacgauugcgugguuaaaccucuggacgauagauucgcuucugcccucacggcucugaacgacaugggaaaggugcggaaagauguccagcagugggagcccagcagaggcuggaaugacuggacccaagugcccuuuugcucccaucacuuccacgaacugaucaugaaggaugggcgcguucucguggucccuugucggaaccaggacgagcugauuggacgggcccgcaucucucagggcgcgggguggagccuucgggaaacagccugccugggcaaguccuacgcucagauguggucucucauguauuuucauagacgcgaucugcggcuugccgcuaaugccaucuguagcgcugugccgucccacuggguccccaccagcagaacaaccuggucuauucaugccacacacgaguggaugaccacggaggacaugcugacaguguggaaccgcguuuggauccaagaaaauccuuggauugaggauaaaacccccguggaauccugggaggaaaucccuuaccucggaaagcgggaggaccaguggugcggcagccugauugggcugaccucuagagcgacaugggccaaaaacauccagaccgcuaucaaucagguccgcucccucauuggaaacgaggaauauacagacuacaugcccagcaugaagcgguucagacgggaggaagaggaagccggcgugcugugguga

SEQ ID NO: 20327 - RNA, 9876 nt, Artificial Sequence
  derived and/or modified CDS sequence (opt5) from DENV-2__AF204178__SS-prME
accgccggcaugaucauuaugcugauccccacagugauggcuuuccaccucacgaccagaaacggggagccucauaugauugucagccggcaggaaaagggaaaaucccugcuuuuuaagacaggcgacgggguuaauaugugcacccugauggccauggauccgggagagcucugugaagacacaaucaccuacaaaugcccccugcuuaagcaaaacgagccugaagauauugacuggugguguaauucuacaagcaccugggugacguauggcaccugcacaaccacaggggagcaccgcagagagaaacgguccguggcgcuggucccccaugugggaaugggccucgaaacccgcacggagacauggaugucuagcgaaggcgcuuggaagcacgcccagagaaucgagaccuggauccugcggcauccuggguucacaaugauggccgcuauucuggccuacaccaucggaaccacacacuuucagcgcgcucucauuuucauccugcuuacggccguugcgcccuccaugaccaugagauguauuggcaucucuaaccgggauuuuguggagggggucagcggaggcuccuggguggacauuguucuggaacacgggagcugcgugacaaccauggccaagaauaaaccuacacucgauuucgagcugaucaagaccgaagcuaaacagccggccacgcuucgcaaguauuguaucgaggcuaaacugacaaacaccaccacagacucuagaugccccacccaaggagaaccuucccucaaugaggagcaggauaagcgguuugucuguaagcauagcaugguggaccgcggcuggggcaacgggugcggacuguucggcaaagggggaauugugacauuugccauguucacguguaagaaaaauaugaagggcaaagucguucagcccgaaaaccuggaguacaccaucgugauuacaccucacucuggggaagagcaugcggugggaaaugauaccggcaagcacggcaaagaaaucaagauuacaccccaguccagcaucaccgaggccgagcucacgggguauggaaccgucacaaugaagugcucuccgagaaccggccuggacuuuaacgaaauggugcuucugcaaauggagaauaaagcuuggcucguucaccggcagugguuccuggaucuuccucugcccuggcucccuggggccgacacacagggauccaacuggauccagaaggaaacccuggugacguuuaaaaauccccaugcuaagaaacaagacgucgugguucugggcagccaggagggggccaugcacacagcccucaccggcgcuacagaaauucagauguccucuggaaaccugcuuuucaccggccaucugaagugccgccucagaauggauaagcugcaacuuaaagggaugagcuacuccauguguaccggaaaguucaaaguggucaaggagaucgcggagacacagcacggcacgauugugauccggguccaguaugaaggggacggaagccccugcaaaauuccuuuugagaucauggaucuggaaaagagacaugugcucggccgccugaucaccguuaacccgauugugacagagaaggacucucccgucaauaucgaggccgaaccucccuucggggauuccuacauuaucauuggcguggagccuggacagcugaaacucaacugguuuaagaaaggcagcucuaucgggcaaauguucgaaaccacaaugcggggagcuaagagaauggccauucugggcgacaccgccugggauuuugggagccuuggaggcguuuucacguccaucgggaaagcucugcaccagguguuuggcgccaucuacggagcggcuuucucuggcgucagcuggacaaugaagauucucaucggggugauuaucaccuggauuggaaugaauucccgcagcaccucucuguccgugagccugguucuugucggcguggugacacucuaucugggggucauggugcaggccgacucuggauguguuguguccuggaagaacaaagagcugaagugcggcagcgggaucuuuaucaccgaugacguccacacauggacggaacaguacaaauuccaacccgaguccccgucuaagcucgccagcgcuauucagaaagcccaugaggaaggcaucuguggaauucgguccgugaccagacuggagaaucuuauguggaagcagaucacaccugaacugaaccacauucucucugagaaugaaguuaaacugaccaucaugacaggcgauaucaaggggauuaugcaggcuggaaagcgcagccugcggccccaaccuaccgagcuuaaauauuccuggaagacguggggcaaagccaagaugcucagcaccgagucucauaaccagacauuucugaucgacgggcccgaaaccgcggagugcccuaauacaaacagagccuggaauucccuggaaguggaggacuacggauucggcgucuuuaccacaaacauuuggcucaaacugcgcgaaaagcaggauguguucugugacagcaagcuuaugucugcuguuaucaaagauaaucgggccgcucacgccgacaugggcuauuggauugaguccgcgcugaacgauaccuggaagaucgagaaagccagcuucaucgaagugaagucuugccacuggcccaaaagccauacgcucugguccaaugggguccuggagagcgaaaugauuaucccgaagaacuuugcuggaccugugucucagcacaacuacagacccggcuaucauacacaaaccgccgggcccuggcaccugggaaagcuugagauggacuucgauuuuugugagggcaccacaguggucguuaccgaagacugcgggaaucgcggaccuucccuccggacgacaaccgcuagcggcaaacugauuacagagugguguugcagauccugcacccugccgccccuccgguaccgcggcgaagauggguguugguacggaauggagaucagaccucugaaggaaaaagaggagaaccuugugaauucucuggugacagccggccaugggcagauugacaacuucagccucggaguccugggcauggcccuguuucuugaagagaugcuccggaccagaguggggacgaagcacgcuauccugcugguugcgguguccuucgucacccucauuacaggaaauaugucuuuucgcgaucugggccgggugaugguuauggugggcgccaccaugacagacgauaucgggaugggagucaccuaucuugcucugcucgccgccuucaaagugagacccacguuugcugccggccugcugcuucgcaagcugacaagcaaggaacucaugaugaccacaaucgggauuguucugcucucccagucuaccaucccugagaccauucuggaacuuacagacgcgcuggcucucggaaugauggugcugaaaauggucagaaagauggagaaauaccaacuggccgugacgaucauggccauucuuugcgugcccaacgcugucauccugcagaaugccuggaagguuagcuguaccauccucgcggugguguccgucagcccucuguucauuacaucuucccagcagaaagcugacuggaucccccucgcccugaccauuaagggccuuaacccgacagccaucuuucugaccacgcucagccggacaaauaaaaagcgcucuuggccucugaacgaggcuauuauggccguggggaugguuuccauccuggcuagcucucuucugaagaaugauauccccaugaccggaccucucguggccggcggccugcucaccgucugcuaugugcugacagggagauccgcggaccuugaacuggagcgggccgcugauguuaaaugggaagaccaagccgagauuagcggauccagccccauccugucuauuaccaucagcgaagauggcuccaugucuauuaagaacgaggaggaagagcagauccucacaauucugauccgcacggggcuucuggugaucagcggacucuucccggucuccauuccuaucaccgcugccgccugguaccugugggaagugaaaaagcagagagcuggcguccucugggacgugcccucuccuccccccguugggaaagcggagcuggaggauggagccuaucggauuaagcagaagggcauccuuggcuacagccaaauuggggcuggaguguauaaagaaggcacauuucacaccauguggcaugucacacgcggggccgugcugaugcacaagggaaaaagaaucgagccuuccugggccgacguuaagaaagaucugaucucuuacggcgggggauggaagcucgaaggcgaguggaaggaaggcgaggaggugcagguccuggcucuugaaccggggaaaaauccccgggccgugcagaccaagccuggacuguucaaaacgaacgcgggcaccauuggggcugugagccucgacuucucccccggaacaagcggcucuccuaucauugauaagaaagggaagguugucggacuguacggcaauggcguggugacccgcuccggggccuaugucagcgccaucgcucagacagagaagucuauugaagacaaccccgagaucgaagaugacaucuuuagaaaacggaagcucaccauuauggaccugcauccuggagccggcaaaacaaagagauaccuuccggcgaucgugcgcgaggcuauuaaacgggggcugagaacgcugauccucgcccccacccgcguuguggccgcugagauggaagaggcccugcggggacuuccuauuagauaucaaacacccgcuauccgcgccgaacacaccggccgggagauugucgaucugaugugucaugcgaccuucacaaugagacuccuguccccugugcgcguucccaacuacaaucucaucaucauggacgaagcccacuuuacggauccggcuagcauugccgcucggggguauaucuccaccagaguggagaugggcgaggccgccggaauuuucaugacagcuaccccucccggcucucgggaccccuuuccucagagcaacgcgcccaucauggaugaagagcgcgaaauuccugagagauccuggagcucugggcacgagugggucacagacuucaagggaaagaccgugugguuuguuccguccaucaaagccggcaaugauaucgcugccugccugcggaagaacgggaaaaaggugauucagcuuagccgcaaaacguucgacucugaauacgucaagacaagaaccaaugauugggacuuuguggugaccacagauaucagcgagaugggagccaacuucaaagcugaacgggucauugaccccagacgcuguaugaagccuguuauccugaccgacggcgaggaacgggugauucuggccgggcccaugccugugacacauuccucugcggcucaaagacgcggccggaucggaagaaaucccaagaacgagaaugaucaguauaucuacaugggcgagccgcucgaaaacgacgaggauugcgcccacuggaaagaagccaagaugcugcuugacaauauuaacaccccugaggggaucauucccagcauguuugaaccugagcgcgagaaagucgaugcuaucgacggagaauaccggcugagaggcgaggcccgcaagacguucguggaucucaugagacggggggaccugcccguuuggcuggcguaucgcguggccgcugaaggaauuaauuacgccgauagacggugguguuucgacggcaucaaaaacaaucagauucucgaggaaaacgucgagguggagaucuggacaaaggaaggggagcgcaagaaacuuaagccuagauggcuggaugcuaaaaucuauuccgacccccuggcccucaaggaauuuaaagaguucgcugccggccggaagucucugacccuuaaccugauuacagagaugggaagacucccgaccuuuaugacgcagaaggcgcgcgaugcccuggacaaucuggcuguucuccauaccgccgaagcuggcgggcgggccuacaaccacgcccuuagcgagcugccugaaacacuggagacccuccugcuucugacacuccuggcuaccgugacaggaggcaucuuccuguuucucauguccgggagaggaauuggcaaaaugacccuuggcaugugcuguaucauuacggcgagcauccugcugugguaugcccaaauccagccccacuggauugcugccucuaucauucucgaauucuuucugaucguccuucugauucccgagccugagaagcagcgcacaccgcaggacaaucaacucaccuacguggucaucgccauccugaccgugguugcugccacaauggcgaacgaaaugggguuccuggagaaaaccaagaaagaucucggacuuggcuccauuacaacgcagcagcccgaaagcaauauccuggacauugaucugcggccugccuccgcuuggacccucuaugccguggcuacaaccuuugugacacccaugcugagacauucuaucgagaacagcuccgucaauguuucucuuaccgccauugcgaaccaggccacggugcugauggggcucggaaagggcuggccucugagcaagauggacaucggggugccccugcucgcuauuggaugcuacucccaagucaauccuaucacccuuacagccgcucuguuccugcucguggcccacuacgcuaucauuggcccgggccugcaggccaaagcgacccgggaagcccagaagcgcgcugccgcugggaucaugaaaaaccccacaguugauggaauuaccgugaucgaccuugauccuauucccuaugacccuaaguuugagaaacagcugggccaagucaugcuccuggugcugugcgucacgcaggugcucaugaugagaacaaccugggcccuuugugaggcccugacacuggcgaccgggcccaucagcacccucugggaaggaaauccgggccgguucuggaacacaacgaucgcuguuucuauggccaauauuuuucgcggguccuaccuggcuggagccggccuucuguucagcaucaugaagaacaccacaaauaccagacggggcacagggaacauuggagagacccucggcgaaaaauggaagauccgccugaaugcccuggggaagucugaguuccagauuuauaaaaaguccggaauccaagaaguggauagaacgcucgcuaaagagggcaucaagcggggggagacagaccaucacgccgucagccgcggaucugcgaaacuuagaugguuuguggaacggaacaugguuaccccugagggcaagguggucgaucugggcugcgggagaggaggcuggagcuacuauugugggggacugaagaacgugcgcgaagugaaaggccucaccaaggggggacccggccaugaggagcccauuccuauguccacauacggcuggaaucugguucggcuucagucuggggucgacguguucuuuacccccccugaaaaaugcgauacacugcucugugacaucggagagagcuccccgaaccccacgguggaagccggcagaacccugcgcguccugaaucucguugagaacuggcuuaauaacaauacacaguucugcauuaaggugcugaacccuuauaugcccagcgugaucgaaaaaauggagacccugcagcggaaguacgggggagcucucgucggcaauccucuguccagaaacucuacacacgagauguacugggugagcaaugccuccgggaacauuguuucuagcgugaauaugaucucccgcaugcuuaucaaccgguuuaccaugagacacaagaaagcuacguaugaacccgacgucgaucugggaucuggcacccgcaauauuggcaucgagagcgaaauuccgaaccucgacaucauugggaagcggaucgagaaaauuaagcaagaacaugagacauccuggcacuacgaucaggaccauccuuauaaaaccugggccuaccacggaagcuaugagacaaagcagaccggcucugcguccagcauggugaacgggguugugagacugcugacaaagcccugggaugucgugccuauggugacccagauggccaugacggacacaacccccuucggacaacagcgcgucuuuaaagaaaagguugauacccggacacaggagccuaaagaaggcacgaagaaacucaugaagaucaccgcugaguggcuuuggaaagaacuggggaagaagaaaacacccagaauguguacccgcgaggaguucacaagaaaggugcggucuaaugccgcucugggagccaucuuuaccgacgaaaacaaauggaaguccgcucgcgaggccguggaagauagcagauucugggagcucgucgacaaagagcggaaucugcaccuugaaggcaagugcgagacauguguguacaacaugaugggcaagagagaaaaaaagcugggggaguuuggaaaagcgaagggcucucgggccauuugguauauguggcucggggcucgcuuccuggaauuugaggcccugggauuccucaaugaggaucauugguucuccagagaaaacagccuguccggcguugagggggaaggccuuuacaaacugggauacauccuccgggacgugagcaagaaggagggcggggcuauguaugccgacgauaccgccggaugggacacgcgcauuacccuggaagaucuuaaaaaugaggagauggucacaaaccacauggaaggcgagcauaagaaacuggcggaagcuaucuuuaagcucaccuaccagaauaaagugguuagagugcaacggccgacaccucgcgggaccgucauggacauuaucucuagacgggaucagcgcggaagcggccagguggggacguauggccugaacacauucaccaauauggaggcccaacugaucagacagauggaaggagagggcguuuuuaaguccauucagcaccucacagugaccgaggaaaucgccguccagaacuggcuggcucgggugcgcagagagcggcuuucucgcauggccauuagcggggacgauugcgucgugaagccccuggacgauagauucgcuuccgcccucacggcgcugaaugacaugggaaaaguucggaaggauauccaacagugggaacccucuagaggcuggaacgacuggacccaggugccuuuuuguagccaucacuuccacgagcuuauuaugaaagaugggcgcguccugguggugccgugccggaaucaggacgagcucaucggaagagcccgcaucucccaaggcgcuggguggucucugcgggaaacagccugccugggcaagagcuacgcucagauguggucccucauguauuuucauagacgcgaccugcggcuugccgcgaacgccauuuguagcgcuguucccucucacugggugccuaccuccagaacaaccuggagcauccaugccaaacacgaguggaugacaaccgaagauaugcugacggucuggaaccgcguguggauucaggagaaucccuggauggaagacaagacaccuguugagucuugggaggaaauccccuaccucggaaagcgggaggaucaguggugcggcucccugauugggcuuaccagcagagcuaccugggccaaaaacauccaaacagcuauuaaucaggugcgcucccugaucggaaacgaagaguauaccgacuacaugccuucuaugaagcgguucagacgggaagaggaggaagccggcguccucugguga

SEQ ID NO: 20328 - RNA, 9876 nt, Artificial Sequence
  derived and/or modified CDS sequence (opt5) from DENV-2__AF204177__SS-prME
accgccggaaugaucauuaugcugauccccaccgugauggcuuuccaccucacgaccagaaacggggaaccucauaugauugugagccggcaggaaaagggaaagucccugcuuuuuaagaccggagacgggguuaauaugugcacccugauggccauggaucucggagaacugugugaagacaccaucaccuacaagugcccgcuucugcgccaaaacgagcccgaagauauugacuguuggugcaauucuacgagcaccugggugacguauggcaccuguacgaccacaggggagcacagacgggagaagcgcuccguggcgcucgucccucaugugggaaugggccuggaaaccagaacggagacauggaugucuagcgaaggcgcuuggaaacacgcccagcggaucgagaccuggauccugcgccaucccggguucacaauuauggccgcuauccucgccuacaccauuggaaccacacacuuucagagagcucugaucuucauucuucugacggccguugcgccuuccaugaccaugcggugcaucggcauuucuaaccgcgauuuuguggagggggucagcggaggcuccuggguggacaucguucucgaacacgggagcugugugacaaccauggccaagaauaagcccacacuggaucuugagcugaucaaaaccgaagcuaagcagucugccacgcucagaaaauauugcauugaggcuaagcugacaaacaccaccacagaaucccgguguccuacccaaggagagccgagccugaaugaggaacaggacaaacgcuucgucugcaagcauucuaugguggauagaggcuggggcaacggguguggacucuuuggcaaagggggaaucgugacaugcgccauguucacgugcaaaaagaauaugaaaggcaaggucguucagcccgagaaccuggaauacaccauugugaucacaccucacuccggggaggaacaugcggugggaaaugacaccggcaaacacggcaaggagauuaaaaucacaccccagagcucuaucaccgaggccgaacuuacgggguauggaaccgucacaauggaguguuccccucggaccggccuggauuuuaacgaaauggugcuccugcaaauggagaauaaggcuuggcuuguucaccgccagugguuccuggaccucccccugccguggcugccuggggccgauacacagggaagcaacuggauucagaaggaaacccucgugacguuuaaaaauccccaugcuaagaaacaagacgucgugguucugggcucccaggagggggccaugcacacagcccuuaccggcgcuacagagauccagaugucuagcggaaaccuccuguucaccggccaucugaagugcagacuucggauggacaaacugcaacucaaggggauguccuacagcauguguaccggaaaguuuaaaguggucaaggaaauugcggagacacagcacggcacgaucgugauuagaguccaguaugaaggggauggaucuccuugcaaaauccccuucgagaucauggaccuggagaagcgccaugugcugggccggcucauuaccguuaaccccaucgugacagaaaaagauuccccugucaauauugaggccgaaccgcccuucggggacagcuacaucauuaucggcguggagccuggacagcugaaacuuaacugguuuaagaaaggcucuagcauugggcaaauguucgaaaccacaaugagaggagcuaagcgcauggccauccugggcgauaccgccugggacuuugggucccucggaggcguuuucacgucuaucgggaaagcucugcaccagguguuuggcgccauuuacggagcggcuuucagcggcgucuccuggacaaugaagauccugauuggggugaucauuaccuggaucggaaugaauagccggucuaccucccuuagcgugucucucguucuggucggcguggugacacuguaucucggggucauggugcaggccgauuccggauguguugugagcuggaaaaacaaggagcugaagugcggcuccgggaucuuuauuaccgacaauguccacacauggacggagcaguacaaauuccaacccgaaucuccuagcaaacuugccuccgcuauccagaaagcccaugaggaaggcauuuguggaaucagaucugugacccgccuggagaaccucauguggaagcagauuacacccgaacugaaucacauccugagcgagaacgagguuaaacuuaccaucaugacaggcgauauuaaggggaucaugcaggcuggaaaacggucccucagaccgcaaccuaccgaacugaaguauagcuggaagacguggggcaaagccaagaugcugucuaccgagucccauaaucagacauuucucauugacgggcccgaaaccgcggagugcccuaacacaaaucgcgccuggaacagccuggaaguggaggauuacggauucggcgucuuuaccacaaauaucuggcuuaaacugcgggagaagcaggacguguucugugacucuaaacucauguccgcugccauuaaggauaacagagcuguucacgccgacaugggcuauuggaucgaaagcgcgcugaaugauaccuggaagaucgagaaagccucuuuuauugaagucaagagcugccacuggcccaaaucccauacgcuguggagcaacgagguccuugagucugaaaugaucauuccuaagaacuucgcugggcccgugucccagcacaauuaccgcccgggauaucauacacaaaccgccggcccuuggcaccucgggaaacuggagauggacuucgauuuuugugaaggaaccacaguggucguuaccgaggacugcggcaaccgggggcccagccugagaacgacaaccgcuuccggaaagcucaucacagaaugcuguugccggucuuguacccugcccccucuucgcuacagaggcgaggauggcugcugguacgggauggagauucggccgcugaaggaaaaagaggaaaaucucgugaacagccuggugacagccggacauggccagaucgacaauuucucccuggggguccuuggaauggcccucuuucuggaggaaaugcugagaacccgcgugggcacgaagcacgcuauucuccugguugcggugucuuucgucacccuuaucacagggaacaugagcuuucgggaucugggaagagugaugguuauggugggcgccaccaugacagacgauaucggcaugggggucaccuaucucgcucugcuggccgccuucaaagugcgccccacguuugcugccggacuucugcucagaaagcugacauccaaagagcucaugaugaccacaauuggcaucguucugcuuucucagagcaccauuccugagaccauccuggaacucacagacgcgcuggcucuggggaugauggugcuuaagaugguccggaagauggagaaauaccaacuggccgugacgauuauggccauccucugugugcccaaugcugucauccugcagaacgccuggaagguuuccugcaccauucucgcgguggugagcgucucuccucuguuccuuacauccagccagcagaaagcugauuggaucccccuggcccucaccauuaagggacugaauccuacagccaucuuucugaccacgcuuucuaaaacaaacaagaaacgcuccuggccccugaaugaagcuauuauggccgugggcaugguuagcauccucgcuucuucccugcucaagaacgacaucccgaugaccgggccucugguggccggaggccuucugaccgucuguuaugugcugacaggcagaagcgcggaccucgagcuggaacgggccgcugauguuaagugggaggaccaagccgagauuuccgggagcucucccauccuuagcauuaccaucuccgaagauggaucuaugagcauuaaaaaugaggaagaggagcagauccugacaauucucauccgcacgggccugcucgugaucuccgggcuguucccugucucuauucccaucaccgcugccgccugguaccuuugggaagugaagaaacagagagcuggaguccugugggacgugccgagcccucccccuguuggcaaggcggagcuggaagauggggccuaucggauuaaacagaagggaauccucggcuacucccaaauuggcgcugggguguauaaggagggaacauuucacaccauguggcaugucacacgcggcgccgugcugaugcacaaagggaagagaaucgaacccucuugggccgacguuaaaaaggaucuuaucagcuacgcuggaggcuggaaacuggagggggaguggaaggaaggagaggaagugcagguccucgcccuggagcccggcaagaacccucgggcggugcagaccaaaccgggccucuucaagacgaaugcugggaccauuggagccgugucccuggacuuuagccccggcacaucuggguccccuaucauugauaaaaagggaaaaguugucggccuuuacgggaacggaguggugacccgcagcggcgccuaugucucugcuaucgcccagacagaaaaguccauugaggacaaccccgagaucgaagaugacaucuucagaaagcggaaacugaccauuauggaucugcauccuggcgcggggaagacaaaaagauaccuccccgcuaucgugcgcgaggccauuaagcggggacugagaacgcuuauccuggccccuacccgcguuguggcugccgaaauggaggaagcucuccggggccugccgauuagauaucaaacacccgccauccgcgcggagcacaccgggcgggagauugucgaccucaugugccaugccaccuucacaaugagacugcuuagcccugugcgcguucccaauuacaaccugaucaucauggacgaagcucacuuuacggauccugccuccauugcugcccggggauauaucucuaccagaguggagaugggcgaagccgcugggauuuucaugacagcgacacccccgggcagccgggacccuuuuccccaguccaaugcccccaucauggaugaggagcgcgaaauuccugagagaagcuggucuuccggacacgaaugggucacagacuucaaaggcaagaccgugugguuuguucccagcaucaaggcugggaacgauaucgccgccugucugcggaaaaauggaaagaaagugauucagcucucucgcaagacguucgacagcgaguacgucaaaacaagaaccaacgauugggacuuuguggugaccacagauaucuccgaaaugggcgcuaauuucaaggccgagcgggucauugacccuagacgcugcaugaaaccgguuauccugaccgauggggaggaacgggugauucuugcgggacccaugccugugacacauucuagcgcugcccaaagacgcggccggaucgggagaaaccccaagaaugagaacgaccaguauaucuacaugggcgaaccucuggagaaugacgaagauugugcccacuggaaggaggcuaaaaugcuccuggacaacauuaauacccccgagggaaucauuccguccauguuugaaccugagcgcgaaaaggucgaugccaucgacggcgaguaccggcugagaggggaagcgcgcaaaacguucguggaucucaugagacggggagaccuucccguuuggcuggccuaucgcguggcugccgagggcauuaacuacgcugauagacgguggugcuuugacgggaucaagaauaaccagauucuggaggaaaacgucgagguggaaaucuggacaaaagagggagagcgcaagaagcucaaaccuagauggcuggaugcccggaucuauucugacccccuugcucugaaggaguucaaagaguucgccgcgggcagaaagagccucacccugaaucugauuacagaaauggggcgccucccuaccuuuaugacgcagaaagcccgggaugcucuugacaaccuggccguucugcauaccgcugaggccggcggcagagccuacaaucacgcucucuccgaacugcccgagacacuugagacccugcuccugcugacacuccuugcgaccgugacaggcgggaucuuccuguuucugaugagcggacgcggcauugggaagaugacccucggaaugugcuguaucauuacggccucuauccugcuuugguaugcucaaauccagccgcacuggauugccgccuccaucauucuggaguucuuucucaucguccugcugauuccugagcccgaaaagcagcggacaccccaggauaaccaacucaccuacguggucaucgcuauccuuaccgugguugccgcgacaauggccaaugagaugggcuuccuggagaaaaccaagaaagaccugggccucgggagcauuacaacgcagcagccugaauccaacauccuggacauugaucuuagaccggcuucugccuggacccuguaugcuguggccacaaccuuugugacacccaugcuccggcauagcaucgaaaauuccucugucaacguuagccugaccgcgauugccaaucaggcuacggugcugaugggacucggcaagggguggccucuuuccaaaauggacaucggagugccccugcuggccauuggcugcuacagccaagucaacccuaucacccucacagcugcccuguuccuucugguggcucacuacgccaucauugggcccggacuccaggcgaaggccacccgcgaagcucagaagagagccgcugccggcaucaugaaaaauccuacaguugauggcauuaccgugaucgaccuggauccgauucccuaugacccuaaguuugagaaacagcuggggcaagucaugcuccuugugcugugugucacacaggugcugaugaugcggacaaccugggcccucugcgaagcgcugacacuugcuaccggacccaucucuacccugugggagggcaacccugggcgcuucuggaauacaacgaucgccguuuccauggcuaacauuuuuagaggaagcuaccucgccggcgccgggcugcuguucucuaucaugaagaauaccacaaacacccggcgcggaacaggcaauauuggcgaaacccucggggagaaauggaaguccagacuuaacgcucugggaaaaagcgaguuucagaucuauaagaagucuggcauucaagaaguggaucggacgcuggccaaagaggggaucaagcgcggagaaacagaccaucacgcggucagcagaggcuccgccaaacuccggugguucguggagagaaacaugguuacccccgaggggaagguggucgaucugggauguggccgcggcggguggucuuacuauugcggaggccuuaaaaaugugcgggaagugaaggggcugaccaagagaggaccgggccaugaggaaccuauccccaugagcacauacggguggaaccucguucgccugcaguccggagucgacguguucuuuacacccccugagaaaugugauacacugcucugcgacauuggcgaaagcucccccaauccuacgguggaggcuggccggacccuuagaguccugaaccugguugagaauuggcucaacaauaacacacaguucuguaucaaggugcugaauccguauaugcccucugugauugagaagauggaggcccuucagcgcaaguacgggggagcucugguccggaacccucucagcagaaauuccacccacgaaauguacugggugucuaacgccagcggcaauaucguuuccucugugaacaugauuagccgcaugcugaucaaucgguuuacaaugagacacaaaaaggcgaccuaugagcccgaugucgaccugggguccggaacgcgcaacaucggcauugaaagcgagaucccuaaccucgacauuaucgggaagcggauugagaaaaucaagcaagaacaugagacccuuuggcacuacgaucaggaccaucccuauaaaacaugggccuaccacggaucuuaugaaaccaagcagacaggcuccgcuagcucuauggugaauggcguugugagacugcugaccaaaccgugggaugucgugccuauggugacacagauggccaugaccgacacgacacccuucgggcaacagcgcgucuuuaaggagaagguugauaccagaacccaggaaccuaaagagggaacaaagaaacucaugaagauuacggcugaguggcuguggaaagaacuuggcaagaaaaagacaccccggaugugcacacgcgaggaguucaccagaaaggugcgguccaacgccgcucugggggccaucuuuacagacgagaauaaaagaaagagcgcgcgggaggccguggaagauucucgcuucugggagcucgucgacaaagaaagaaaccugcaccuggagggaaagugugaaaccugcguguacaauaugaugggcaaacgggagaagaagcucggggaguuuggaaaagcuaagggcucccgcgccaucugguauauguggcugggcgcuagauuccuugaauuugaggcccugggguuccucaacgaagaucauugguuuagccgggaaaauucccugagcggaguugaaggcgaggggcuucacaaacugggauacauucuccgcgacgugucuaagaaagagggcggggccauguacgcggaugacacagcuggcugggacaccagaaucacgcuggaagaucugaagaacgaggaaauggucaccaaucauauggagggagaacacaagaaacucgccgaggccauuuucaagcugacauaucagaacaaagugguucgggugcaacgcccuacccccagaggcacagucauggacaucauuagccggcgcgaucagagaggguccggacaggugggcaccuacgggcuuaauacguucacaaacauggaggcucaacugauccggcagauggaaggagagggcguuuuuaagucuauccagcaucucaccgugacagaagagauugccguccagaauuggcuggcucgcguggggagagagcggcuuagcagaauggccaucuccggcgacgauugcgucgugaaaccgcuggacgaucgcuucgcgucugcccucaccgcucugaacgacaugggaaagguucggaaggauauucaacagugggaaccuagcagaggcuggaaugacuggacacaggugcccuuuuguucccaccacuuccaugagcugaucaugaaagaugggcgcguccucguggugcccugccggaaccagaacgaacugauuggcagagcccgcaucucucaaggcgcuggguggagccuucgggagaccgccugucugggaaaguccuaugcgcagauguggagccucauguacuuucacagacgcgaccugcggcuugccgcuaaugccaucugcucugcuguuccuucccauugggugccgacaagcagaaccacauggucuauucacgccaaacacgaauggaugaccacagaggauaugcugaccgucuggaaccgcguguggauccaggagaaucccuggauggaagacaagacguccguugagagcugggaagagauuccuuaucucggcaaacgggaagaccaguggugugggucccugaucggccugacaucuagagcuaccugggccaagaacauucaaaccgcgaucaaucaggugcggagccucauuggaaacgaggaguacacagauuauaugcccuccaugaagagauuccgccgggaagaggaagaggccggcguccugugguga

SEQ ID NO: 20329 - RNA, 9876 nt, Artificial Sequence
  derived and/or modified CDS sequence (opt5) from DENV-2__DQ645540__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugacaaagaccgaggcuaaacacccugccacgcuuagaaaguacugcaucgaagcuaaacugacaaacaccaccacagccucucgguguccgacccagggggagcccucccucaaugaggaacaagauaagcgcuuuguuugcaaacauagcaugguggacagaggauggggcaacggcugugggcuguucggaaagggcgggaucgugacaugcgcgauguuuacgugcaagaaaaauauggagggaaaggucgugcagccugaaaaccuggaguauaccauuguuaucacaccccacucuggcgaagagaaugccguggggaacgauaccggaaaacauggcaaggagauuaaagucacaccucaguccagcaucaccgaagcugagcucacgggcuacgggaccgugacaauggaauguucuccccggaccggacuggacuucaaugagaugguucuucugcagauggaagauaaggccuggcucgugcaccgccaaugguuucuggaccuuccgcugccuuggcuccccggcgcugauacacagggguccaacuggauucagaaagagacccuggucacguucaagaacccucacgccaagaaacaggacguggucgugcugggaagccaagagggcgccaugcauacagcucucaccggggcgacagaaauccagauguccucuggcaaucugcuuuuuaccggacaccugaagugcagacuccggauggacaaacugcagcuuaagggcaugagcuauuccauguguaccgggaaauucaagguugugaaggagaucgccgaaacacaacauggaacgauugucaucagagugcaguacgagggcgaugggagccccugcaaaauucccuucgagaucauggaccuggaaaagcgccacguucucggacggcugauuaccgugaacccuaucgucacagagaaagauucuccggugaauaucgaagcugagcccccuuuuggcgacuccuacauuaucauugggguggaacccggccagcugaagcucagcugguucaaaaagggaucuagcaucggccagauguuugagaccacaaugagaggggccaagcgcauggccauucugggagauaccgcuugggacuucggcucccuugggggaguuuuuacgucuaucggcaaagcccugcaucaagucuucggggcgauuuauggcgcugccuuuagcggaguguccuggacaaugaagauccucaucggcguggucauuaccuggaucgggaugaacagccggucuaccucccugagcgugucucugguucuugugggagucgugacacucuaccugggcguuauggugcaggccgauuccgggugugucgugagcuggaaaaauaaggagcugaaaugcggauccggcauuuucaucaccgacaacguucacacauggacggaacaguauaaguuucagccugagucucccagcaagcucgcuuccgccauucaaaaagcucacgaagaggggaucuguggcaucagaucugugacccgccuggaaaaucuuauguggaagcagauuacaccggagcugaaccauauccucagcgagaaugaagucaaacugaccauuaugacaggagauaucaagggcauuaugcaggccgggaaacggucccugagaccucagcccaccgagcuuaaguacagcuggaaagcguggggaaaggccaagaugcucucuacggaacugcacaaccauaccuuccugaucgacggcccugagacagcugaaugccccaauaccaaccgcgccuggaauagccucgagguggaggauuauggguuuggaguguucacaaccaacaucuggcugaaacuuaaggaacggcaagacgucuuuugugacagcaaacugaugucugcugccauuaaggauaauagagcgguucacgccgacaugggcuacuggaucgaguccgcucucaacgauacauggaaaauugaaaaggccagcuucaucgaggugaagucuugccacuggccuaaaagccauacccugugguccaacggcgugcuggagagcgaaaugauuauccccaagaauuucgcugggccggucucucagcacaacuaucgcccuggauaccauacgcagacagccggccccuggcaccuugggaaacucgagauggacuuugauuucugugaaggaaccaccgugguugugacagaggacugcggcaaucgggggcccucccugagaaccacgacagccagcggaaagcugaucaccgaauggugcugucgguccugcacacucccuccgcugcgcuacagaggcgaggauggcuguugguaugggauggagauucggccccuuaaagaaaaggaggaaaaccuggucaauucucucgugaccgcuggacauggccagaucgacaacuuuagccuggggguucugggaauggcgcuuuuccucgaggaaaugcugagaacacgcgugggcaccaagcacgccauucugcucgucgcuguguccuuuguuacgcugaucaccgggaauaugucuuuccgggaucuuggaagagugauggucauggugggcgccacaaugaccgacgauauuggcaugggggugacauaccuggcccuccuggcugccuuuaaaguccgcccuaccuucgcggcuggacugcuucugagaaagcucacgagcaaagagcugaugaugacaaccaucggcauuguucuccugucccaaucuacaauccccgagaccauccuugaacugaccgacgcccucgcccuggggaugauggugcugaagauugugcggaacauggagaaauaucagcuugcugucacaaucauggccauucugugcgugccuaaugcgguuauccuccagaacgcuuggaaggugagcuguacgauucuggccgucguguccguuagcccccuccugcuuaccucuucccaacagaaggccgauuggaucccucuggcucucacaaucaaaggacugaaucccaccgccauuuuucugacaacccuuagccgcacgucuaagaaaagauccuggccgcugaacgaagcuaucauggccgugggcauggucagcauucucgcgucuucccugcucaagaaugacaucccuaugacagggccccugguggccggaggccuucugaccgucugcuacgugcugaccggccggagcgcugaccucgagcuggaacgcgccgcugauguuagaugggaggagcaggccgaaauuuccgggagcucuccuauccuuagcaucacaauuuccgaggacggaucuaugagcaucaaaaacgaagaggaggaacagacccugacaauucucauccggacgggccugcucgugauuuccgggcuguuccccgucucuaucccgauuaccgccgcugcgugguaucuuugggaggugaagaaacaacgcgccggaguucugugggaugugccuucucccccucccgucggcaaggcugaacuggaggacggggccuacagaaucaagcagaaaggaauccucggcuauucccagauuggcgccgggguguacaaggaaggaacauuucacaccauguggcaugugacacggggcgcuguucugaugcacaaagggaagcgcaucgagcccuccugggccgaugucaaaaaggaccuuauuagcuacggaggcggguggaagcuggagggagaauggaaagagggcgaagagguccaggugcucgcgcuggaaccuggcaagaauccgagagcuguccaaaccaaacccggacucuucaagacgaacaccggaacaaucggcgccgugucccuggauuuuagcccugggaccucuggaucccccauuguugacaaaaagggcaagguggucgggcuuuauggaaacggcgugguuacacggagcggcaccuacgugucugccaucgcucagacagagaaauccaucgaggauaauccugaaauugaggacgauaucuucagaaagaaacgccugacgauuauggaccugcaucccggggccggaaagaccaaacgguaucucccugcgaucgucagagaagcuauuaagcgcggccugcggacacuuauccuggccccgaccagagugguugccgcugagauggaagaggcccuccgcgggcugcccauccgguaccagaccccugcuauuagagccgagcacacaggacgcgaaaucguggaucucaugugucaugcgacguucaccaugcggcugcuuagccccauuagagucccuaacuauaaucugaucauuauggacgaggcccacuuuacagaccccgcuuccaucgccgcucggggcuacauuucuacccgcguggaaaugggggaggccgccggcaucuucaugacagcuaccccgccuggaagcagagaucccuuuccccaguccaacgcgccuaucauggacgaggaacgggagauucccgaacgcagcuggaacucuggccacgagugggugacggauuucaaggggaaaacagucugguuuguuccuuccaucaaggccggaaacgacauugcugccugccugcgcaagaauggcaagaaagugauccaacucagccggaagaccuucgauucugaauaugugaagaccagaacaaacgacugggauuuugucgugaccacagacauuagcgagaugggggccaauuucaaagcugagcgcguuaucgauccgcggagauguaugaagcccgugauccugaccgacggagaagaaagagucauucuugccggcccuaugcccgugacgcauuccucugcggcucagcggagagggcgcguuggccggaacccuaaaaaugaaaacgaucaguacaucuacaugggagagccccuggaaaaugacgaggacugcgcccacuggaaggaggccaaaaugcuccuggauaacauuaauacaccggaaggcaucauuccuagcauguuugagcccgaaagagagaagguggacgcuaucgauggggaauaucgccugagaggagaggcccggaaaaccuucgucgaccucaugcgcagaggcgaucuuccuguguggcuggcguaccgggucgccgcugaggggaucaacuaugccgaccgcagaugguguuuugauggagugaagaacaaucaaauucuggaagagaacguugaaguggagaucuggacaaaggagggcgaacggaaaaagcucaaacccagauggcuggacgcucgcauuuacuccgauccucuugcccugaaggaguucaaagaguucgcugccgggcggaagucucucacccugaaucugaucacggagaugggcagacuccccaccuuuaugacacagaaggcgcgcaacgcccuugacaaucuggcugugcugcauaccgccgaagcuggaggccgggccuauaaccacgcccucagcgagcugccggagacacuugaaacccugcuccugcugacacuccuugcuaccgucacaggcgggauuuuccuguuucugauguccgggaaagggaucggaaagaugacacucggcaugugcugcauuaucaccgcgagcguucugcuuugguacgcccagauccagccucacuggauugcugccucuaucauucuggaguucuuucucaucgugcugcugauucccgaacccgagaaacaaagaaccccucaggauaaucagcucacauauguggucaucgccauccuuaccgugguugcugccacaauggcgaacgaaaugggcuuccuggagaagacgaaaaaggacuuugggcugggaggcauugccacccagcaaccggaguccaauauccucgauauugaccugcggcccgcuagcgccuggacacuuuacgcuguggccaccacauucaucaccccuaugcugcgccauuccauugaaaacucuagcgucaaugugucccucacggcgaucgccaaccaggcuaccguccugauggggcugggaaagggcuggccccucucuaaaauggacaucggggugccucuucuggccauuggauguuacagccagguuaaucccaucacacugaccgcugcccuccugcuucugguggcucacuaugccauuaucggcccuggccuccaggcgaaggccacaagagaggcucaaaaacgggccgcugccgggauuaugaagaacccgaccgucgauggaaucacggugauugaccuggaucccaucccuuacgaccccaaauuugaaaagcagcugggccagguuaugcuccuugugcugugcgucacacaggugcugaugaugcgcaccacaugggcccucugugaggcgcugacccuugcuaccgggccuaucuccacacugugggaaggaaaucccggcagauucuggaacacgaccauugccgugagcauggcuaauaucuuucgggggucuuaucucgccggagccggccugcuguucuccauuaugaagaacacagcuaacacccgcagaggcacagggaauaccggagagacgcucggcgagaaauggaagaaccggcuuaaugcccuggggaaaagcgaauuucaaaucuacaagaaaucuggcauucaggagguugaucgcacacuggcgaaggaaggcaucaaaagaggggagaccgaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucacaaaagggggaccuggccaugaagaacccauccccaugagcaccuauggcuggaaccuggugagacugcaguccggggucgacguguucuuuacaccucccgaaaaaugcgauacgcuccuuugugacauuggagagucuagcccuaauccgaccguugaggccggccgcacacugcgggugcugaaccucgucgaaaauuggcugaacaauaacacccaauucugcaucaaggugcuuaaucccuacaugccuuccguuauugagaagauggaagcucugcagagaaaauacgggggagcccucgugcgcaacccccugagcagaaauuccacacacgagauguauugggucucuaacgcgagcggcaacaucguguccucugugaauaugauuagcagaaugcugaucaaccgcuuuaccaugcggcacaagaaagccacguacgaaccugaugucgaccucggguccggaaccagaaauaucggcauugagucugagauccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagugaaggucgauacccgcacacaagaacccaaagagggaacgaagaagcucaugaaaauuaccgccgaguggcuguggaaggaacuuggcaaaaagaaaacaccuagaauguguacccgggaggaguucacacgcaaggugagaagcaacgcugcccugggggcgaucuuuaccgacgagaauaaauggaagucugcccgggaggcuguugaagauuccggauucugggagcucguggacaaggaaagaaaccugcaccuggagggcaaaugcgaaacaugugucuauaauaugaugggcaagcgggagaaaaagcucggggaguuuggaaaagccaagggcagccgcgcuauuugguacauguggcugggggccagauuccuugaauuugaggcccugggauuccucaacgaagaucauugguuuucucgggaaaauucccugagcggcguggaaggggagggccuucacaagcugggauacauccuccgcgacguuuccaaaaaggagggcggggcgauguaugcugaugacaccgccggaugggauacgagaauuacccuggaagaccugaaaaacgaggaaauggugacaaaucauauggagggcgaacacaagaaacucgccgaggcuaucuucaagcugaccuaccagaacaaggucgugcggguccagcgccccacaccgagagggaccgugauggacauuaucagccggcgcgaucagagaggaucuggccaaguugugacguaugggcuuaauacauucaccaacauggaggcccagcugauccggcagauggaaggcgagggagucuuuaaaagcauucaacagcucacagcuaccgaagagaucgccgugaagaacuggcuggcgcgcgugggcagagagcggcuuucccgcauggccauuucuggggacgauugcguugugaaaccucuggacgauagauucgcuagcgcccucacggcucugaaugacaugggaaagguccggaaagauauccagcagugggaacccuccagaggcuggaacgacuggacccaagugcccuuuugcucucaucacuuccacgagcugauuaugaaggaugggcgcguucucguggucccuugucggaaucaggacgaacugaucggacgggcccgcaucagccagggcgcgggguggucccuucgggagacagccugccugggcaagucuuacgcucagauguggagccucauguauuuucauagacgcgaucugcggcuugccgcuaacgccauuuguuccgcugugccgagccacuggguccccaccucuagaacaaccugguccauccaugccacacacgaauggaugaccacggaggacaugcugacaguguggaaucgcguuuggauucaagagaacccuuggaucgaagauaaaacccccguggagagcugggaagagauuccuuaccucggaaagcgggaagaccaguggugcggcucucugaucgggcugaccuccagagcgacaugggccaaaaauauccagaccgcuauuaaccagguccgcagccucaucggaaaugaggaguauacagacuacaugcccuccaugaagcgguucagacgggaagaggaagaggccggcgugcugugguga

SEQ ID NO: 20330 - RNA, 9876 nt, Artificial Sequence
  derived and/or modified CDS sequence (opt5) from DENV-2__DQ645541__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugacaaagaccgaggcuaaacacccugccacgcuuagaaaguacugcaucgaagcuaaacugacaaacaccaccacagccucucgguguccgacccagggggagcccucccucaaugaggaacaagauaagcgcuuuguuugcaaacauagcaugguggacagaggauggggcaacggcugugggcuguucggaaagggcgggaucgugacaugcgcgauguuuacgugcaagaaaaauauggagggaaaggucgugcagccugaaaaccuggaguauaccauuguuaucacaccccacucuggcgaagagaaugccguggggaacgauaccggaaaacauggcaaggagauuaaagucacaccucaguccagcaucaccgaagcugagcucacgggcuacgggaccgugacaauggaauguucuccccggaccggacuggacuucaaugagaugguucuucugcagauggaagauaaggccuggcucgugcaccgccaaugguuucuggaccuuccgcugccuuggcuccccggcgcugauacacagggguccaacuggauucagaaagagacccuggucacguucaagaacccucacgccaagaaacaggacguggucgugcugggaagccaagagggcgccaugcauacagcucucaccggggcgacagaaauccagauguccucuggcaaucugcuuuuuaccggacaccugaagugcagacuccggauggacaaacugcagcuuaagggcaugagcuauuccauguguaccgggaaauucaagguugugaaggagaucgccgaaacacaacauggaacgauugucaucagagugcaguacgagggcgaugggagccccugcaaaauucccuucgagaucauggaccuggaaaagcgccacguucucggacggcugauuaccgugaacccuaucgucacagagaaagauucuccggugaauaucgaagcugagcccccuuuuggcgacuccuacauuaucauugggguggaacccggccagcugaagcucagcugguucaaaaagggaucuagcaucggccagauguuugagaccacaaugagaggggccaagcgcauggccauucugggagauaccgcuugggacuucggcucccuugggggaguuuuuacgucuaucggcaaagcccugcaucaagucuucggggcgauuuauggcgcugccuuuagcggaguguccuggacaaugaagauccucaucggcguggucauuaccuggaucgggaugaacagccggucuaccucccugagcgugucucugguucuugugggagucgugacacucuaccugggcguuauggugcaggccgauuccgggugugucgugagcuggaaaaauaaggagcugaaaugcggauccggcauuuucaucaccgacaacguucacacauggacggaacaguauaaguuucagccugagucucccagcaagcucgcuuccgccauucaaaaagcucacgaagaggggaucuguggcaucagaucugugacccgccuggaaaaucuuauguggaagcagauuacaccggagcugaaccauauccucagcgagaaugaagucaaacugaccauuaugacaggagauaucaagggcauuaugcaggccgggaaacggucccugagaccucagcccaccgagcuuaaguacagcuggaaagcguggggaaaggccaagaugcucucuacggaacugcacaaccauaccuuccugaucgacggcccugagacagcugaaugccccaauaccaaccgcgccuggaauagccucgagguggaggauuauggguuuggaguguucacaaccaacaucuggcugaaacuuaaggaacggcaagacgucuuuugugacagcaaacugaugucugcugccauuaaggauaauagagcgguucacgccgacaugggcuacuggaucgaguccgcucucaacgauacauggaaaauugaaaaggccagcuucaucgaggugaagucuugccacuggccuaaaagccauacccugugguccaacggcgugcuggagagcgaaaugauuauccccaagaauuucgcugggccggucucucagcacaacuaucgcccuggauaccauacgcagacagccggccccuggcaccuugggaaacucgagauggacuuugauuucugugaaggaaccaccgugguugugacagaggacugcggcaaucgggggcccucccugagaaccacgacagccagcggaaagcugaucaccgaauggugcugucgguccugcacacucccuccgcugcgcuacagaggcgaggauggcuguugguaugggauggagauucggccccuuaaagaaaaggaggaaaaccuggucaauucucucgugaccgcuggacauggccagaucgacaacuuuagccuggggguucugggaauggcgcuuuuccucgaggaaaugcugagaacacgcgugggcaccaagcacgccauucugcucgucgcuguguccuuuguuacgcugaucaccgggaauaugucuuuccgggaucuuggaagagugauggucauggugggcgccacaaugaccgacgauauuggcaugggggugacauaccuggcccuccuggcugccuuuaaaguccgcccuaccuucgcggcuggacugcuucugagaaagcucacgagcaaagagcugaugaugacaaccaucggcauuguucuccugucccaaucuacaauccccgagaccauccuugaacugaccgacgcccucgcccuggggaugauggugcugaagauugugcggaacauggagaaauaucagcuugcugucacaaucauggccauucugugcgugccuaaugcgguuauccuccagaacgcuuggaaggugagcuguacgauucuggccgucguguccguuagcccccuccugcuuaccucuucccaacagaaggccgauuggaucccucuggcucucacaaucaaaggacugaaucccaccgccauuuuucugacaacccuuagccgcacgucuaagaaaagauccuggccgcugaacgaagcuaucauggccgugggcauggucagcauucucgcgucuucccugcucaagaaugacaucccuaugacagggccccugguggccggaggccuucugaccgucugcuacgugcugaccggccggagcgcugaccucgagcuggaacgcgccgcugauguuagaugggaggagcaggccgaaauuuccgggagcucuccuauccuuagcaucacaauuuccgaggacggaucuaugagcaucaaaaacgaagaggaggaacagacccugacaauucucauccggacgggccugcucgugauuuccgggcuguuccccgucucuaucccgauuaccgccgcugcgugguaucuuugggaggugaagaaacaacgcgccggaguucugugggaugugccuucucccccucccgucggcaaggcugaacuggaggacggggccuacagaaucaagcagaaaggaauccucggcuauucccagauuggcgccgggguguacaaggaaggaacauuucacaccauguggcaugugacacggggcgcuguucugaugcacaaagggaagcgcaucgagcccuccugggccgaugucaaaaaggaccuuauuagcuacggaggcggguggaagcuggagggagaauggaaagagggcgaagagguccaggugcucgcgcuggaaccuggcaagaauccgagagcuguccaaaccaaacccggacucuucaagacgaacaccggaacaaucggcgccgugucccuggauuuuagcccugggaccucuggaucccccauuguugacaaaaagggcaagguggucgggcuuuauggaaacggcgugguuacacggagcggcaccuacgugucugccaucgcucagacagagaaauccaucgaggauaauccugaaauugaggacgauaucuucagaaagaaacgccugacgauuauggaccugcaucccggggccggaaagaccaaacgguaucucccugcgaucgucagagaagcuauuaagcgcggccugcggacacuuauccuggccccgaccagagugguugccgcugagauggaagaggcccuccgcgggcugcccauccgguaccagaccccugcuauuagagccgagcacacaggacgcgaaaucguggaucucaugugucaugcgacguucaccaugcggcugcuuagccccauuagagucccuaacuauaaucugaucauuauggacgaggcccacuuuacagaccccgcuuccaucgccgcucggggcuacauuucuacccgcguggaaaugggggaggccgccggcaucuucaugacagcuaccccgccuggaagcagagaucccuuuccccaguccaacgcgccuaucauggacgaggaacgggagauucccgaacgcagcuggaacucuggccacgagugggugacggauuucaaggggaaaacagucugguuuguuccuuccaucaaggccggaaacgacauugcugccugccugcgcaagaauggcaagaaagugauccaacucagccggaagaccuucgauucugaauaugugaagaccagaacaaacgacugggauuuugucgugaccacagacauuagcgagaugggggccaauuucaaagcugagcgcguuaucgauccgcggagauguaugaagcccgugauccugaccgacggagaagaaagagucauucuugccggcccuaugcccgugacgcauuccucugcggcucagcggagagggcgcguuggccggaacccuaaaaaugaaaacgaucaguacaucuacaugggagagccccuggaaaaugacgaggacugcgcccacuggaaggaggccaaaaugcuccuggauaacauuaauacaccggaaggcaucauuccuagcauguuugagcccgaaagagagaagguggacgcuaucgauggggaauaucgccugagaggagaggcccggaaaaccuucgucgaccucaugcgcagaggcgaucuuccuguguggcuggcguaccgggucgccgcugaggggaucaacuaugccgaccgcagaugguguuuugauggagugaagaacaaucaaauucuggaagagaacguugaaguggagaucuggacaaaggagggcgaacggaaaaagcucaaacccagauggcuggacgcucgcauuuacuccgauccucuugcccugaaggaguucaaagaguucgcugccgggcggaagucucucacccugaaucugaucacggagaugggcagacuccccaccuuuaugacacagaaggcgcgcaacgcccuugacaaucuggcugugcugcauaccgccgaagcuggaggccgggccuauaaccacgcccucagcgagcugccggagacacuugaaacccugcuccugcugacacuccuugcuaccgucacaggcgggauuuuccuguuucugauguccgggaaagggaucggaaagaugacacucggcaugugcugcauuaucaccgcgagcguucugcuuugguacgcccagauccagccucacuggauugcugccucuaucauucuggaguucuuucucaucgugcugcugauucccgaacccgagaaacaaagaaccccucaggauaaucagcucacauauguggucaucgccauccuuaccgugguugcugccacaauggcgaacgaaaugggcuuccuggagaagacgaaaaaggacuuugggcugggaggcauugccacccagcaaccggaguccaauauccucgauauugaccugcggcccgcuagcgccuggacacuuuacgcuguggccaccacauucaucaccccuaugcugcgccauuccauugaaaacucuagcgucaaugugucccucacggcgaucgccaaccaggcuaccguccugauggggcugggaaagggcuggccccucucuaaaauggacaucggggugccucuucuggccauuggauguuacagccagguuaaucccaucacacugaccgcugcccuccugcuucugguggcucacuaugccauuaucggcccuggccuccaggcgaaggccacaagagaggcucaaaaacgggccgcugccgggauuaugaagaacccgaccgucgauggaaucacggugauugaccuggaucccaucccuuacgaccccaaauuugaaaagcagcugggccagguuaugcuccuugugcugugcgucacacaggugcugaugaugcgcaccacaugggcccucugugaggcgcugacccuugcuaccgggccuaucuccacacugugggaaggaaaucccggcagauucuggaacacgaccauugccgugagcauggcuaauaucuuucgggggucuuaucucgccggagccggccugcuguucuccauuaugaagaacacagcuaacacccgcagaggcacagggaauaccggagagacgcucggcgagaaauggaagaaccggcuuaaugcccuggggaaaagcgaauuucaaaucuacaagaaaucuggcauucaggagguugaucgcacacuggcgaaggaaggcaucaaaagaggggagaccgaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucacaaaagggggaccuggccaugaagaacccauccccaugagcaccuauggcuggaaccuggugagacugcaguccggggucgacguguucuuuacaccucccgaaaaaugcgauacgcuccuuugugacauuggagagucuagcccuaauccgaccguugaggccggccgcacacugcgggugcugaaccucgucgaaaauuggcugaacaauaacacccaauucugcaucaaggugcuuaaucccuacaugccuuccguuauugagaagauggaagcucugcagagaaaauacgggggagcccucgugcgcaacccccugagcagaaauuccacacacgagauguauugggucucuaacgcgagcggcaacaucguguccucugugaauaugauuagcagaaugcugaucaaccgcuuuaccaugcggcacaagaaagccacguacgaaccugaugucgaccucggguccggaaccagaaauaucggcauugagucugagacacccaaccuugauaucauuggcaagcgcaucgagaaaauuaagcaggagcaugaaaccagcuggcacuaugaccaggaccauccguacaagacaugggcuuaucacggguccuacgagaccaaacaaacaggaagcgccucuuccaugguuaauggcguggugcggcugcugaccaagccuugggaugucauccccauggugacgcagauggcuaugacagacaccaccccuuucgggcagcagagaguuuuuaaagaaaagguggauacacgcacgcaagagcccaaagagggaaccaagaagcucaugaaaaucacagccgaauggcuguggaaggagcuuggcaaaaagaaaaccccuagaauguguacacgggaagaguucacccgcaaggucagaagcaacgcugcccugggggcgauuuuuacagacgagaauaaauggaagucugcccgggaagcuguggaggauuccggauucugggaacucguugacaaggagagaaaccugcaccuggaaggcaaaugcgagaccuguguguauaauaugaugggcaagcgggagaaaaagcucggggaauuuggaaaagccaagggcagccgcgcuaucugguacauguggcugggggccagauuccuugaguuugaagcccugggauuccucaacgaggaucauugguuuucucgggaaaauucccugagcggcgucgagggggagggccuucacaagcugggauacauucuccgcgacguguccaaaaaggaaggcggggcgauguaugcugaugacacggccggaugggauaccagaaucacacuggaggaccugaaaaacgaagagaugguuaccaaucauauggaaggcgagcacaagaaacucgccgaggcuauuuucaagcugacauaccagaacaaggugguccgggugcagcgccccaccccgagagggacggucauggacaucauuagccggcgcgaucagagaggaucuggccaagugguuacauaugggcuuaauaccuucacaaacauggaagcccagcugauccggcagauggagggcgaaggaguguuuaaaagcauccaacagcucaccgcuacggaggagauugccgucaagaacuggcuggcgcgcgugggcagagaacggcuuucccgcauggccaucucuggggacgauugcgugguuaaaccucuggacgauagauucgcuagcgcccucaccgcucugaaugacaugggaaaggugcggaaagauauucagcagugggagcccuccagaggcuggaacgacuggacacaaguccccuuuugcucucaucacuuccacgaacugaucaugaaggaugggcgcgugcucguugugccuugucggaaucaggacgagcugauuggacgggcccgcaucagccagggcgcgggguggucccuucgggaaaccgccugccugggcaagucuuacgcucagauguggagccucauguauuuucauagacgcgaucugcggcuugccgcuaacgccaucuguuccgcugucccgagccacugggugcccacaucuagaaccacaugguccauucaugccacccacgaguggaugacgacagaggacaugcugaccgucuggaaucgcguguggauccaagaaaacccuuggauugaggauaaaacccccguugaaagcugggaggaaaucccuuaccucggaaagcgggaggaccaguggugcggcucucugauugggcugacauccagagcgaccugggccaaaaauauccagacagcuaucaaccaggugcgcagccucauuggaaaugaggaauauacggacuacaugcccuccaugaagcgguucagacgggaggaagaggaagccggcguccugugguga

SEQ ID NO: 20331 - RNA, 9876 nt, Artificial Sequence
  derived and/or modified CDS sequence (opt5) from DENV-2__DQ645542__SS-prME
accgccggagugaucauuaugaugauccccacggugguugcuuuccaccugacgaccagaaauggggagccucauaugauugugagccggcaggaaaagggaaaaucccuccuguuuaagacagagaauggcgugaacaugugcacccuuauggccauggaccugggggaacucugugaggauacaaucaccuacaauugcccgcugcuucgccaaaacgaacccgaggacauugauuguuggugcaauucuacaagcaccugggucacguauggaaccuguacagcgaccggcgagcacagacgggaaaaacgcuccguggcucugguuccucauguggggaugggacucgagacaagaaccgaaacguggaugucuagcgagggcgccuggaagcacgcccagcggaucgagacauggguccugcgccaucccggcuucaccaucauggcugccauucuggcuuacacaaucgggaccaccuauuuucagagagugcucauuuucauccugcuuacagccguugcgccuuccaugacgaugcggugcauuggaaucucuaaccgcgacuuuguggaaggcgucagcgggggauccuggguggauauugugcuggagcacggcagcugugucaccacaauggccaaaaauaagcccacccucgacuucgaacugacaaagaccgaggcuaaacacccugccacgcuuagaaaguacugcaucgaagcuaaacugacaaacaccaccacagccucucgguguccgacccagggggagcccucccucaaugaggaacaagauaagcgcuuuguuugcaaacauagcaugguggacagaggauggggcaacggcugugggcuguucggaaagggcgggaucgugacaugcgcgauguuuacgugcaagaaaaauauggagggaaaggucgugcagccugaaaaccuggaguauaccauuguuaucacaccccacucuggcgaagagaaugccguggggaacgauaccggaaaacauggcaaggagauuaaagucacaccucaguccagcaucaccgaagcugagcucacgggcuacgggaccgugacaauggaauguucuccccggaccggacuggacuucaaugagaugguucuucugcagauggaagauaaggccuggcucgugcaccgccaaugguuucuggaccuuccgcugccuuggcuccccggcgcugauacacagggguccaacuggauucagaaagagacccuggucacguucaagaacccucacgccaagaaacaggacguggucgugcugggaagccaagagggcgccaugcauacagcucucaccggggcgacagaaauccagauguccucuggcaaucugcuuuuuaccggacaccugaagugcagacuccggauggacaaacugcagcuuaagggcaugagcuauuccauguguaccgggaaauucaagguugugaaggagaucgccgaaacacaacauggaacgauugucaucagagugcaguacgagggcgaugggagccccugcaaaauucccuucgagaucauggaccuggaaaagcgccacguucucggacggcugauuaccgugaacccuaucgucacagagaaagauucuccggugaauaucgaagcugagcccccuuuuggcgacuccuacauuaucauugggguggaacccggccagcugaagcucagcugguucaaaaagggaucuagcaucggccagauguuugagaccacaaugagaggggccaagcgcauggccauucugggagauaccgcuugggacuucggcucccuugggggaguuuuuacgucuaucggcaaagcccugcaucaagucuucggggcgauuuauggcgcugccuuuagcggaguguccuggacaaugaagauccucaucggcguggucauuaccuggaucgggaugaacagccggucuaccucccugagcgugucucugguucuugugggagucgugacacucuaccugggcguuauggugcaggccgauuccgggugugucgugagcuggaaaaauaaggagcugaaaugcggauccggcauuuucaucaccgacaacguucacacauggacggaacaguauaaguuucagccugagucucccagcaagcucgcuuccgccauucaaaaagcucacgaagaggggaucuguggcaucagaucugugacccgccuggaaaaucuuauguggaagcagauuacaccggagcugaaccauauccucagcgagaaugaagucaaacugaccauuaugacaggagauaucaagggcauuaugcaggccgggaaacggucccugagaccucagcccaccgagcuuaaguacagcuggaaagcguggggaaaggccaagaugcucucuacggaacugcacaaccauaccuuccugaucgacggcccugagacagcugaaugccccaauaccaaccgcgccuggaauagccucgagguggaggauuauggguuuggaguguucacaaccaacaucuggcugaaacuuaaggaacggcaagacgucuuuugugacagcaaacugaugucugcugccauuaaggauaauagagcgguucacgccgacaugggcuacuggaucgaguccgcucucaacgauacauggaaaauugaaaaggccagcuucaucgaggugaagucuugccacuggccuaaaagccauacccugugguccaacggcgugcuggagagcgaaaugauuauccccaagaauuucgcugggccggucucucagcacaacuaucgcccuggauaccauacgcagacagccggccccuggcaccuugggaaacucgagauggacuuugauuucugugaaggaaccaccgugguugugacagaggacugcggcaaucgggggcccucccugagaaccacgacagccagcggaaagcugaucaccgaauggugcugucgguccugcacacucccuccgcugcgcuacagaggcgaggauggcuguugguaugggauggagauucggccccuuaaagaaaaggaggaaaaccuggucaauucucucgugaccgcuggacauggccagaucgacaacuuuagccuggggguucugggaauggcgcuuuuccucgaggaaaugcugagaacacgcgugggcaccaagcacgccauucugcucgucgcuguguccuuuguuacgcugaucaccgggaauaugucuuuccgggaucuuggaagagugauggucauggugggcgccacaaugaccgacgauauuggcaugggggugacauaccuggcccuccuggcugccuuuaaaguccgcccuaccuucgcggcuggacugcuucugagaaagcucacgagcaaagagcugaugaugacaaccaucggcauuguucuccugucccaaucuacaauccccgagaccauccuugaacugaccgacgcccucgcccuggggaugauggugcugaagauugugcggaacauggagaaauaucagcuugcugucacaaucauggccauucugugcgugccuaaugcgguuauccuccagaacgcuuggaaggugagcuguacgauucuggccgucguguccguuagcccccuccugcuuaccucuucccaacagaaggccgauuggaucccucuggcucucacaaucaaaggacugaaucccaccgccauuuuucugacaacccuuagccgcacgucuaagaaaagauccuggccgcugaacgaagcuaucauggccgugggcauggucagcauucucgcgucuucccugcucaagaaugacaucccuaugacagggccccugguggccggaggccuucugaccgucugcuacgugcugaccggccggagcgcugaccucgagcuggaacgcgccgcugauguuagaugggaggagcaggccgaaauuuccgggagcucuccuauccuuagcaucacaauuuccgaggacggaucuaugagcaucaaaaacgaagaggaggaacagacccugacaauucucauccggacgggccugcucgugauuuccgggcuguuccccgucucuaucccgauuaccgccgcugcgugguaucuuugggaggugaagaaacaacgcgccggaguucugugggaugugccuucucccccucccgucggcaaggcugaacuggaggacggggccuacagaaucaagcagaaaggaauccucggcuauucccagauuggcgccgggguguacaaggaaggaacauuucacaccauguggcaugugacacggggcgcuguucugaugcacaaagggaagcgcaucgagcccuccugggccgaugucaaaaaggaccuuauuagcuacggaggcggguggaagcuggagggagaauggaaagagggcgaagagguccaggugcucgcgcuggaaccuggcaagaauccgagagcuguccaaaccaaacccggacucuucaagacgaacaccggaacaaucggcgccgugucccuggauuuuagcccugggaccucuggaucccccauuguugacaaaaagggcaagguggucgggcuuuauggaaacggcgugguuacacggagcggcaccuacgugucugccaucgcucagacagagaaauccaucgaggauaauccugaaauugaggacgauaucuucagaaagaaacgccugacgauuauggaccugcaucccggggccggaaagaccaaacgguaucucccugcgaucgucagagaagcuauuaagcgcggccugcggacacuuauccuggccccgaccagagugguugccgcugagauggaagaggcccuccgcgggcugcccauccgguaccagaccccugcuauuagagccgagcacacaggacgcgaaaucguggaucucaugugucaugcgacguucaccaugcggcugcuuagccccauuagagucccuaacuauaaucugaucauuauggacgaggcccacuuuacagaccccgcuuccaucgccgcucggggcuacauuucuacccgcguggaaaugggggaggccgccggcaucuucaugacagcuaccccgccuggaagcagagaucccuuuccccaguccaacgcgccuaucauggacgaggaacgggagauucccgaacgcagcuggaacucuggccacgagugggugacggauuucaaggggaaaacagucugguuuguuccuuccaucaaggccggaaacgacauugcugccugccugcgcaagaauggcaagaaagugauccaacucagccggaagaccuucgauucugaauaugugaagaccagaacaaacgacugggauuuugucgugaccacagacauuagcgagaugggggccaauuucaaagcugagcgcguuaucgauccgcggagauguaugaagcccgugauccugaccgacggagaagaaagagucauucuugccggcccuaugcccgugacgcauuccucugcggcucagcggagagggcgcguuggccggaacccuaaaaaugaaaacgaucaguacaucuacaugggagagccccuggaaaaugacgaggacugcgcccacuggaaggaggccaaaaugcuccuggauaacauuaauacaccggaaggcaucauuccuagcauguuugagcccgaaagagagaagguggacgcuaucgauggggaauaucgccugagaggagaggcccggaaaaccuucgucgaccucaugcgcagaggcgaucuuccuguguggcuggcguaccgggucgccgcugaggggaucaacuaugccgaccgcagaugguguuuugauggagugaagaacaaucaaauucuggaagagaacguugaaguggagaucuggacaaaggagggcgaacggaaaaagcucaaacccagauggcuggacgcucgcauuuacuccgauccucuugcccugaaggaguucaaagaguucgcugccgggcggaagucucucacccugaaucugaucacggagaugggcagacuccccaccuuuaugacacagaaggcgcgcaacgcccuugacaaucuggcugugcugcauaccgccgaagcuggaggccgggccuauaaccacgcccucagcgagcugccggagacacuugaaacccugcuccugcugacacuccuugcuaccgucacaggcgggauuuuccuguuucugauguccgggaaagggaucggaaagaugacacucggcaugugcugcauuaucaccgcgagcguucugcuuugguacgcccagauccagccucacuggauugcugccucuaucauucuggaguucuuucucaucgugcugcugauucccgaacccgagaaacaaagaaccccucaggauaaucagcucacauauguggucaucgccauccuuaccgugguugcugccacaauggcgaacgaaaugggcuuccuggagaagacgaaaaaggacuuugggcugggaggcauugccacccagcaaccggaguccaauauccucgauauugaccugcggcccgcuagcgccuggacacuuuacgcuguggccaccacauucaucaccccuaugcugcgccauuccauugaaaacucuagcgucaaugugucccucacggcgaucgccaaccaggcuaccguccugauggggcugggaaagggcuggccccucucuaaaauggacaucggggugccucuucuggccauuggauguuacagccagguuaaucccaucacacugaccgcugcccuccugcuucugguggcucacuaugccauuaucggcccuggccuccaggcgaaggccacaagagaggcucaaaaacgggccgcugccgggauuaugaagaacccgaccgucgauggaaucacggugauugaccuggaucccaucccuuacgaccccaaauuugaaaagcagcugggccagguuaugcuccuugugcugugcgucacacaggugcugaugaugcgcaccacaugggcccucugugaggcgcugacccuugcuaccgggccuaucuccacacugugggaaggaaaucccggcagauucuggaacacgaccauugccgugagcauggcuaauaucuuucgggggucuuaucucgccggagccggccugcuguucuccauuaugaagaacacagcuaacacccgcagaggcacagggaauaccggagagacgcucggcgagaaauggaagaaccggcuuaaugcccuggggaaaagcgaauuucaaaucuacaagaaaucuggcauucaggagguugaucgcacacuggcgaaggaaggcaucaaaagaggggagaccgaccaucacgccgucucccggggaagcgcuaagcucagaugguucguggagcgcaaccuggugaccccggaaggcaaggucauggaucuuggcugcgggcggggaggcuggucuuauuacugugggggacugaaaaauguuaaggaggugaaaggccucacaaaagggggaccuggccaugaagaacccauccccaugagcaccuauggcuggaaccuggugagacugcaguccggggucgacguguucuuuacaccucccgaaaaaugcgauacgcuccuuugugacauuggagagucuagcccuaauccgaccguugaggccggccgcacacugcgggugcugaaccucgucgaaaauuggcugaacaauaacacccaauucugcaucaaggugcuuaaucccuacaugccuuccguuauugagaagauggaagcucugcagagaaaauacgggggagcccucgugcgcaacccccugagcagaaauuccacacacgagauguauugggucucuaacgcgagcggcaacaucguguccucugugaauaugauuagcagaaugcugaucaaccgcuuuaccaugcggcacaagaaagccacguacgaaccugaugucgaccucggguccggaaccagaaauaucggcauugagucugagauccccaaccuugauauuaucggcaagcgcauugagaaaaucaagcaggagcaugaaacaagcuggcacuaugaccaggaccauccguacaagaccugggcuuaucacggguccuacgagacaaaacaaaccggaagcgccucuuccaugguuaauggcguggugcggcugcugacaaagccuugggaugucauccccauggugacccagauggcuaugacggacacaaccccuuucgggcagcagagaguuuuuaaagaaaagguggauacccgcacacaagagcccaaagagggaacgaagaagcucaugaaaauuaccgccgaauggcuguggaaggagcuuggcaaaaagaaaacaccuagaauguguacccgggaagaguucacacgcaaggucagaagcaacgcugcccugggggcgaucuuuaccgacgagaauaaauggaagucugcccgggaagcuguggaggauuccggauucugggaacucguugacaaggagagaaaccugcaccuggaaggcaaaugcgagacauguguguauaauaugaugggcaagcgggagaaaaagcucggggaauuuggaaaagccaagggcagccgcgcuauuugguacauguggcugggggccagauuccuugaguuugaagcccugggauuccucaacgaggaucauugguuuucucgggaaaauucccugagcggcgucgagggggagggccuucacaagcugggauacauccuccgcgacguguccaaaaaggaaggcggggcgauguaugcugaugacaccgccggaugggauacgagaauuacccuggaggaccugaaaaacgaagagaugguuacaaaucauauggaaggcgagcacaagaaacucgccgaggcuaucuucaagcugaccuaccagaacaaggugguccgggugcagcgccccacaccgagagggaccgucauggacauuaucagccggcgcgaucagagaggaucuggccaagugguuacguaugggcuuaauacauucaccaacauggaagcccagcugauccggcagauggagggcgaaggaguguuuaaaagcauucaacagcucacagcuaccgaggagaucgccgucaagaacuggcuggcgcgcgugggcagagaacggcuuucccgcauggccauuucuggggacgauugcgugguuaaaccucuggacgauagauucgcuagcgcccucacggcucugaaugacaugggaaaggugcggaaagauauccagcagugggagcccuccagaggcuggaacgacuggacccaaguccccuuuugcucucaucacuuccacgaacugauuaugaaggaugggcgcgugcucguugugccuugucggaaucaggacgagcugaucggacgggcccgcaucagccagggcgcgggguggucccuucgggaaacagccugccugggcaagucuuacgcucagauguggagccucauguauuuucauagacgcgaucugcggcuugccgcuaacgccauuuguuccgcugucccgagccacugggugcccaccucuagaacaaccugguccauccaugccacacacgaguggaugaccacggaggacaugcugacagucuggaaucgcguguggauucaagaaaacccuuggaucgaggauaaaacccccguugaaagcugggaggaaauuccuuaccucggaaagcgggaggaccaguggugcggcucucugaucgggcugaccuccagagcgacaugggccaaaaauauccagaccgcuauuaaccaggugcgcagccucaucggaaaugaggaauauacagacuacaugcccuccaugaagcgguucagacgggaggaagaggaagccggcguccugugguga

SEQ ID NO: 20332 - RNA, 9876 nt, Artificial Sequence
  derived and/or modified CDS sequence (opt5) from DENV-2__AY702036__SS-prME
accgccggagugaucgucaugcugauucccacagcuauggccuuccaccucacgacccggaacggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucuccacaaacaucuggcugaaacuucgggagaaacaggacgucuuuugugauagcaagcugaugucugccgcuaucaaagacaauagagccgugcacgcggauaugggcuauuggauugaauccgcccucaacgacaccuggaagauggagaaggcuagcuucaucgagguuaaaucuugccacuggccuaagagccauacgcugugguccaauggggugcuggaaagcgagaugauuauccccaaaaacuucgccggaccggucucucagcacaacuaccgcccuggcuaucauacacaaaccgcugggcccuggcaccuuggaaagcucgaaauggauuuugacuucugugagggcaccacagugguggucaccgaagauugcgggaaucggggacccucccugagaacgacaaccgccagcggcaaacugauuacagaguggugcugucgguccugcacccucccuccgcugcgcuacagaggcgaggacggguguugguacggaauggaaauccggccccuuaaggagaaggaagagaaccugguuaauucucucgugacagccggccaugggcagauugauaacuuuagccugggagugcugggcauggcucuuuuccucgaagagaugcugagaacccgcgucgggacgaaacacgcgauccugcucguggccguuuccuuugugacccugaucacaggaaauaugucuuuccgggaccuuggcagagucauggugaugguuggcgcuaccaugacagaugacauugggaugggagugaccuaucuggcccuccuggccgcuuuuaagguccgcccuacguucgccgcgggccugcuucugagaaaacucacaagcaaggagcugaugauggcuaccaucgggauugcccuccugucccagucuacaaugcccgaaaccauccuugagcugaccgaugcccucgcucugggaaugauggugcugaaaauuguucggaacauggaaaaguaccaacuugccgugacaaucauggcgaucagcugcgucccuaaugcugugauucugcagaacgccuggaagguguccuguacgauccucgccgcugucagcguuucuccccugcuccugaccuccagccagcagaaagccgacuggauuccucuugcucugacaaucaagggccucaaucccaccgccauuuuucugacaacccugucucgcacguccaaaaagagaagcuggccgcuuaacgaggcgaucauggccguggggauggugucuauccuggcuuccagccuccugaaaaaugacauuccuaugacaggaccccucgucgccggcggccugcuuaccgugugcuauguucugaccgggcgguccgcugaucuggaacucgagcgcgccgccgacgugaagugggaggaucaagcugaaaucagcggaucuagcccuauucuguccaucacaauuucugaggacggcagcauguccaucaaaaacgaagaggaggaacagacccuuacaauucugaucagaacggggcuccuggucaucucuggaguguuccccguuagcauuccgaucaccgcggccgcuugguaccucugggaggugaagaagcagcgggccggcguccugugggaugugccuucucccccucccgucgggaaagccgaacuugaggacggagcuuaucgcauuaagcagagaggcauccugggcuacagccaaauuggggccggaguguauaaagaaggcacauuucacaccauguggcauguuacaagaggggcggugcugaugcaccgcggaaagagaaucgagcccagcugggcugaugucaaaaaggaccucaucuccuacggcgggggauggaagcuggagggcgaauggaaagagggcgaagaggugcagguucuugcccuggaaccugggaagaauccgcgggccgugcagaccaaacccggaauuuucaagacgaacaccggcacaaucggggcugucagccucgauuuuucuccuggaaccuccggcagccccauuguggacagaaaagggaaggugguuggacuguacggcaauggcgucgugacacgcucuggggccuauguguccgcgaucgcucagaccgaaaagagcauugaggauaacccugaaaucgaggacgauaucuuccggaaaaagagacucacaauuauggaccugcaucccggagccggcaaaacgaagcgcuaccuuccugccaucguccgggaagcuauuaacagagggcugcgcacccugauccucgccccgacacgggugguugcugccgagauggaagaggcgcugagaggacuucccauucgcuaucaaaccccugccauccgggcugagcacaccggcagagaaauuguggaccugaugugucaugccacauucacgaugcggcuccugucccccguccgcgugccuaauuacaaccucaucaucauggaugaggcucacuuuaccgaccccgccucuauugccgcuagaggguauaucagcacacggguugaaaugggcgaggcggccggaauuuucaugaccgcuacaccgccuggcucccgcgaucccuuuccccagagcaaugccccuaucauggacgaggaaagagagauucccgaacggucuuggaacuccgggcacgagugggugaccgauuucaaaggaaagacggucugguuugugccuagcaucaaggccggcaaugacaucgcugccugccugcgcaagaaugggaagaaaguuauucagcuuucucgcaagacauucgauagcgaauacgugaaaacccgggcgaaugacugggauuuugucgugaccacagacaucuccgagaugggagcuaacuucaaggccgagagagugauugauccgcgccgguguaugaagcccgucauccugaccgacggcgaagagagaguuauucuggccgggccuaugcccgugacacauucuagcgcugcccaacgccggggcagaaucggacgcaauccuaaaaacgaaaaugaccaguauaucuacaugggcgagccccucgaaaacgaugaggacugcgcgcacuggaaggaggccaaaaugcugcuugauaauauuaacaccccggaagggaucauuccuuccauguuugagcccgaaagagagaagguggacgcuaucgauggagaauaccggcugcgcggcgaggccagaaaaacguucgucgaccucaugcggcgcggggaucugccuguguggcuggcuuauaagguugccgcugagggaauuaauuacgccgacagaaaaugguguuuugauggcaucaagaacaaccagauucucgaagagaauguggaagucgagaucuggacaaaggagggggaacggaagaaacuuaaacccagauggcuggacgcgcgcaucuauucugauccucuggcccucaaagaguucaaagaguucgcugccggccggaagucccugacccuuaaccugauuacagagaugggaagacuccccaccuuuaugacgcagaaggcucgcaaugcccuggacaaccuggccgugcuccauaccgcugaagcgggcgggcgggccuacaaucacgcucuuuccgagcugccggagacacuggaaacccuccugcuucugacacuccuggccaccguuacaggaggcaucuuccuguuucucaugagcgggaaaggaauuggcaagaugacccuuggcaugugcugcaucauuacggccucuucccugcugugguaugcucaaauccagccucacuggaucgccgcgagcauuauccucgaguucuuucugauugugcuucugauccccgaacccgagaaacagagaacaccucaggauaaccaacucaccuacgucgugauugccauccugaccgucguggcugccacaauggcuaaugaaaugggguuccuggagaagaccaaaaaggaccucggacuuggcuccaucacaacgcaggagucugaaagcaacauucuggacaucgaucugcggccggccuccgcguggacccucuaugccguugcuacaaccuuugugacacccaugcugcgccauucuauugagaauagcuccgugaacgucagccuuaccgccaucgcuaaucaggccacgguucugauggggcucggaaagggcuggccucugucuaaaauggacauuggggugccccugcucgcuaucggauguuacucccaggugaacccuauuacccuuacagccgcgcugcugcuccuggucgcccacuacgcuaucaucggccccggccuucaagccaaggcuaccagagaagcccagaaacgggccgcggcugggauuaugaagaauccuacaguggauggaaucaccguuauugaccuggagccgauccccuaugauccuaaauucgaaaagcagcucggccaggugaugcugcugauucucugcgucacgcaagugcuuaugaugcgcacaaccugggcccugugugaggcucugacacucgccaccgggcccaucagcacccugugggagggaaacccuggcagauuuuggaauacaacgaucgccgucucuauggcuaacauuuuccggggguccuaccuugccggagcgggccugcucuuuagcaucaugaagaauaccacaaacacccgcagaggcacagggaacauuggagaaacccugggcgagaaauggaagucucggcugaaugcccucgggaaaagcgaguuccagaucuauaagaaauccggcauucaggagguggaccgcacgcuugcuaaggagggcaucaaaagaggggaaacagaucaucacgccguuucucggggaagcgcuaagcugagaugguuuguggagcgcaacauggucacccccgaaggcaaggugguugaccugggcugcgggcggggaggcugguccuacuauugugggggacucaaaaaugugagagaggucaagggccugaccaaagggggaccgggccaugaagaaccuauccccaugagcacauacggcuggaaccuugugcgccugcaauccgggguggauguuuucuucacacccccugagaagugcgacacccuccugugugauauuggagaaucuagccccaauccuacgaucgaggccggccggacccugagaguccucaaccuuguggaaaauuggcugaacaauaacacacaguuuugcauuaaagugcugaauccguauaugcccuccgucaucgagaagauggaaacccuccagcgcaaguacgggggagcgcugguucggaacccucuuucuagaaauagcacacacgagauguacuggguguccaacgccaccggcaauauugugucuagcgucaacaugaucucccgcaugcugaucaaccgguucacgaugaaacacaagaaagcuaccuaugagcccgacguggaucucgggagcggaacaagaaauauuggcaucgaaucugagauuccuaaccuggacaucauuggcaagcgcaucgagaagauuaagcaggagcaugaaaccuccuggcacuacgaccaagaucaucccuauaagacaugggccuaccacgggagcuaugagaccaaacagacaggaucugcuuccagcaugguuaauggcgugguccggcugcucaccaagccgugggacgugguuccuauggugacgcagauggccaugacagauaccacccccuuugggcagcaaagagucuucaaagagaagguggacacacgcacgcaggaaccuaaagagggaaccaagaaacuuaugaaaaucacagcugaauggcuguggaaggagcugggcaaaaagaaaacccccagaauguguacacgggaggaauuuacccgcaaggugagaucuaacgccgcgcucggggccaucuucacagaugagaauaaauggaaguccgcucgggaagccgucgaggacggaagauuuugggaacugguugaucgggagcgcaaccuucaccuggagggcaagugcgaaaccuguguguacaauaugaugggcaaaagagagaagaaacucggggaguucggaaaggcuaaaggcagccgggccauuugguauauguggcugggggcccgcuuucuggaguucgaagcgcucggauuucugaacgaggaccauugguucuccagaggcaauagccuuucugggguggagggcgaaggacugcaccggcucggcuacauccugcgcgaggucgggaagaaggaaggaggcgcuauguacgccgaugacacggccgggugggauaccagaauuacacuugaggaccugaaaaacgaagagauggugaccaaucauaugaagggagagcacaaaaagcucgcugaagccaucuuuaaacugacauaucagaacaagguugugcggguccagcgcccuacccccagaggcacggugauggacauuaucagccggcgcgaucaaagaggguccggccagguuggaacauacggccugaauaccuucacaaacauggaggcucagcucauccggcaaauggaaggggagggaauuuucaagucuauccagcaucugaccgccacggaggaaauugcggugcagaauuggcuugcccgcgucggcagagagcggcugagcagaauggcuaucuccggggacgauugcgugguuaaaccgauugacgaucgcuuugccucugcucucaccgcccugaacgacaugggaaaggugcggaaagauauccagcaaugggaaccuagcagaggcuggaacgacuggacacagguccccuucugcucccaccacuuucaugagcuugugaugaaggaugggcgcguccuggugguucccugucggaaucaggacgaacucaucggcagagcgcgcauuucucagggagccggcuggagccugaaagagaccgcuugccuggggaaguccuaugcccaaauguggacacucauguacuuccaccggagagaucugcgccuugcugccaacgcuaucuguagcgccgugccuucucauugggucccgaccucccggacaaccuggagcauucacgcgaagcacgaguggaugacgacagaagacaugcuggccguguggaauagaguguggauccaggagaaccccuggauggaagauaaaaccccuguugagucuugggaagaggugcccuaucucggaaagcgcgaggaccaguggugcggcucccugauugggcuuaccagccgggcuacaugggccaaaaauauccagaccgccauuaaccaagucagaucccugaucggaaaugaagaguacacagacuauaugccuucuaugaagcgguuuagacgcgaagaggaagaggcuggcgugcucugguga

SEQ ID NO: 20333 - RNA, 9876 nt, Artificial Sequence
  derived and/or modified CDS sequence (opt5) from DENV-2__AY702034__SS-prME
acagccggagugaucgucaugcugauucccacagcuauggccuuccaccucacgacccggaacggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugacuucugugagggcacaaccgugguggucacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccugguuaauucccucgugaccgccggccaugggcagauugauaacuuuucucugggagugcugggcauggcucuuuuccucgaagagaugcugagaacgcgcgucgggaccaaacacgcgauccugcucguggccguuagcuuugugacacugaucaccggaaauauguccuuccgggaccuuggcagagucauggugaugguuggcgcuacaaugaccgaugacauugggaugggagugacguaucuggcccuccuggccgcuuuuaagguccgcccuacauucgccgcgggccugcuucugagaaaacucaccucuaaggagcugaugauggcuacaaucgggauugcccuccugagccaguccaccaugcccgaaaccauccuugagcugacagaugcccucgcucugggaaugauggugcugaaaauuguucggaacauggaaaaguaccaacuugccgugacgaucauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccauuuuucugaccacgcugagccgcacaucuaaaaagagauccuggccgcuuaacgaggcgaucauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauucugaucagaaccgggcuccuggucaucuccggaguguuccccguuucuauuccgaucacagcggccgcuugguaccucugggaggugaagaagcagcgggccggcguccugugggaugugccuucucccccucccgucgggaaagccgaacuugaggacggagcuuaucgcauuaagcagagaggcauccugggcuacucccaaauuggggccggaguguauaaagaaggcaccuuucacacaauguggcauguuaccagaggggcggugcugaugcaccgcggaaagagaaucgagcccuccugggcugaugucaaaaaggaccucaucagcuacggcgggggauggaagcuggagggcgaauggaaagagggcgaagaggugcagguucuugcccuggaaccugggaagaauccgcgggccgugcagacgaaacccggaauuuucaagaccaacacaggcaccaucggggcugucucccucgauuuuagcccuggaacaucuggcucccccauuguggacagaaaagggaaggugguuggacuguacggcaauggcgucgugacccgcagcggggccuaugugucugcgaucgcucagacagagaaguccauugaggauaacccugaaaucgaggacgauaucuuccggaaaaagagacucacgauuauggaccugcaucccggagccggcaaaaccaagcgcuaccuuccugccaucguccgggaagcuauuaacagagggcugcgcacacugauccucgccccgacccgggugguugcugccgagauggaagaggcgcugagaggacuucccauucgcuaucaaaccccugccauccgggcugagcacacaggcagagaaauuguggaccugaugugucaugccacguucaccaugcggcuccugagccccguccgcgugccuaauuacaaccucaucaucauggaugaggcucacuuuacagaccccgccuccauugccgcuagaggguauaucucuacccggguugaaaugggcgaggcggccggaauuuucaugacagcuaccccgccuggcagccgcgaucccuuuccccaguccaaugccccuaucauggacgaggaaagagagauucccgaacggagcuggaacucugggcacgagugggugacggauuucaaaggaaagacagucugguuugugccuuccaucaaggccggcaaugacaucgcugccugccugcgcaagaaugggaagaaaguuauucagcuuagccgcaagaccuucgauucugaauacgugaaaacccgggcgaaugacugggauuuugucgugacaaccgacaucagcgagaugggagcuaacuucaaggccgagagagugauugauccgcgccgguguaugaagcccgucauccugacagacggcgaagagagaguuauucuggccgggccuaugcccgugacccauuccucugcugcccaacgccggggcagaaucggacgcaauccuaaaaacgaaaaugaccaguauaucuacaugggcgagccccucgaaaacgaugaggacugcgcgcacuggaaggaggccaaaaugcugcuugauaauauuaacacgccggaagggaucauuccuagcauguuugagcccgaaagagagaagguggacgcuaucgauggagaauaccggcugcgcggcgaggccagaaaaacauucgucgaccucaugcggcgcggggaucugccuguguggcuggcuuauaagguugccgcugagggaauuaauuacgccgacagaaaaugguguuuugauggcaucaagaacaaccagauucucgaagagaauguggaagucgagaucuggaccaaggagggggaacggaagaaacuuaaacccagauggcuggacgcgcgcaucuauuccgauccucuggcccucaaagaguucaaagaguucgcugccggccggaagucucugacacuuaaccugauuaccgagaugggaagacuccccacguuuaugacccagaaggcucgcaaugcccuggacaaccuggccgugcuccauacagcugaagcgggcgggcgggccuacaaucacgcucuuagcgagcugccggagacccuggaaacacuccugcuucugacccuccuggccacaguuaccggaggcaucuuccuguuucucauguccgggaaaggaauuggcaagaugacgcuuggcaugugcugcaucauuacagccagcucucugcugugguaugcucaaauccagccucacuggaucgccgcguccauuauccucgaguucuuucugauugugcuucugauccccgaacccgagaaacagagaaccccucaggauaaccaacucaccuacgucgugauugccauccugacagucguggcugccaccauggcuaaugaaaugggguuccuggagaagaccaagaaggaccucggacuuggcagcaucacgacccaggaguccgaaucuaacauucuggacaucgaucugcggccggccagcgcguggacacucuaugccguugcuaccacauuugugacccccaugcugcgccauuccauugaaaauucuagcgugaacgucucccuuacggccaucgcuaaucaggccaccguucugauggggcucggaaagggcuggccucugagcaaaauggacauuggggugccccugcucgcuaucggauguuacucucaggugaacccuauuacacuuaccgccgcgcugcugcuccuggucgcccacuacgcuaucaucggccccggccuucaagccaaggcuacaagagaagcccagaaacgggccgcggcugggauuaugaagaauccuaccguggauggaaucacgguuauugaccuggagccgauccccuaugauccuaaauucgaaaagcagcucggccaggugaugcugcugauucucugcgucacacaagugcuuaugaugcgcaccacaugggcccugugugaggcucugacccucgccaccgggcccaucuccacacugugggagggaaacccuggcagauuuuggaauacgaccaucgccgucagcauggcuaacauuuuccgggggucuuaccuugccggagcgggccugcucuuuuccaucaugaagaauacaaccaacacacgcagaggcaccgggaacauuggagaaacgcugggcgagaaauggaaaagccggcugaaugcccucgggaaaucugaguuccagaucuauaagaaaagcggcauucaggagguggaccgcacacuugcuaaggagggcaucaaaagaggggaaaccgaucaucacgccguuucccggggaucugcuaagcugagaugguuuguggagcgcaacauggucacccccgaaggcaaggugguugaccugggcugcgggcggggaggcuggagcuacuauugugggggacucaaaaaugugagagaggucaagggccugacaaaagggggaccgggccaugaagaaccuauccccauguccaccuacggcuggaaccuugugcgccugcaaagcgggguggauguuuucuucacacccccugagaagugcgacacgcuccugugugauauuggagaauccucucccaauccuaccaucgaggccggccggacacugagaguccucaaccuuguggaaaauuggcugaacaauaacacccaguuuugcauuaaagugcugaauccguauaugcccagcgucaucgagaagauggaaacacuccagcgcaaguacgggggagcgcugguucggaacccucuuuccagaaauucuacccacgagauguacugggugagcaacgccacgggcaauauuguguccucugucaacaugaucagccgcaugcugaucaaccgguucaccaugaaacacaagaaagcuacauaugagcccgacguggaucucggguccggaaccagaaauauuggcaucgaaagcgagauuccuaaccuggacaucauuggcaagcgcaucgagaagauuaagcaggagcaugaaacaucuuggcacuacgaccaagaucaucccuauaagaccugggccuaccacggguccuaugagacaaaacagaccggaagcgcuucuuccaugguuaauggcgugguccggcugcucacgaagccgugggacgugguuccuauggugacacagauggccaugaccgauaccacacccuuugggcagcaaagagucuucaaagagaagguggacacgcgcacccaggaaccuaaagagggaacaaagaaacuuaugaaaaucaccgcugaauggcuguggaaggagcugggcaaaaagaaaacacccagaauguguacccgggaggaauuuacacgcaaggugagaagcaacgccgcgcucggggccaucuucaccgaugagaauaaauggaagucugcucgggaagccgucgaggacggaagauuuugggaacugguugaucgggagcgcaaccuucaccuggagggcaagugcgaaacguguguguacaauaugaugggcaaaagagagaagaaacucggggaguucggaaaggcuaaaggcucccgggccauuugguauauguggcugggggcccgcuuucuggaguucgaagcgcucggauuucugaacgaggaccauugguucagcagaggcaauucccuuagcgggguggagggcgaaggacugcaccggcucggcuacauccugcgcgaggucgggaagaaggaaggaggcgcuauguacgccgaugacaccgccgggugggauacaagaauuacccuugaggaccugaaaaacgaagagauggugacaaaucauaugaagggagagcacaaaaagcucgcugaagccaucuuuaaacugaccuaucagaacaagguugugcggguccagcgcccuacgcccagaggcacagugauggacauuaucucucggcgcgaucaaagagggagcggccagguuggaaccuacggccugaauacauucaccaacauggaggcucagcucauccggcaaauggaaggggagggaauuuucaaguccauccagcaucugacggccaccgaggaaauugcggugcagaauuggcuugcccgcgucggcagagagcggcugucuagaauggcuaucagcggggacgauugcgugguuaaaccgauugacgaucgcuuugccuccgcucucacagcccugaacgacaugggaaaggugcggaaagauauccagcaaugggaaccuucuagaggcuggaacgacuggacccagguccccuucugcagccaccacuuucaugagcuugugaugaaggaugggcgcguccuggugguucccugucggaaucaggacgaacucaucggcagagcgcgcauuucccagggagccggcuggucucugaaagagacagcuugccugggaaagagcuaugcccaaauguggacccucauguacuuccaccggagagaucugcgccuugcugccaacgcuaucuguuccgccgugccuagccauugggucccgacaucucggaccacgugguccauucacgcgaagcacgaguggaugacaaccgaagacaugcuggccguguggaauagaguguggauccaggagaaccccuggauggaagauaaaaccccuguugagagcugggaagaggugcccuaucucggaaagcgcgaggaccaguggugcggcucucugauugggcuuacaucccgggcuaccugggccaaaaauauccagacagccauuaaccaagucagaagccugaucggaaaugaagaguacacggacuauaugccuuccaugaagcgguuuagacgcgaagaggaagaggcuggcgugcucugguga

SEQ ID NO: 20334 - RNA, 9876 nt, Artificial Sequence
  derived and/or modified CDS sequence (opt5) from DENV-2__AF208496__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccguuccuucgccaaaacgaacccgaggauauugacuguuggugcaauuuuacauccaccugggugacguauggcaccuguacaaccacaggggagcacagacgggaaaagcgcucugucgcucuggugccucauguuggaaugggccucgagaccagaacggaaacauggaugagcuccgagggcgccuggaaacacgugcagcggaucgagaccuggauccugcgccaucccggguucacaauuauggccgcuauccuggccuacaccauuggaaccacacacuuucagagagcucucaucuucauucugcuuacggccgucgcgccuucuaugaccaugcggugcaucggcauuagcaaccgcgauuuuguggaagggguuuccggaggcucuuggguggacaucguccuggagcacgggagcugugugacaaccauggccaagaauaagcccacacucgauuucgaacugaucaaaaccgaggcuaagcagccugccacgcuuagaaaauauugcauugaagcuaagcugacaaacaccaccacagagucccgguguccgacccaaggagagcccagccucaaugaagagcaggacaaacgcuuuaucugcaagcauucuaugguggauagaggcuggggcaacggguguggacuguucggcaaggggggaauugucacaugcgccauguuuacgugcaaaaagaauauggaaggcaaaguugugcagccugagaaccuggaauacaccaucgugauuacaccccacuccggggaggagcaugcggucggaaaugacaccggcaagcacggcaaagaaaucaagaucacaccucagagcucuauuaccgaggccgaacucacgggguauggaaccgugacaauggaguguuccccccggaccggccuggauuucaacgaaaugguucuucugcaaauggaggacaaagcuuggcucgugcaccgccagugguuucuggaucuuccgcugccuuggcuccccggggccgacacacagggaagcaauuggauccagaaggagacccuggucacguucaagaacccucaugcuaaaaagcaagacgugguugugcugggcucucaggaaggggccaugcacacagcccucaccggcgcuacagagauucagauguccagcggaaaucugcuuuucaccggccaucugaaaugcagacuccggauggauaagcugcaacuuaaagggauguccuacucuauguguaccggaaaguuuaagaucgucaaagaaauugcggagacacagcacggcacgaucgugaucagaguccaguaugagggggacggaagccccugcaagauucccuucgaaaucaccgaucuggagaaacgccaugugcucggccggcugauuacaguuaacccuaucgugaccgaaaaggacuccccggucaacauugaggccgaacccccuuuuggggauagcuacaucauuaucggcguggagcccggacagcugaaacucaauugguucaagaagggcucuuccaucgggcaaauguuugagacaaccaugagaggagcuaaacgcauggccauucugggcgacacggccugggauuucgggagccuuggaggcguuuuuacaucuaucgggaaggcucugcaccagguguucggcgccauuuacggagcggcuuuuagcggcgucuccuggaccaugaaaauccucauuggggugaucaucaccuggauuggaaugaacucucggagcacaucccugagcgugucucugguucuugucggcguggugacccucuaucugggggccaugguccaggccgacuccggaugugugguuagcuggaagaauaaagaacugaagugcggcucugggaucuucauuacagauaacgugcacacguggaccgagcaguacaaguuucaaccugaaucccccagcaaacucgcuuccgccauccagaaggcucaugaggaaggcauuuguggaaucagaucugucacacgccuggagaaucuuauguggaaacagaucaccccggagcugaaccacauucucagcgaaaaugaggugaagcugacaaucaugaccggcgacauuaaagggaucaugcaggccggaaagcggucccugagaccucaacccacggaacuuaaauauucuuggaagaccuggggcaaggcgaaaaugcucagcacagagucccauaaccagaccuuccugauugaugggccugaaacagccgagugccccaauaccaaccgcgcuuggaauagccuggagguugaagacuacggauuuggcguguucacaaccaacaucuggcucaagcugcgggagaaacaggacgucuucugugauucuaagcuuauguccgccgcuaucaaagacaauagagccgugcacgcggauaugggcuauuggauugaaagcgcccugaacgacacguggaagauggagaaggcuucuuuuaucgagguuaaauccugccacuggccuaagagccauacacucuggucuaauggggugcuggaaagcgagaugauuauccccaaaaacuucgccggaccggucucccagcacaacuaccgcccuggcuaucauacccaaaccgcugggcccuggcaccugggaaagcuugaaauggauuuugacuucugugagggcacaaccgugguggucacggaagauugcgggaaucggggacccagccucagaacaaccacagccucuggcaaacugauuaccgaguggugcugucgguccugcacacugccuccgcuccgcuacagaggcgaggacggguguugguacggaauggaaauccggccccugaaggagaaggaagagaaccuuguuaauagccuggugaccgccggccaugggcagauugauaacuuuucccucggagugcugggcauggcucuguuccuugaagagaugcucagaacgcgcgucgggaccaaacacgcgauccugcugguggccguuucuuuugugacacucaucaccggaaauaugagcuuccgggaccugggcagagucauggugaugguuggcgcuacaaugaccgaugacauugggaugggagugacguaucuugcccugcucgccgcuuuuaagguccgcccuacauucgccgcgggccugcugcuuagaaaacugaccuccaaggagcucaugauggcuacaaucgggauugcccugcucucucagagcaccaugcccgaaaccauccuggagcuuacagaugcccuggcucucggaaugauggugcugaaaauuguucggaacauggaaaaguaccaacuggccgugacgaucauggcgaucuccugcgucccuaaugcugugauucuucagaacgccuggaaggugucuuguaccauccuggccgcugucagcguuuccccccuccugcucacaagcucucagcagaaagccgacuggauuccucuggcucuuaccaucaagggccugaaucccacagccauuuuucucaccacgcugucccgcacaagcaaaaagagaucuuggccgcugaacgaggcgaucauggccguggggaugguguccauccuugcuagcucucugcucaaaaaugacauuccuaugaccggaccccuggucgccggcggccuccugaccgugugcuauguucuuacagggcgguccgcugaucuggaacuggagcgcgccgccgacgugaagugggaggaucaagcugaaaucagcggauccagcccuauucucucuaucaccauuagcgaggacggcuccaugucuaucaaaaacgaagaggaggaacagacacugacgauucuuaucagaaccgggcugcucgucaucagcggaguguuccccguuuccauuccgaucacagcggccgcuugguaccugugggaggugaagaagcagcgggccggcguccucugggaugugccuucucccccucccgucgggaaagccgaacuggaggacggagcuuaucgcauuaagcagagaggcauccuuggcuacagccaaauuggggccggaguguauaaagaaggcaccuuucacacaauguggcauguuacccggggggcggugcugaugcaccgcggaaagagaaucgagcccuccugggcugaugucaaaaaggaccugaucucuuacggcgggggauggaagcucgagggcgaauggaaagagggcgaagaggugcagguucuggcccuugaaccugggaagaauccgcgggccgugcagacgaaacccggaauuuucaagaccaacacaggcaccaucggggcugucagccuggauuucuccccuggaacaagcggcucucccauuguggacagaaaagggaaggugguuggacucuacggcaauggcgucgugacccgcuccggggccuaugugagcgcgaucgcucagacagagaagucuauugaggauaacccugaaaucgaggacgauaucuuucggaaaaagagacugacgauuauggaccuccaucccggagccggcaaaaccaagcgcuaccugccugccaucguccgggaagcuauuaaaagagggcuucgcacacugauccuggccccgacccgggugguugcugccgagauggaagaggcgcucagaggacugcccauucgcuaucaaaccccugccauccgggcugagcacacaggcagagaaauuguggaccuuaugugucaugccacguucaccaugcggcugcucucccccguccgcgugccuaacuacaaucugaucaucauggaugaggcucacuuuacagaccccgccagcauugccgcuagaggguauaucuccacccggguugaaaugggcgaggcggccggaauuuucaugacagcuaccccgccuggcucucgcgaucccuuuccccagagcaacgccccuaucauggacgaggaaagagagauucccgaacgguccuggaauagcgggcacgagugggugacggauuucaagggaaagacagucugguuugugccuucuaucaaagccggcaacgacaucgcugccugccucagaaagaaugggaaaaagguuauucagcugucccgcaaaaccuucgauagcgaauacgugaagacccgggcgaacgacugggauuuugucgugacaaccgacaucucugagaugggagcuaauuucaaggccgagagagugauugauccgcgccgguguaugaaacccgucauccuuacagacggcgaagagagaguuauucuggccgggccuaugcccgugacccauagcuccgcugcccaacgccggggcagaaucggacgcaacccuaagaaugaaaacgaccaguauaucuacaugggcgagccccuggaaaaugaugaggacugcgcgcacuggaaagaggccaagaugcuccuggauaacauuaauacgccggaagggaucauuccuucuauguuugagcccgaaagagagaaaguggacgcuaucgauggagaauaccggcuucgcggcgaggccagaaagacauucgucgaccugaugcggcgcggggaucucccuguguggcuggcuuauaaaguugccgcugagggaauuaacuacgccgacagaaagugguguuucgauggcaucaagaauaaccagauucuggaagagaacguggaagucgagaucuggaccaaagagggggaacggaagaaacucaagcccagauggcuugacgcgcgcaucuauagcgauccucuggcccugaaagaguuuaaggaauucgcugccggccggaagucccucacacugaaucuuauuaccgagaugggaagacugcccacguuuaugacccagaaagcucgcaacgcccucgacaaucuggccgugcugcauacagcugaagcgggcgggcgggccuacaaccacgcucucucugagcuuccggagacccuggaaacacugcuccugcuuacccugcucgccacaguuaccggaggcaucuuccuguuucugaugagcgggaagggaauuggcaaaaugacgcucggcaugugcugcaucauuacagccuccagccuucugugguaugcucaaauccagccucacuggaucgccgcgucuauuauccuggaguucuuucucauugugcugcuuauccccgaacccgagaagcagagaaccccucaggauaaucaacugaccuacgucgugauugccauccucacagucguggcugccaccauggcuaacgaaaugggguuccuggagaaaacaaagaaggaccugggacucggcuccaucgccacgcaggagagcgaauccaauauucuugacaucgaucugcggccggcgucugccuggacccuguaugcuguugccacaaccuuugugacacccaugcuccgccauagcauugagaacuccucugugaaugucagccugaccgcuaucgccaaccaggcuacgguucuuauggggcugggaaaaggcuggccucucuccaagauggacauuggggugccccugcuggccaucggauguuacagccaggugaauccuauuacccucacagcggcccuucugcugcucgucgcucacuacgccaucaucggccccggccugcaagcuaaagccaccagagaagcccagaagcgggcggcugccgggauuaugaaaaacccuacaguggauggaaucaccguuauugaccuugagccgauccccuaugauccuaaguucgaaaagcagcugggccaggugaugcuccugauucugugcgucacgcaagugcucaugaugcgcacaaccugggcucuuugugaggcccugacacuggccaccgggcccaucucuacccucugggagggaaauccuggcagauuuuggaacacaacgaucgcugucuccauggccaauauuuuccgggggagcuaccuggcgggagccggccuucuguuuucuaucaugaaaaacaccacaaauacccgcagaggcacagggaacauuggagaaacccucggcgagaaguggaaaucccggcugaacgcucuggggaagagcgaauuccagaucuauaaaaagucuggaauucaggagguggaccgcacgcucgccaaagagggcaucaagagaggggaaacagaucaucacgcuguuagccggggauccgccaagcuuagaugguucguggagcgcaauauggucacccccgaaggcaaagugguugaccugggcugcgggcggggaggcuggucuuacuauugugggggacugaagaacgugagagaggucaaaggccucaccaaggggggaccgggccaugaagagccuauccccaugagcacauacggcuggaaucuggugcgccuucaauccgggguggauguuuuuuucacccccccugagaaaugcgacacacugcucugugauauuggagaaagcucccccaacccuacgaucgaggcgggccggacccugagaguccugaaucucguggaaaacuggcuuaauaacaauacacaguuuugcauuaaggugcugaacccguauaugcccucugucaucgagaagauggaaacccugcagcgcaaauacgggggagcccucguucggaauccucugagcagaaacuccacacacgagauguacugggugucuaaugcuaccggcaacauugugagcuccgucaauaugaucucucgcaugcuuaucaaccgguucacgaugaagcacaaaaaggccaccuaugagcccgacguggaucuggggagcggaacaagaaacauuggcaucgaauccgagauuccuaaucucgacaucauuggcaaacgcaucgaaaagauuaagcaggagcaugaaaccagcuggcacuacgaccaagaucaucccuauaaaacaugggcuuaccacgggucuuaugagaccaagcagacaggauccgccagcucuaugguuaacggcgugguccggcugcugaccaaaccgugggacgugguuccuauggugacgcagauggcuaugacagauaccacccccuuugggcagcaaagagucuucaaggagaaaguggacacacgcacgcaggaaccuaaggagggaaccaagaaacucaugaagaucacagccgaauggcuuuggaaagagcugggcaagaaaaagacccccagaauguguacacgggaggaauuuacccgcaaagugagauccaaugcggcccugggggcuaucuucacagaugagaacaaguggaagagcgcccgggaagcugucgaggacggaagauuuugggaacucguugaucgggagcgcaaucugcaccuugagggcaaaugcgaaaccuguguguacaacaugaugggcaagagagagaaaaagcugggggaauucggaaaagccaagggcucucgggccauuugguauauguggcucggggcgcgcuuucuggaguucgaagcucugggauuucucaaugaggaccauugguucuccagaggcaacagccuguccgggguggagggcgaaggacuucaccggcugggcuacauccuccgcgaggucgggaagaaagaaggaggcgccauguacgccgaugacacggcugggugggauaccagaauuacacuggaggaccuuaagaaugaagagauggugaccaaccauaugaaaggagagcacaagaaacuggccgaagcuaucuucaagcucacauaucagaauaagguugugcggguccagcgcccuacccccagaggcacggugauggacauuaucagccggcgcgaucaaagagggucuggccagguuggaacauacggccugaacaccuuuacaaauauggaggcccagcugauccggcaaauggaaggggagggaauuuucaaaagcauccagcaucucaccgcgacggaggaaauugccgugcagaacuggcuggcucgcgucggcagagagcggcuuuccagaauggccaucucuggggacgauugcgugguuaagccgauugacgaucgcuuugcuagcgcccugaccgcgcucaaugacaugggaaaagugcggaaggauauccagcaaugggaaccuuccagaggcuggaacgacuggacacagguccccuucugcucucaccacuuucaugagcuggugaugaaagaugggcgcguccuugugguucccugucggaaccaggacgaacugaucggcagagcccgcauuagccagggagcuggcuggucccucaaggagaccgccugccuggggaagucuuaugcucaaauguggacacugauguacuuccacaaacgggaucucagacuggccgcuaaugccaucuguagcgcggugccuucccauugggucccgaccagccgcacaaccuggucuauucacgccaagcacgaguggaugacgacagaagacaugcuugcuguguggaaccggguguggauccaggagaaucccuggauggaagauaaaaccccuguugaguccugggaagaggugcccuaucugggaaagagagaggaccaguggugcggcagccucauugggcugaccucucgcgccacaugggccaaaaacauccagaccgcuauuaaucaaguccggucccuuaucggaaacgaagaguacacagacuauaugccuagcaugaagagauuucggagagaagaggaagaggccggcgugcugugguga

SEQ ID NO: 20335 - RNA, 9876 nt, Artificial Sequence
  derived and/or modified CDS sequence (opt5) from DENV-2__AY702040__SS-prME
acagccggaaugaucauuaugcugauccccacagugauggcuuuccaccucacgaccagaaacggggagccucauaugauugucagccggcaggaaaagggaaagagccugcuuuuuaagacaaaggacggaaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagagaagcgguccguggcgcuggugccucauguugggaugggacucgaaacgcgcacagagaccuggaugucuagcgaaggcgcuuggaagcacgcccagagaaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaauggaggauaaggccuggcucguucaccggcagugguuccuggaccuuccgcugccuuggcuccccggcgcugacacgcaggggucuaauuggauucagaaagaaacacuggugaccuuuaagaacccucaugccaaaaagcaagaugucgugguucugggaucccaggagggcgcuaugcacacagcccucaccggggccaccgagauccagaugagcuccggcaaucugcuuuucacaggacaucugaaaugccgccucagaauggacaagcugcaacuuaagggcaugucuuacagcauguguacggggaaauucaagauugugaaagaaaucgcugagacccagcacggaacaauugucauccgggugcaguaugaaggcgaugggucccccugcaagauccccuuugagauuauggaccuggagaaaagacauguccucggacgccugaucaccgugaacccuauuguuacagaaaaggauagcccggugaacaucgaggcggaacccccuuucggcgacucuuacauuaucauuggggucgagcccggccagcugaagcucgauugguuuaaaaagggauccagcaucggccaaauguucgaaaccacgaugagaggggccaaaagaauggcuauccugggagacacagccugggauuuuggcucucuugggggaguguucaccagcauuggcaaggcccugcaccagguuuuuggggcuaucuacggcgccgcguucuccggagugucuuggaccaugaaaauucucaucggcgucauuaucacauggaucgggaugaauagccgcuccaccagccugucugugucccuggugcuuguuggaauugucacacucuaucugggcgugauggugcaggcugacagcgggugugucgugucuuggaagaacaaggagcugaaaugcggauccggcaucuuuguuacggauaaugugcacaccuggacagagcaguacaaguuccaaccugaaagccccuccaaacucgccucugccauucagaaggcucaugaggaagggaucuguggcauucggagcgucaccagacuggagaaccuuauguggaaacagaucacauccgaacugaaucacauccucucugagaacgaggugaagcugaccauuaugacgggagacaucaaaggcauuaugcagguugggaagcgcagccugcggccgcaaccuaccgaacuuagauauuccuggaagacauggggaaaagccaagaugcucagcaccgagcugcauaaucagacauuucugaucgacggccccgaaaccgcugagugcccuaacacaaaucgcgccuggaacucucucgaaguggaggauuacggguucggagucuuuaccacgaauauuuggcugcggcuuagagagaaacaggacgcguucugugaucccaagcugauguccgccgcuaucaaagacaaccgcgccgugcacgcugauaugggcuauuggaucgaaagcgcccucaaugacacauggaagauugagaaggcgucuuucaucgaaguuaaauccugccacuggccuaagagccauacccuguggucuaacggcgugcuggagagcgagauggucauucccaaaaauuuugccgggccggugucccagcacaacaaccggccuggauaccauacccaaacagcuggccccuggcaccuugggaagcucgaaauggauuucgacuuuugugagggaaccacgguggucguuacagaagagugcggcaauagagggcccagccugcggaccacaaccgccucuggaaaacugaucacagaauggugcugucgcuccugcacccucccuccgcugagauaucggggcgaggauggcuguugguacgggauggagauuagaccccuuaaggaaaaggaggaaaaccuggugagcucccucgugacggcuggacauggccagaucgacaauuucucucuggggauucugggaauggcccuuuuucucgaggaaaugcugcgcacccgggucggcacaaaacacgccauccugcucguggcuguuagcuucgugacccugaucacagggaacauguccuuuagagaucuuggacgcgucauggugaugguuggcgcgaccaugacggacgauauuggcaugggggugacauaccuggcccuccuggcugccuucaaggucagaccuaccuuugccgcuggacugcuucugcggaaacucacaucuaaggagcugaugaugaccaccaucggcauugugcuccugagccaguccucuauccccgagacaauucuugaacugacggacgcccucgcgcuggggaugaugguucugaaaauggugcgcaauauggagaaguaucaacuugcugucaccaucauggccauccugugcgugccuaacgccgugauucuccagaaugcuuggaaggucagcuguacaauccuggccguuguguccgugagcccccuccugcuuaccucuucccagcagaaagcggacuggauuccucuggcucucacaaucaagggacugaaccccaccgccauuuuccugacgacacuuagcagaaccucuaaaaagcgguccuggccgcugaaugaagccaucauggcugucggcauggugagcauccucgccucuucccugcucaaaaacgauauuccuaugaccgggccccugguugcuggaggccuucugacagugugcuacguccugaccggccgcagcgccgaccucgagcuggaaagagcgacagaugugaagugggacgaucaagccgagaucuccgggagcucuccuauucuuagcaucauuaucuccgaggacggaucuaugagcauuaaaaaugaagaggaggaacagacgcugaccauccucauccggacaggccugcucguuauuuccgggcuguuucccgugucuaucccgauuaccgcugccgcuugguaucuuugggaggucaagaagcagcgcgccggagugcugugggaugucccuucucccccucccgugggcagagccgaacuggaggacggggcuuaccggaucaaacagaagggcauucucggcuauucccaaaucggcgcggggguuuacaaagaaggaacauuccacaccauguggcaugugacgcgcggcgccguccugaugcacaaggggaaaagaaucgagcccuccugggcugaugugaagaaggaccuuauuagcuauggaggcggguggaaacuggaaggagaguggaaggagggcgaagagguucaggugcucgcccuggaaccuggcaaaaacccgcgggccguccagaccaagcccgggcucuuuagaacaaauaccggaacaaucggcgcugugucccuggauuucagcccugggaccucuggaucccccauuguggacaaaaagggcaagguugucgggcuuuacggaaacggcguggugacacgcggcggggccuacgucagcgcgaucgcucagacggagaaaucuauugaagauaauccugagaucgaggacgacaucuuccggaagagacgccugaccauuauggaucugcaucccggagccggcaaaacaaagcgguaucucccugccaucgugagagaagcuauuaaacgcgggcugcggacccuuauccuggccccgaccagaguuguggcggcugagauggaagaggcccuccgcggacugcccauucgguaccaaaccccugccaucagagcugaacacacgggccgggagauugucgaccucaugugucaugccaccuuuacaaugcgccugcuuucccccaucagagugccuaacuauaaccugaucauuauggaugaggcucacuucaccgaccccgccagcaucgcggcccggggguacauuuccacacgcguugaaaugggcgaggcugccggaaucuuuaugaccgcuacgccgccuggcucuagagaucccuucccccagagcaaugccccuauuauggacgaggaacgggagauccccgaaagauccuggaacagcgggcacgagugggugacagauuuuaagggaaagaccgucugguucgugccuucuaucaaaaccggcaaugacauugccgcuugccugcgcaagaacgggaaacggguuauccagcucuccagaaagacauuugauagcgaauaugugaaaacccgcacaaaugacugggauuucgucgugaccacggacauuucugagaugggagcgaacuuuaaggccgaacgggugaucgacccgagacgcuguaugaagcccgucauucugacagauggcgaggagcggguuauccuugcugggccuaugcccgugacccauagcuccgccgcccaaagacgcggcagaaucggacggaauccucgcaacgaaaaugaccaguacauuuauaugggcgagccccuggaaaacgaugaggacugcgcucacuggaaagaagccaagaugcuccuggauaauaucaacacaccggaggggauuaucccuucuauguucgagcccgaaagagagaaaguggacgcgauugauggagaauaccggcugcgcggcgaggcuagaaagaccuuugucgaccucaugcggagaggggaucuuccuguguggcuggccuacaaaguugccgcugaaggaaucaauuaugccgaccgccggugguguuucgauggcacgagaaacaaucagauucuggaggagaacguggaagucgagaucuggaccaaggaaggggagcgcaaaaagcucaagccccgguggcuggacgcgagaaucuacagcgauccucuugcccugaaagaguucaaggaauuugcugccggccggaaaucccucacacugaaccugauuaccgagaugggacgccuccccacauucaugacccagaaggcuagagacgcccuugacaaucuggcugugcugcauacagccgaagcgggcgggaaagccuauaaccacgcucucucugagcugccggaaacccuugagacgcugcuccugcugacacuccuugccaccguuaccggaggcaucuuucuguuccugaugagcgggcggggaauuggcaagaugacacucggcaugugcugcaucauuaccgcuuccauccugcuuugguacgcccaaauccagccucacuggauugccgcuagcaucauucuggaguuuuuccucaucgugcugcugauucccgaacccgagaagcagcgcacaccucaggauaaucaacucacguaugucaucaucgcgauucuuaccguggucgccgcuacaauggccaacgaaaugggguuucuggagaaaaccaagaaagacuucggacugggccauaucgccacacagcagccggaaucuaauauucucgauaucgaccugagacccgcuuccgccuggacccuuuacgcgguggccacgaccuuuauuacaccuaugcugcggcacagcaucgagaacuccucuguuaaugugagccucaccgcuauugccaaccaggcuacagugcugauggggcugggaaagggcuggccccucuccaaaauggauaucggggucccucuucuggccaucggauguuauucucaaguuaaucccauuacccugacggcggcccuccugcuucugguggcucauuacgccaucauuggcccuggccuccaggcuaaggccacacgcgaggcucagaagagagccgcggccgggaucaugaaaaacccgaccguggacggaauuacagucaucgaucuggaccccaucccuuacgaucccaaguucgaaaaacagcugggccaagugaugcuccuuguucugugcgugacccagguccugaugaugcggaccacaugggcucucugugaggcccugacgcuugcuaccgggccugugagcacacugugggaaggaaaucccggccgcuuuuggaacaccacaauugccgucuccauggccaauaucuucagagggagcuaucucgcgggagcuggccugcuguuuucuauuaugaagaacaccacguccgcccggagaggcacagggaauaugggagagacccucggcgaaaaauggaaaagccgccuuaacgcucuggggaagucugaguuccagaucuacaaaaaguccggcauucaagagguggaccggacccuggccaaagaaggcaucaagagaggggagacagaucaccaugccguuagccgcggaucugcuaaacuccggugguucguggaaagaaaucuggucaccccggagggcaaggugguugaccuuggcugcgggcgcggaggcuggagcuauuacugugggggacugaaaaacgugcgggaggucaagggccucacaaaagggggaccuggccacgaggaacccauccccauguccacguauggcuggaaccuggugagacugcagucugggguggaugucuuuuucgucccucccgaaaaaugcgacacccuccuuugugacauuggagagagcuccccuaauccgacaguggaagccggccgcacccugcgggugcugaaccucgucgagaauuggcugaacaauaacacacaguuuugcguuaaggugcuuaaucccuacaugccuagcgugaucgagagaauggaaacccugcagcgcaaauaugggggagcgcucguccggaacccccuguccagaaauucuacgcacgagauguacugggugagcaacgccuccggcaauauuguuucuagcgugaacaugaucucccgcaugcugauuaauagauucaccaugcggcauaagaaagcuacauacgaaccugaugucgaccucgggucuggaacccgcaacaucggcaucgagagcgaaacacccaaucuugauauuaucggcaagagaauugagaagaucaaacaagagcacgaaaccuccuggcauuaugaccaggaucacccguacaagacaugggccuaucacgggagcuacgagaccaaacagacgggaucugcuuccagcauggugaacggcguugugcggcugcugacaaagccuugggacgucauucccauggugacccagauggccaugaccgauacaacgccuuuugggcaacagagaguguucaaagaaaaggucgacacccggacacaggagcccaaggaaggaaccaaaaagcucaugaaaaucacagcggaguggcuguggaaggagcuuggcaaaaagaagaccccucgcauguguacaagagaagaguuuaccaaaaagguucggucuaacgccgcucugggggccauuuucacggaugaaaauaaauggaaguccgcucgcgaggccguggaggacaacagauuuugggaacucguggauaaagagcggaaucugcaucuggaaggaaagugcgagaccugugucuauaacaugaugggcaaacgcgaaaagaagcucggcgaguucgggaaagcuaagggaagcagagccaucugguacauguggcugggcgcgcgguuucuugaguucgaagcccugggguuucucaaugaggaccacugguucucucgcgaaaacucccugagcggaguggagggcgaagggcuucauaaacugggcuauauccucagagagguuuccaagaaagagggaggcgcuauguacgccgacgauacagcugggugggacacccggauuacaaucgaagaucugaagaaugaggaaaugauuaccaaccacauggccggagagcauaagaaacuggccgaagcgaucuucaagcucacguaccagaauaaagugguccgcgugcaaagacccacaccgcggggcaccguuauggacauuaucagccgcaaggaucagagagggucuggacaggugggcacauaugggcugaacaccuuuacgaauauggaggcucaacuuauccggcagauggagggcgaaggaauuuucaaaagcauccagcaccugaccgccuccgaggaaauugccguccaggacuggcucgugagaguuggccgcgagcggcugucuagaauggcuaucagcggggaugacugcguggucaagccucuugaugaccgcuuugccaaggcucugacagcccucaacgauaugggaaaagugcggaaggacauucaacagugggagcccuccagaggcuggaaugauuggacccagguccccuucugcucucaccauuuucacgaacugaucaugaaagacgggcgcacacuggugguuccuugucggaaccaggacgagcucaucggacgggcgcgcauuagccaaggcgccggguggucccugcgggaaaccgcuugccuuggcaagucuuacgcccagauguggagccugauguauuuccauagacgcgaucuccggcuggcugccaaugcgaucuguuccgccgugccgagccacuggguccccacaucuagaaccacgugguccauucacgcuagccaugaguggaugacaaccgaagacaugcuuaccguguggaaccggguguggauccuggagaacccuuggauggaggauaaaacacccguugaaucuugggaggaaauuccuuaccucggaaagagagaggaccaguggugcggcucccugaucgggcugaccagccgcgccacaugggcuaagaauauucagacggccaucaaccaagugcggucccucaucggaaaugaagaguauaccgauuacaugcccucuaugaaaagauuucgcagagaggaagaggaagcuggcguccugugguga

SEQ ID NO: 20336 - RNA, 9876 nt, Artificial Sequence
  derived and/or modified CDS sequence (opt5) from DENV-2__AY037116__SS-prME
accgccggcaucauuaucaugaugauucccacagugauggcuuuccaccugacgacccggaauggggagccucauaugaucgugagccggcaggaaaagggaaagucccuccuguuuaagacagagaauggcguuaacaugugcacccuuauggccauggaccugggggaacucugugaggauacaauuaccuacaauugcccgcugcuucgccaaaacgaacccgaggacaucgauuguggaugccacucuacaagcaccugggugacguauggcaccuguacagcgaccggggagcaucggcgggaaaagcgcuccguggcucuggucccucacgugggaaugggccucgagacaagaaccgaaacguggaugucuagcgagggcgccuggaagcaugcccagcggaucgagacauggguucugcgccaccccggguucaccauuauggcugccauccuggcuuacacaauuggaaccaccuauuuucagagagugcucaucuucauucugcuuacagccgucacgccuuccaugaccaugcggugcaucggcauuucuaaucgcgacuuuguggaagggguuagcggaggcuccuggguggauaucguccuggagcacgggagcugugugacaaccauggcgaagaacaagcccacacucgacuucgaacuggugaagaccgaggccaaacauccugcuacgcuuagaaaguacugcaucgaagccaaacugacaaauaccaccacagcuucucgguguccgacccagggagagcccucccucaacgaggaacaagauaagcgcuuugucugcaaacacagcaugguugacagaggcuggggcaauggguguggacuguucggcaaagggggaauugugacaugcgccauguuuacgugcaagaaaaacauggagggcaaggugguccagccugaaaaucuggaguauaccaucgugauuacaccccauucuggggaagagaacgcgguuggaaaugauaccggcaaacacggcaaggagaucaaagugacaccucaguccagcauuaccgaagccgagcucacgggguacggaaccgucacaauggaauguucuccccggaccggccuggacuucaacgagauggugcuucugcagauggaaaauaaggcuuggcucguucaccgccaaugguuucuggaucuuccgcugccuuggcuccccggggccgacacacagggauccaacuggauccagaaagagacccuggugacguucaagaacccucaugcuaagaaacaggaugucgugguccugggcagccaagagggggccaugcacacagcccucaccggcgcuacagaaauccagauguccucuggaaaucugcuuuuuaccggccaucugaagugcagacuccggauggacaaacugcagcuuaaggggaugagcuauuccauguguaccggaaaauucaaggugguuaaggagauugcggaaacacaacacggcacgaucgugauuagaguccaguacgagggggacggaagccccugcaaaauccccuucgagauuauggaucuggaaaagcgccaugugcucggccggcugaucaccguuaacccuaucgugacagagaaagacucuccggucaauauugaagccgagcccccuuuuggggauuccuacaucauuaucggcguggaacccggacagcugaagcucagcugguucaaaaagggcucuagcauugggcagauguuugagaccacaaugagaggagcuaagcgcauggccauccugggcgacaccgccugggauuucgggucccuuggaggcguguuuacgucuauugggaaagcucugcaccaaguuuucggcgccaucuauggagcggcuuuuagcggcgucuccuggacaaugaagauccucauugggguggugaucaccuggauuggaaugaacagccggucuaccucccugagcgucucucuggugcuuguuggcguggucacacucuaccugggggugaugguucaggccgacuccggauguguggucagcuggaaaaauaaggagcugaaaugcggcuccgggaucuucauuaccgauaacgugcacacauggacggaacaguauaaguuucagccugagucucccagcaagcucgccuccgcuauccaaaaagcccaugaagagggcaucuguggaauuagaucuguuacccgccuggaaaaucuuauguggaagcagaucacaccggagcugaaccacauucucagcgagaaugaagugaaacugaccaucaugacaggcgacauuaaggggaucaugcaggcuggaaaacggucccugagaccucagcccaccgagcuuaaguacagcuggaaagccuggggcaaggcgaagaugcucucuacggaacugcauaaccacaccuuccugaucgaugggccugagacagccgaaugccccaauaccaaccgcgcuuggaauagccucgaggucgaggacuauggauuuggcguguucacaaccaacauuuggcugaaacuuaaggaacggcaagauguguuuugugacagcaaacugaugucugccgcuaucaaggacaauagagccguccacgcggauaugggcuacuggauugaguccgcccucaacgacacauggaaaaucgaaaaggcuagcuucauugagguuaagucuugccauuggccuaaaagccacacccugugguccaacggggugcuggagagcgaaaugaucauccccaagaauuucgccggaccggugucucagcauaacuaucgcccuggcuaccacacgcagacagcugggcccuggcaucuuggacggcucgagauggauuuugacuucugugaaggcaccaccgucgugguuacagaggauugcgggaauagaggacccucccugcggaccacgacagccagcggcaaacugauuaccgaauggugcugucgcuccugcacacucccuccgcugagauaccggggcgaggacggguguugguauggaauggagaucagaccccuuaaggaaaaagaggaaaaccuggucaauucucucgucaccgccggccacgggcagauugauaacuuuagccugggagugcugggcauggcucuuuuccucgaggaaaugcugcgcacacggguugggaccaagcacgcgauccugcucguggccgucuccuuugugacgcugauuaccggaaauaugucuuucagagaccuuggccgcguuauggugauggucggcgcuacaaugaccgaugacaucgggaugggagugacauaccuggcccuccuggccgcuuuuaaggugagaccuaccuucgccgcgggccugcuucugcggaaacucacgagcaaggagcugaugaugacaaccauugggaucguccuccugucccaaucuacaauccccgagaccauucuugaacugaccgaugcuugggcccucggaaugaugguucugaaaaucgugcgcaacauggagaaguaucagcuggccgugacaauuauggcuauccuuugcgucccuaaugccgugauucugcagaacgcguggaaaguuagcuguacgacccucgcuguggucuccgugagcccccugcuccugacaucuucccaacagaaggccgacuggaucccucuugcccugaccaucaagggccucaaucccacagcuauuuuucugaccacgcugagcagaacaucuaaaaagcgguccuggccgcuuaacgaagccaucauggcuguugggauggugagcauucuggccucuucccuccugaaaaaugauaucccuaugaccggaccccucgucgcgggcggccugcuuaccgugugcuacguccugacagggcgcagcgccgaccuggagcucgaaagagcugccgacgugcggugggaggagcaggcugaaauuuccggaagcucuccuauccugagcaucaccauuuccgaggauggcucuaugagcaucaagaacgaagaggaggaacagacacuuacgauucugauccgcaccgggcuccugguuauuuccggacucuuccccgccucuaucccgauuacagccgcugcgugguaucugugggaggugaaaaagcaaagagccggcguccuuugggacgugccuucucccccucccguugggaaagcugaacuggaggauggagccuaccggaucaagcagaagggcauccugggcuauucccagauuggggccggaguguacaaagaaggcaccuuucauacaauguggcacgucacccgcggggcugugcucaugcauaagggaaaaagaaucgagcccuccugggccgacgugaagaaagaucugauuagcuacggcgggggauggaaacuugagggcgaauggaaggagggcgaagagguucagguccuggcgcucgaaccugggaaaaauccgcgggcugugcaaacgaagcccggacuguucaaaaccaacacaggcaccaucggggccgugucccucgacuuuagcccuggaacaucuggcucccccauugucgauaagaaagggaaggugguuggacuguauggcaacggcguggucaccagaagcggggccuacgugucugcuaucgcccagacagagaaguccaucgaggacaauccugaaauugaggaugacaucuuccgcaaaaagcggcuuacgauuauggaucugcaccccggagcgggcaaaaccaagagauaucugccugcuaucguucgcgaagccauuaaacgggggcucagaacacugauccuugccccgacccgcguggucgcugccgagauggaagaggcucugcggggacuccccaucagauaccagaccccugccauucgcgcggagcauacaggccgggaaaucguggaccugaugugucacgccacguucaccaugagacuccugagccccauucggguuccuaacuauaaucuuaucauuauggaugaggcucacuuuacagaccccgccuccaucgcugcccgcggguacauuucuaccagaguggaaaugggcgaggccgcuggaaucuucaugacagcgaccccgccuggcagccgggaccccuuuccccaguccaacgccccuaucauggaugaggaacgcgagauucccgaaagaagcuggaacucugggcaugagugggucacggacuucaagggaaagacagugugguuugugccuuccaucaaagcuggcaacgauauugccgccugccugcggaagaaugggaaaaaggucauccaacugagcagaaaaaccuucgacucugaauauauuaagacccgcacaaacgauugggacuuuguugugaccacagauaucagcgagaugggagcuaauuucaaggccgagcgggugaucgacccgagacgcuguaugaaacccgucauucucaccgauggcgaagaacgggugauccuggcggggccuaugcccguuacgcacuccucugcugcccagagacgcggccgggugggaagaaacccuaagaaugaaaacgaccaguacauuuacaugggcgagccccuugaaaaugaugaggacugcgcccauuggaaagaggcuaagaugcugcucgacaacaucaauacaccggaagggauuaucccuagcauguuugagcccgaacgcgagaaagucgaugccaucgacggagaauauagacugcggggcgaggcgcgcaagaccuucguggaucugaugagaagaggggaccucccuguuuggcuugccuaccgcguggcugccgagggaauuaacuaugcugauagacggugguguuuugacggcgucaaaaacaaucaaauccuggaagagaacguggaagucgagauuuggacaaaggagggggaaagaaagaaacugaagccccgcuggcucgaugcccggaucuacuccgacccucuggcucuuaaagaguucaaggaguucgccgcgggcagaaaaucucugacccucaaucugauuacggagaugggacgccugcccaccuuuaugacacagaaggcccggaacgcucucgauaaucuugccgugcugcacaccgcugaagccggcgggagagccuauaaccacgcucugagcgagcucccggagacacuggaaacccuucugcuccugacacugcucgcgaccguuacgggaggcaucuuccuuuuucugauguccgggaagggaauuggcaaaaugacacugggcaugugcugcaucaucaccgccagcauucuccugugguacgcucagauccagccucauuggauugccgccucuaucauucuugaguucuuucugaucgugcuccugauccccgaacccgagaagcaacggaccccucaggacaaucagcugacauauguggucauugcuauccucaccguuguggccgcgacaauggccaacgaaaugggguuccuugagaaaacgaagaaagauuuuggacugggcuccauugcuacccagcaaccggagagcaauauccuggacauugaucuccgccccgccuccgcuuggacacuguacgccguggcgaccacauucaucaccccuaugcuuagacacucuaucgaaaacagcuccgucaaugugucucugacggccauugcuaaccaggccaccguucucauggggcugggaaagggcuggccccugagcaagauggacaucggggugccucuccuugcuauuggauguuacucccaggucaaucccaucacacugaccgccgcucugcuccugcuuguggcccauuaugcgauuaucggcccuggccugcaggccaaagcuacacgggaggcccaaaagcgcgcugccgccgggauuaugaaaaacccgaccgucgacggaaucacggugaucgaucucgaccccauuccuuacgaucccaaguuugaaaaacagcugggccagguuaugcugcucgugcuuugcgucacacaggugcugaugaugagaaccacaugggcgcugugugaggcucucacccuggccaccgggccuaucagcacacuuugggaaggaaaucccggccgguucuggaacacgaccauugcuguuucuauggccaauaucuuucgcggguccuaucuggccggagcuggccuccuguucagcauuaugaagaacacagccaacaccagacggggcacagggaauaccggagagacgcugggcgagaaguggaaaaaccgccucaaugcgcuugggaagucugaauuucaaaucuacaaaaaguccggaauccaggagguggacagaacacuggccaaagaaggcauuaagagaggggaaaccgaucaccaugcugucagcagaggaucugccaaacugcgcugguucguggagcggaaccucgugaccccggaaggcaagguugucgaccugggcugcgggagaggaggcuggagcuauuacugugggggacuuaagaaugugaaagaggugaagggccugacaaaagggggaccuggccacgaggagcccauccccauguccaccuauggcuggaaccucguccgccugcagucugggguugauguguucuuuacaccucccgaaaagugcgacacgcugcucugugauauuggagagagcuccccuaauccgaccguggaggcuggccggacacuuagaguccugaaccugguggaaaauuggcucaacaauaacacccaauucugcaucaaaguucugaaucccuacaugccuagcgugauugagaagauggaagcccuucagcgcaaguacgggggagcgcugguccggaacccccucuccagaaauucuacacacgagauguauugggugagcaacgccuccggcaacaucguuucuagcgugaauaugaucucccgcaugcugauuaaccgguuuaccaugagacauaaaaaggcuacguacgaaccugacgucgaucuggggucuggaacccgcaauaucggcauugagagcgagacacccaaccucgacaucauuggcaaacggaucgaaaagaucaaacaggagcacgaaaccuccuggcauuaugaucaggaccacccguacaagacaugggccuaucacgggagcuacgagaccaagcaaacaggaucugcuuccagcauggugaauggcguggucagacuucugaccaaaccuugggacauuauccccaugguuacgcagauggccaugacagauaccaccccuuucgggcagcagcgcguguuuaaggaaaaaguggacacaagaacgcaagagcccaaggagggaaccaaaaagcugaugaagauuacagcugaauggcucuggaaagagcugggcaagaaaaagaccccucggauguguacacgcgaagaguucaccagaaaaguccggucuaacgccgcgcuuggggccaucuuuacagaugagaauaaguggaaauccgcuagagaagccguggaggacagcggauucugggaacugguugauaaggagcggaaccuccaucuggaaggcaagugcgagaccuguguguauaauaugaugggcaaacgcgagaagaaacugggggaauuuggaaaggcuaaaggcucuagagccauuugguacauguggcucggggcccgguuccuggaguuugaagcgcuuggauuccugaacgaggaccacugguuuucccgcgaaaauagccucuccggcgucgagggggagggccugcauaaacuuggauacauccugagagaugugagcaagaaagaaggcggggcuauguaugccgacgauacggccggaugggacacccggauuacacucgaggaucugaagaacgaagagaugguuaccaaucacauggaaggcgagcauaaaaagcuggcugaggccaucuucaaacucacauaccagaacaaggugguccgcgugcagagacccaccccgcgggggacgguuauggacaucauuucucgcagagaccagcggggaagcggccaaguggucacauaugggcugaauaccuucacaaacauggaagcucagcuuauccgccagauggagggcgaaggaguguuuaaguccauucaacaccugaccgucacggaggagaucgccgugaaaaacuggcucguuagagugggccgggaacgccugucuagaauggcgauuagcggggaugacugcgucgugaagccucuugaugaccgguucgccuccgcucugaccgcccucaaugauaugggaaaagugagaaaggacauccagcagugggagcccucucgcggcuggaacgauuggacacagguucccuuuugcagccaccauuuccacgaacugaucaugaaagacgggcgggugcuggucgugccuuguagaaaucaagaugagcucauuggacgcgcucggaucucccagggcgccggguggucucugagagaaaccgcgugccuuggcaagagcuacgcccagauguggucccugauguauuuucaucgccgggaccucagacuggcugccaacgcuauuuguagcgccguuccgucucacugggugcccacaucccgcaccacauggagcauccacgcuacccaugaguggaugacgacagaggauaugcuuaccgucuggaaucggguguggauucaggaaaacccuuggauggaggacaagacccccgucgaaucuugggaggaaaucccuuaccugggaaaaagagaggaucaauggugcggcucccucaucgggcugacaagccgcgccaccugggcgaagaauauucagacagccaucaaccaggugcggucccugauuggaaaugaggaauauacggacuacaugcccucuaugaaaagauuccggagagaggaagaggaagcuggcguucucugguga

SEQ ID NO: 20337 - RNA, 9876 nt, Artificial Sequence
  derived and/or modified CDS sequence (opt5) from DENV-2__AF169678__SS-prME
uccgccggaaugaucauuaugcugauccccaccgugauggcuuuccaccugacaacgcggaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgccgggaaaagcggucuguggcgcucgucccucauguggggaugggacuggagacacgcaccgaaacguggauguccuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaggacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcaaaauccccuucgaaaucauggaccucgagaagagauacguucugggacgccugauuacggugaacccuaucgucaccgaaaaagauuccccggugaacauugaggccgaacccccuuuuggcgacagcuacaucauuaucgggguugagcccggccagcucaagcugaauugguucaagaaaggaucuagcauuggccaaauguuugagacaaccaugagaggggcuaagagaauggccauccuuggagauacagccugggacuucggcucccucgggggaguguuuaccucuaucggcaaagcucuccaucaggucuucggggccauuuauggcgcggcuuuuagcggaguguccuggacgaugaagauccugauuggcgugaucauuacauggaucgggaugaacagccgcucuaccucccugagcguuucucuuguccucgugggaaucgugacccuguaccugggcgucauggugcaggccgauuccggguguguugugagcuggaaaaauaaggaacucaagugcggauccggcauuuucaucacagacaacguccacaccuggacagagcaguauaaauuucaaccugaaucucccagcaagcuggccuccgcuauucagaaagcccaggaggaagggaucuguggcauucggucugugacgagacuugagaaucugauguggaagcagaucaccccggagcucaaccacauccuggcugaaaaugagguuaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccugaaacagccgagugccccaauaccaacagagcuuggaacucccucgagguggaagauuauggguuuggagucuucacaaccaacauuuggcugaaacuuaaggagaaacaggacgccuuuugugacagcaagcugaugucugcugccaucaaggauaaucgcgcggugcacgccgacaugggcuacuggaucgaauccgcucucaacgauacauggaaaauugagaaggccagcuucaucgagguuaaaaauugccauuggccuaagucucacacccuguggagcaacggcgugcuggaauccgagaugauuauccccaaaaaccuugcugggccggucagccaacacaauuaucggccuggauaccauacgcagauugccggccccuggcaccucgggaagcuggaaauggacuucgauuuuugugacggaacaaccgugguggucaccgaggauugcggcaacagagggcccucucugcgcacaaccacggccuccggaaagcucaucacagaauggugcugucggagcugcacccugccuccgcuuagauaccggggcgaggacggcuguugguaugggauggagauucgcccccugaaagaaaaggaggaaaaucucguuaacucccuggugacagcuggacauggccagguggauaauuucucucuggggguccuuggaauggcgcucuuucuggaggaaaugcugagaacccgggugggcacaaaacacgccauccuccugguugcugugagcuucgucacccuuaucacggggaacauguccuuuaaggaccugggaagagugguugugauggucggcgccaccaugacagaugacauuggcaugggggugaccuaccucgcccugcuggcugccuucaaaguucgcccuacauuugcggcuggacuucugcuccggaagcugaccucuaaggagcucaugaugacgacaaucggcauugugcugcuuagccaauccaccauccccgagacaauucuggaacucaccgaugcccuggcccuggggaugaugguccuuaaaaucgugagaaauauggagaaguaucagcuggcugugaccaucauggccauucucugcgucccuaacgcgguuauccugcagaaugcuuggaaagugucuuguacaauucucgccguggucagcgugagcccccugauccuuacgagcucucagcaaaagaccgacuggauuccucuggcccucacaaucaaaggacugaaccccaccgcuaucuuccugacaacccuuucccgcacgaauaagaaaagaagcuggccgcugaacgaagccauuauggcuguuggcauggugucuauccucgccuccagccugcucaagaaugacauuccuaugacagggccccuggucgcgggaggccuucugaccgugugcuacguucugaccggccggucugccgaucucgagcuggaacgcgcugccgacgugaagugggaggaucaggcugagaucuccgggagcuccccuauucuuagcaucacaauuucugaagacggaagcauguccaucaaaaacgaggaagaggagcagacccugacaauccucauuagaacgggccugcucgucaucucugggcuguuucccgugagcauuccgaucaccgccgccgcuugguaucuuugggaagucaagaaacagcgggcgggagugcugugggauguuccuucucccccucccaugggcaaggccgagcuggaagacggggcuuaccgcauuaaacaaaagggaauccucggcuauagccagaucggcgccgggguguacaaggagggaacauuccauaccauguggcacgucacaagaggcgccgugcugaugcacaaagggaagcggauugaacccagcugggcugauguuaaaaaggaccuuaucuccuacggaggcggguggaaacuggagggagaguggaaggaaggcgaggaagugcagguccucgcccuggagccuggcaagaauccgcgcgcggugcagaccaaacccgggcucuuuaagacgaacaccggaacaauuggcgcugugucucuggauuucagcccugggaccuccggaagccccaucauugacaaaaagggcaaaguugucgggcuuuauggaaacggcguggugacaagaucuggcgccuacgucuccgccaucgcucaaaccgaaaagagcaucgaggauaauccugagauugaagacgauaucuuucggaagaaacgccugacaauuauggaccugcaucccggggccggaaagacgaaaagauaucucccugcgaucgugcgggaggcuauuaagagaggccugcgcacccuuauccuggccccgacacggguuguggccgcugaaauggaggaagcccucagagggcugcccauucgcuaccagaccccugcuauccgggccgagcacaccggaagagagaucgucgaccucaugugucaugcgacauucacgaugcgccugcuuucucccgugcggguuccuaacuauaaucugauuaucauggaugaagcccacuucaccgaccccgcuuccauugccgcuagaggcuacaucagcacacgcguggagaugggggaagccgccggcauuuuuaugaccgcuacaccgccuggaucccgggaucccuucccccagucuaacgcgccuaucaucgacgaggagagagaaauucccgagcggagcuggaacuccggccaugaaugggucaccgauuuuaaagggaagacggugugguucguuccuagcaucaaggccggaaacgacauugcugccugccugcgcaaaaauggcaagaaagugauccaacucucuagaaagacauuugauuccgaguaugucaaaacccggaccaacgacugggauuucguggugacaaccgacauuagcgaaaugggggccaauuuuaaggcugagcgcgucaucgauccgagacgguguaugaaacccguuauccugacagacggagaggaaagagugauucuugccggcccuaugcccgugacccacucuagcgcggcucagcgccgggggagaaucggccgcaacccuaagaaugagaacgaccaguacauuuacaugggagaaccccuggagaaugaugaagacugcgcccacuggaaggaggccaaaaugcuccuggauaacaucaauacgccggagggcauuaucccuuccauguucgaacccgagcgggaaaaggucgacgcuauugauggggaguauagacugcgcggagaagcccggaaaacauuuguggaccucaugagacgcggcgaucuuccuguuuggcuggcguacaagguggccgcugaggggaucaacuaugccgacagacggugguguuucgauggaauccagaacaaucaaauucuggaggaaaacgucgagguggaaaucuggaccaaagagggcgagcgcaagaagcucaaacccagauggcuggacgcucggauuuacucugauccucuugcccugaaggaauuuaaagaguucgcugccgggcgcaagagccucacacugaaucugaucaccgaaaugggcagacuccccacguucaugacccagaaagcgcgggacgcccuugauaaccuggcuguucugcauacagccgaggcuggaggcagagccuauaaucacgcccucuccgaacugccggagacccuugagacacugcuccugcugacccuccuugcuacagugaccgggggaauuuuucuguuccugaugucuggccgcgggaucggaaagaugacgcucggcaugugcugcaucauuacagcgagcauccugcuuugguacgcccagauucagccucauuggaucgcugccuccauuauccuggaauuuuuccucaucguccugcugauucccgagcccgaaaagcaacggaccccucaggacaaccagcucaccuauguggucaucgccauucuuacagugguugcugccaccauggcgaaugagaugggcuuucuggagaaaaccaagaaagaccugggguucggaagcaucgccacgcagcaaccggagucuaacauucucgauaucgaccugagacccgcuuccgccuggacccuuuacgcuguggccacaaccuuugugacaccuaugcugcgccacagcauugaaaauuccucugucaacguuagccucaccgcgaucgccaaucaggcuacggugcugaugggccuggggaagggauggccccucuccaaaauggauaucggcgugccucuucuggccauuggguguuacucucaggucaaccccaucacccugacagcugcccuccugcuucugguggcucacuaugccauuaucggaccuggccuccaggcgaaggccacccgggaagcucaaaagagagccgcugccggcauuaugaaaaauccgacaguugacgggaucaccgugaucgaucuggaccccauuccuuacgaucccaaguucgagaaacagcugggacaggucaugcuccuugugcugugcgucacgcaagugcugaugaugcggacaaccugggcccucugugaagcgcugacacuugcuaccggcccuaucagcacccugugggaggggaaccccggacgcuuuuggaauacaacgauugccguuuccauggcuaacaucuucagaggcagcuaucucgccggggccggacugcuguuuucuauuaugaagaauaccacaaacacccggcgcggcacaggcaacaucggggaaacccucggagagaaauggaaguccagacuuaaugcucugggcaaaagcgaguuccagaucuacaagaagucugggauucaggaaguggaccggacgcuggccaaagagggaaucaagcgcggcgaaacagaucaucacgcggucuccagagggagcgccaaacuccggugguuuguggagcgcaacaugauuaccccggagggaaagguuguggaccugggcugcggcagagggggauggucuuauuacuguggcgggcuuaaaaauguccgggaagugaagggacugaccaagggcgggccuggacaugaggaacccauccccaugagcacauauggcuggaaccucgugagacugcaguccggcguugaugucuucuucaccccucccgagaaaugcgacacacugcucugugauauuggggaaucuagcccuaauccgacgguggaggcuggacgcacccuucgggugcugaaccuggucgagaauuggcucaacaauaacacacaauuuugcaucaagguucugaaucccuacaugccuuccgugaucgagaaaauggaggcccuucagagaaaguacggcggggcucuggugcgcaacccccucagcagaaauuccacccacgaaauguauugggucucuaacgccagcggaaauauuguguccucuguuaacaugaucagcagaaugcugauuaaccgcuucacaaugaaacauaagaaggcgaccuacgagccugacguggaccugggcuccgggacgcggaauaucggaauugaaucugagguccccaaccucgauaucauuggcaaaagaaucgagaagaucaaacaggaacacgagaccagcuggcacuaugaccaggaucauccguacaagacaugggccuaucacggcuccuacgaaaccaaacaaacagggagcgcuucuuccauggugaauggaguugugcgccuucugaccaagccuugggacguccugcccacagugacccagauggccaugacggauacaaccccuuuuggccagcagcggguguucaaggagaaagucgacaccagaacacaagaacccaaggaggggacgaaaaagcucaugaaaauuaccgcugaguggcuguggaaggaacuuggcaaaaagaagacaccucgcauguguacccgggaggaauuuacaagaaaaguucgcagcaacgccgcucugggcgccaucuucaccgaugagaauaaguggaaaucugcgagagaggccguggaagacucccgguuuugggagcucguggauaaggaacgcaaccugcaucuggaggggaaaugcgaaacaugugucuauaauaugaugggaaagagagagaagaaacucggcgaguucggcaaggcuaaagggagccgggccauuugguacauguggcugggagcuagauuucuugaguucgaggcccugggcuuucucaacgaagaccacugguucucucgggaaaauucccugagcgggguggaaggagagggccuucacaagcugggguacauccuccgcgauguuuccaaaaaggagggcggagccauguaugcggacgacaccgcuggcugggauacgagaauuacccuggaagaccugaagaacgaggaaauggugacaaaucauauggagggggaacacaaaaagcucgccgaggccaucuuuaaacugaccuaccagaacaaggucgugcggguucagcgccccacaccgagaggaaccgugauggauaucauuagccggcgcgaccaaagaggcucugggcaggucggaacguauggccuuaauacauucaccaacauggaggcucagcugauccggcagauggaaggggagggcguguucaaaaauauucaacaucucacagccaccgaagagaucgcuguucagaacuggcuggcccgcgugggaagagagcggcuuagccgcauggcgauuuccggcgaugacugcgucgugaagccucuggaugacagauuugccucugcucucacggcccugaacgauauggggaagguccggaaagacauccagcagugggaacccagccgcggauggaaugauuggacccaagugcccuucugcucccaccauuuucacgagcugaucaugaaggacggcagaguucucguggucccuugucggaaccaggaugaacugauugggagagcucgcaucucucagggagccggcuggagccuucgggagacagcgugccuggggaaauccuacgcccagauguggucucucauguauuuccacagacgcgaccugcggcuugcugccaaugcuauuuguagcgccgugccgucccauugggugcccaccagcagaacaaccuggucuauccacgcuaagcaugaauggaugacaaccgaggacaugcugacgguuuggaaccgcguguggauucaagagaauccuuggauggaagauaaaacacccgucgaguccugggaagagaucccuuaccucggcaagcgggaagaccaguggugcggaagccugauuggccugaccucuagagccaccugggcgaagaacauccaggccgcuaucaaucaggugcgcucccucauugggaacgaggaguauacagauuacaugcccagcaugaaacgguuuagacgcgaagaggaagaggccggaguucugugguga

SEQ ID NO: 20338 - RNA, 9876 nt, Artificial Sequence
  derived and/or modified CDS sequence (opt5) from DENV-2__AF169679__SS-prME
uccgccggaaugaucauuaugcugauccccaccgugauggcuuuccaccugaccacgcggaauggggagccucauaugauugucuccauccaggaaaagggaaaaucucugcuuuuuaagaccgaggacggcguuaauaugugcacgcugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcacagaagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaggaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcaaaauccccuucgaaaucauggaccucgagaagagauacguucugggacgccugauuacggugaacccuaucgucaccgaaaaagauuccccggugaacauugaggccgaacccccuuuuggcgacagcuacaucauuaucgggguugagcccggccagcucaagcugaauugguucaagaaaggaucuagcauuggccaaauguuugagacaaccaugagaggggcuaagagaauggccauccuuggagauacagccugggacuucggcucccucgggggaguguuuaccucuaucggcaaagcucuccaucaggucuucggggccauuuauggcgcggcuuuuagcggaguguccuggacgaugaagauccugauuggcgugaucauuacauggaucgggaugaacagccgcucuaccucccugagcguuucucuuguccucgugggaaucgugacccuguaccugggcgucauggugcaggccgauuccggguguguugugagcuggaaaaauaaggaacucaagugcggauccggcauuuucaucacagacaacguccacaccuggacagagcaguauaaauuucaaccugaaucucccagcaagcuggccuccgcuauucagaaagcccaggaggaagggaucuguggcauucggucugugacgagacuugagaaucugauguggaagcagaucaccccggagcucaaccacauccuggcugaaaaugagguuaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccuaaaacagccgaaugccccaauaccaacagagcuuggaacucccucgagguggaggauuauggguuuggagucuucacaaccaacauuuggcugaaacuuaaagaaaagcaggacgccuuuugugacagcaagcugaugucugcugccaucaaagauaaucgcgcggugcacgccgacaugggcuacuggaucgaguccgcucucaacgauacauggaagauugaaaaagccagcuucaucgagguuaagaauugccauuggccuaaaucucacacccuguggagcaacggcgugcuggaguccgaaaugauuauccccaagaaccuugcugggccggucagccaacacaauuaucggccuggauaccauacgcagauugccggccccuggcaccucgggaagcuggagauggacuucgauuuuugugacggaacaaccgugguggucaccgaagauugcggcaacagagggcccucucugcgcacaaccacggccuccggaaaacucaucacagaguggugcugucggagcugcacccugccuccgcuuagauaccggggcgaagacggcuguugguaugggauggagauucgcccccugaaggagaaagaagagaaucucguuaacucccuggugacagcuggacauggccagguggauaauuucucucuggggguccuuggaauggcgcucuuucuggaagagaugcugagaacccgggugggcacaaagcacgccauccuccugguugcugugagcuucgucacccuuaucacggggaacauguccuuuaaagaccugggaagagugguugugauggucggcgccaccaugacagaugacauuggcaugggggugaccuaccucgcccugcuggcugccuucaagguucgcccuacauuugcggcuggacuucugcuccggaagcugaccucuaaagaacucaugaugacgacaaucggcauugugcugcuuagccaauccaccauccccgagacaauucuggagcucaccgaugcccuggcccuggggaugaugguccuuaagaucgugagaaauauggaaaaauaucagcuggcugugaccaucauggccauucucugcgucccuaacgcgguuauccugcagaaugcuuggaaggugucuuguacaauucucgccguggucagcgugagcccccugauccuuacgagcucucagcagaagaccgacuggauuccucuggcccucacaaucaagggacugaaccccaccgcuaucuuccugacaacccuuucccgcacgaauaaaaagagaagcuggccgcugaacgaggccauuauggcuguuggcauggugucuauccucgccuccagccugcucaagaaugacauuccuaugacagggccccuggucgcgggaggccuucugaccgugugcuacguucugaccggccggucugccgaucucgaacuggagcgcgcugccgacgugaaaugggaagaucaggcugagaucuccgggagcuccccuauucuuagcaucacaauuucugaggacggaagcauguccaucaagaacgaagaggaggaacagacccugacaauccucauuagaacgggccugcucgucaucucugggcuguuucccgugagcauuccgaucaccgccgccgcuugguaucuuugggaggucaaaaagcagcgggcgggagugcugugggauguuccuucucccccucccaugggcaaagccgaacuggaggacggggcuuaccgcauuaagcaaaagggaauccucggcuauagccagaucggcgccgggguguacaaagaaggaacauuccauaccauguggcacgucacaagaggcgccgugcugaugcacaaggggaaacggauugagcccagcugggcugauguuaagaaagaccuuaucuccuacggaggcggguggaagcuggaaggagaguggaaggagggcgaagaggugcagguccucgcccuggaaccuggcaaaaauccgcgcgcggugcagaccaagcccgggcucuuuaaaacgaacaccggaacaauuggcgcugugucucuggauuucagcccugggaccuccggaagccccaucauugacaagaaaggcaagguugucgggcuuuauggaaacggcguggugacaagaucuggcgccuacgucuccgccaucgcucaaaccgaaaaguccaucgaagauaauccugagauugaggacgauaucuuucggaaacgcagacugacaauuauggaccugcaucccggggccggaaagacgaaacgguaucucccugcgaucgugagagaagcuauuaagcgcggccugcggacccuuauccuggccccgacaagaguuguggccgcugagauggaagaggcccuccgcgggcugcccauucgguaccagaccccugcuaucagagccgaacacaccggacgcgagaucgucgaccucaugugucaugcgacauucacgaugcggcugcuuucucccgugagaguuccuaacuauaaucugauuaucauggaugaggcccacuucaccgaccccgcuuccauugccgcucgcggcuacaucagcacacggguggaaaugggggaggccgccggcauuuuuaugaccgcuacaccgccuggauccagagaucccuucccccagucuaacgcgccuaucauggacgaggaacgggagauccccgaacgcagcuggaacuccggccaugagugggucaccgauuuuaaagggaagacggugugguucguuccuagcauuaaggccggaaacgacaucgcugccugccugcgcaaaaauggcaagaaagugauucaacucucucggaagacauuugauuccgaauaugucaaaacccgcaccaacgacugggauuucguggugacaaccgacaucagcgagaugggggccaauuuuaaggcugaaagagucauugauccgcggagauguaugaaacccguuauccugacagacggagaggagcgcgugauccuugccggcccuaugcccgugacccacucuagcgcggcucagcggagagggcgcauuggccggaacccuaagaaugaaaacgaccaguacaucuacaugggagagccccuggaaaaugaugaggacugcgcccacuggaaggaagccaaaaugcuccuggauaacauuaauacgccggagggcaucauuccuuccauguucgagcccgaaagagagaaggucgacgcuaucgauggggaauaucgccugcggggagaggccagaaaaacauuuguggaccucaugcgcagaggcgaucuuccuguuuggcuggcguacaagguggccgcugaagggauuaacuaugccgaccggcgcugguguuucgauggaaucagaaacaaucagauccuggaggagaacgucgaaguggagauuuggaccaaagaaggcgagcggaagaagcucaaaccccgcuggcuggacgcuagaaucuacucugauccucuugcccugaaggaguuuaaagaguucgcugccgggagaaagagccucacacugaaucugauuaccgagaugggccggcuccccacguucaugacccaaaaagcgcgcgacgcccuugauaaccuggcuguucugcauacagccgaagcuggaggccgggccuauaaucacgcccucuccgagcugccggaaacccuugagacacugcuccugcugacccuccuugcuacagugaccgggggaaucuuucuguuccugaugucuggcagagggauuggaaagaugacgcucggcaugugcugcaucaucacagcgagcauucugcuuugguacgcccagauccagccucauuggauugcugccuccaucauucuggaguuuuuccucaucguccugcugauccccgaacccgagaagcagcgcaccccucaagacaaccagcucaccuauguggucauugccauccuuacagugguugcugccaccauggcgaaugaaaugggcuuucuggagaaaacaaagaaagaccugggguucggaagcauugccacgcagcagccggaaucuaacauccucgauauugaccugcggcccgcuuccgccuggacccuuuacgcuguggccacaaccuuugugacaccuaugcugagacacagcaucgaaaauuccucugucaacguuagccucaccgcgauugccaaucaagcuacggugcugaugggccuggggaagggauggccccucuccaaaauggauaucggcgugccucuucuggccaucggguguuacucucaggucaaccccauuacccugacagcugcccuccugcuucugguggcucacuaugccaucauuggaccuggccuccaggcgaaggccacccgggaggcucagaagcgcgccgcugccggcaucaugaaaaauccgacaguugacgggauuaccgugaucgaucuggaccccaucccuuacgaucccaaguucgaaaaacaacugggacaggucaugcuccuugugcugugcgucacacaggugcugaugaugagaacaaccugggcccucugugaggcgcugacacuugcuaccggcccuauuagcacccugugggaagggaaccccggacgguuuuggaauacaacgaucgccguuuccauggcuaacauuuuccgcggcagcuaucucgccggggccggacugcuguuuucuaucaugaagaauaccacaaacaccagacggggcacaggcaacauuggggagacccucggagaaaaauggaagucccgccuuaaugcucugggcaaaagcgaguuccaaaucuacaagaagucugggauccaggagguggacagaacgcuggccaaagaaggaauuaagcggggcgagacagaucaucacgcggucucccgcgggagcgccaaacucagaugguuuguggaacggaacaugaucaccccggagggaaagguuguggaccugggcugcggcagagggggauggucuuauuacuguggcgggcuuaaaaauguccgcgaggugaagggacugaccaagggcgggccuggacaugaggagcccauucccaugagcacauauggcuggaaccucgugcggcugcaguccggcguugaugucuucuucaccccucccgaaaaaugcgacacacugcucugugauaucggggagucuagcccuaauccgacgguggaagcuggaagaacccuucgcgugcugaaccuggucgagaauuggcucaacaauaacacacaguuuugcauuaagguucugaaucccuacaugccuuccgugaucgagaaaauggaagcccuucaacggaaguacggcggggcucuggugagaaacccccucagccgcaauuccacccacgagauguauugggucucuaacgccagcggaaauaucguguccucuguuaacaugauuagccggaugcugaucaacagauucacaaugaaacauaagaaggcgaccuacgaaccugacguggaccugggcuccgggacgcgcaauauuggaaucgagucugaaguccccaaccucgauauuaucggcaaacggauugagaagaucaaacaggagcacgaaaccagcuggcacuaugaccaggaucauccguacaagacaugggccuaucacggcuccuacgagaccaaacagacagggagcgcuucuuccauggugaauggaguugugagacuucugaccaagccuugggacguccugcccacagugacccaaauggccaugacggauacaaccccuuuuggccagcagcgcguguucaaggaaaaagucgacacccggacacaggagcccaaggaagggacgaaaaagcucaugaaaaucaccgcugaguggcuguggaaggagcuuggcaaaaagaagacaccuagaauguguacccgcgaagaguuuacaagaaaaguucggagcaacgccgcucugggcgccauuuucaccgaugaaaauaaguggaaaucugcgcgcgaggccguggaggacuccagauuuugggaacucguggauaaggagcggaaccugcaucuggaagggaaaugcgagacaugugucuauaauaugaugggaaagagagaaaagaaacucggcgaguucggcaaggcuaaagggagccgggccaucugguacauguggcugggagcucgcuuucuugaguucgaagcccugggcuuucucaacgaggaccacugguucucuagagaaaauucccugagcgggguggagggagaaggccuucacaagcugggguacauucuccgggauguuuccaaaaaggagggcggagccauguaugcggacgacaccgcuggcugggauacgcgcaucacccuggaggaccugaagaacgaagagauggugacaaaucauauggaaggggagcacaaaaagcucgccgaagccauuuuuaaacugaccuaccaaaacaaggucgugagaguucagcggcccacaccgcgcggaaccgugauggauaucaucagcagacgggaccagcgcggcucugggcaagucggaacguauggccuuaauacauucaccaacauggaggcucagcugauuagacagauggagggggaaggcguguucaaaaauauccagcaucucacagccaccgaggaaauugcuguucaaaacuggcuggcccgggugggacgcgagagacuuagccggauggcgaucuccggcgaugacugcgucgugaagccucuggaugaccgcuuugccucugcucucacggcccugaacgauauggggaaggucagaaaagacauucagcagugggagcccagccggggauggaaugauuggacccaggugcccuucugcucccaccauuuucacgaacugaucaugaaggacggcagaguucucguggucccuugucgcaaccaagaugagcugaucgggcgggcuagaauuucucagggagccggcuggagccuucgcgaaacagcgugccuggggaaauccuacgcccagauguggucucucauguauuuccaccggagagaccugcgccuugcugccaaugcuaucuguagcgccgugccgucccauugggugcccaccagccggacaaccuggucuauucacgcuaagcaugaguggaugacaaccgaagacaugcugacgguuuggaacagaguguggauccaggagaauccuuggauggaggauaaaacacccgucgaauccugggaggaaauuccuuaccucggcaagcgcgaggaccaauggugcggaagccugaucggccugaccucucgggccaccugggcgaagaacauucaggccgcuaucaaucaggugagaucccucaucgggaacgaagaguauacagauuacaugcccagcaugaaacgcuuucggagagaggaagaggaagccggaguucugugguga

SEQ ID NO: 20339 - RNA, 9876 nt, Artificial Sequence
  derived and/or modified CDS sequence (opt5) from DENV-2__AF169680__SS-prME
agcgccggcaugaucauuaugcugauccccaccgugauggcuuuccaccugacaacgcggaacggggaaccucauaugauuguguccauccaggaaaagggaaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcaucauccccuucgaaauuauggaccucgagaaaagauacguucugggacgccugaucacggugaacccuauugucaccgaaaaggauuccccggugaacaucgaggccgaacccccuuuuggcgacagcuacauuaucauugggguugagcccggccagcucaaacugaauugguucaagaagggaucuagcaucggccaaauguuugagacaaccaugagaggggcuaaaagaauggccauccuuggagauacagccugggacuucggcucccucgggggaguguuuaccucuauuggcaaggcucuccaucaggucuucggggccaucuauggcgcggcuuuuagcggaguguccuggacgaugaaaauucugaucggcgugauuaucacauggaucgggaugaacagccgcucuaccucccugagcguuucucuuguccucgugggaauugugacccuguaccugggcgucauggugcaggccgauuccggguguguugugagcuggaagaauaaagaacucaagugcggauccggcaucuucauuacagacaacguccacaccuggacagagcaguauaaguuucaaccugaaucucccagcaaacuggccuccgcuauccagaaggcccaggaggaagggauuuguggcauccggucugugacgagacuugagaaucugauguggaaacagaucaccccggagcucaaccacauucuggcugaaaaugagguuaagcugacaaucaugaccggagauauuaaaggcaucaugcaagccgggaagcgcagccuucggccucagcccacagaacucaaauacuccuggaagaccuggggaaaggcgaaaaugcugagcacggagucucauaaccagaauuuccugauugacggcccugaaaccgccgagugccccaacacaaauagagcuuggaacucccucgagguggaagauuauggguuuggagucuucaccacaaauguguggcugaaacuuaaagagaagcaggacgccuuuugugacagcaaacugaugucugcugccaucaaggauaaccgcgcgguucacgccgacaugggcuacuggaucgaauccgcucucaaugauaccuggaagauugagaaagccagcuucaucgaggugaagaacugccauuggccuaaaucucacacacuguggagcaacggcguccuggaauccgagaugauuauccccaagaaucuugcugggccggugagccaacacaacuaucggccuggauaccauacccagauugccggccccuggcaccucgggaaacuggaaauggacuucgauuuuugugacggaacgacaguggucguuaccgaggauugcggcaauagagggcccucucugcgcaccacaaccgccuccggaaagcucaucacggaauggugcugucggagcugcacacugccuccgcuuagauaccggggcgaggacggcuguugguaugggauggagauucgcccccugaaggaaaaagaggaaaaccucgucaauucccuggugaccgcuggacauggccaggucgauaacuucucucugggggugcuuggaauggcgcucuuucuggaggaaaugcugagaacacggguuggcaccaagcacgccauccuccugguggcugucagcuucgugacacuuaucaccgggaauauguccuuuaaagaccugggaagaguuguggucauggugggcgccacgaugaccgaugacauuggcauggggguuacauaccucgcccugcuggcugccuucaaggugcgcccuaccuuugcggcuggacuucugcuccggaaacugacaucuaaggagcucaugaugaccacgaucggcauuguccugcuuagccaauccacaauccccgagaccauucuggaacucacagaugcccuggcccuggggaugauggugcuuaagaucgugagaaacauggagaaauaucagcuggcugucaccaucauggccauucucugcguuccuaaugcggugauccugcagaacgcuuggaaggugucuuguaccauucucgccgucgugagcguuagcccccugauccuuacaagcucucagcagaagacggacuggauuccucuggcccucaccaucaagggacugaaucccacagcuaucuuccugaccacacuuucccgcaccaacaaaaagagaagcuggccgcugaaugaagccauuauggcugugggcauggucucuauccucgccuccagccugcucaaaaacgacauuccuaugacggggccccugguggcgggaggccuucugacaguuugcuacgugcugaccggccggucugccgaucucgagcuggaacgcgcuaccgacgucaagugggagagacaggccgagaucuccgggagcuccccuauucuuagcaucacaauuucugaagauggaagcauguccaucaagaaugaggaagaggagcagacccugacaauccucauucggacgggccugcucgugaucucugggcuguuucccgucagcauuccgaucaccgcugccgccugguaucuuugggaagugaaaaagcagcgcgcuggaguucugugggacgugccuucucccccucccaugggcaaagcggagcuggaagauggggccuacagaauuaagcaaaaaggaauccucggcuauagccagaucggcgcuggggucuacaaggagggaacauuccauaccauguggcacgugacacggggcgccguucugaugcacaaggggaaacgcauugaacccagcugggccgacgugaagaaagaucuuaucuccuacggaggcggguggaagcuggagggagaguggaaagaaggcgaggaaguccaggugcucgcucuggagccuggcaagaacccgagagccgugcagaccaagcccgggcucuuuaaaacgaacaccggaacaauuggcgcgguuucucuggacuucagcccugggaccuccggaagccccaucauugauaagaaaggcaaggucguggggcuuuauggaaauggcguggucacacggucuggcgcuuacguguccgccaucgcccaaaccgagaaauccaucgaggacaacccugagauugaagaugacaucuuucgcaagagaaagaugacaauuauggaucugcaucccggggcuggaaaaacgaagcgguaucugccugccaucguuagagaggcgauuaaacgcggccuccggacccugauccuugcuccgacaagaguggucgccgccgaaauggaggaagcucugcgcgggcuccccauucgguaccagaccccugccaucagagcugagcacaccggacgcgagaucguggaccugaugugucaugccacauucacgaugcggcuccugucucccguuagagugccuaauuauaaccuuauuaucauggacgaagcgcacuucaccgaucccgccuccauugcugcccgcggcuacaucagcacacgggucgagaugggggaagcugccggcauuuuuaugaccgccacaccgccuggauccagagaccccuucccccagucuaaugcuccuaucaucgaugaggagcgggaaauucccgagcgcagcuggaacuccggccaugaaugggugaccgacuuuaaggggaaaacgguuugguucgugccuagcaucaaggcgggaaaugauauugccgcuugccugagaaagaacggcaaaaaggucauccaacugucucggaaaacauuugacuccgaguaugugaagacccgcaccaaugauugggacuucguggucacaaccgauauuagcgaaaugggggccaacuuuaaagccgagagaguuaucgacccgcggagauguaugaagcccgugauccucacagauggagaggaacgcgugauucuggcuggcccuaugcccgucacccacucuagcgccgcgcagcggagagggcgcaucggccggaauccuaaaaacgagaaugaccaguacauuuacaugggagaaccccuugagaacgacgaagauugcgcucacuggaaggaggccaagaugcugcucgacaauaucaacacgccggagggcauuaucccuuccauguucgaacccgagagagaaaaaguggaugccauugacggggaguaucgccugcggggagaagcuagaaagacauuuguugaucugaugcgcagaggcgaccucccuguguggcuugccuacaaagucgcggccgaggggaucaacuaugcugaucggcgcugguguuucgacggaaucagaaauaaccagauucuggaggaaaauguggagguugaaaucuggaccaaggagggcgagcggaaaaagcugaagccccgcuggcucgaugccagaauuuacucugacccucuggcucuuaaagaauuuaaggaguucgccgcugggcggaaaagccugacacucaaccugaucaccgaaaugggcagacugcccacguucaugacccaaaaggcccgcgaugcgcucgacaaucuugccgugcugcauacagcugaggccggaggccgggcuuauaaccacgcccuguccgaacucccggagacccuggagacacuucugcuccugacccugcucgccacagucaccgggggaauuuuucuuuuccugaugucuggcagagggaucggaaaaaugacgcugggcaugugcugcaucauuacagcuagcauccuccugugguacgcgcagauucagccucauuggaucgccgcuuccauuauccuugaauuuuuccugaucgugcuccugauucccgagcccgaaaagcagcgcaccccucaagauaaucagcugaccuaugucgugaucgccauucucacaguuguggccgcuaccauggccaacgagaugggcuuucuugaaaagaccaaaaaggaccugggguucggaagcaucgcgacgcagcagccggagucuaauauucuggacaucgaucuccggcccgccuccgcuuggacccuguacgccguggcuacaaccuuugucacaccuaugcuuagacacagcauugagaacuccucuguuaaugugagccugaccgccaucgcgaaccaagccacggugcucaugggccuggggaaaggauggccccuguccaagauggacaucggcgucccucuccuugcuauuggguguuacucucaggugaaucccaucacccugacagccgcucugcuccugcuuguugcccacuaugcuauuaucggaccuggccugcaggccaaagcgacccgggaagcccagaagcgcgcugccgcuggcauuaugaagaacccgagcguggaugggaucacagucaucgaccucgaucccauuccuuacgaccccaaauucgagaagcaacugggacaggugaugcugcucguccuuugcgugacccagguucugaugaugagaacgacaugggcccugugugaagcccucacccuggcgacaggcccuaucuccacccuuugggaggggaaucccggacgguuuuggaacaccacaauugcugugagcauggccaauaucuuccgcggcucuuaucuggcuggggccggacuccuguuuuccauuaugaaaaacacgaccaacacaagacggggcaccggcaauaucggggaaacacugggagagaaguggaaaagccgccucaacgcccuuggcaagucugaguuccaaaucuacaaaaaguccgggauucaggaagucgauagaacccuggcuaaggagggaaucaaacggggcgaaacggaccaucacacagugagccgcgggucugccaagcugagaugguuuguugagcggaauaugauuaccccggagggaaaagugcucgaucugggcugcggcagagggggauggagcuauuacuguggcgggcuuaagaacguccgcgaagugaaaggacugaccaagggcgggccuggacaugaggaacccauccccauguccacauauggcuggaaucucgugcggcugcagucuggcguugacgucuucuucaccccucccgagaagugcgauacacugcucugugacauuggggaaagcuccccuaacccgacgguggaggcgggaagaacccuucgcgugcugaaucuggucgagaacuggcucaauaacaauacacaguuuugcaucaaaguucugaaccccuacaugccuagcgugaucgaaaagauggaggcccuucaacggaaauacggcggggcucuggugagaaauccccucucccgcaacucuacccacgaaauguauugggucagcaaugccuccggaaacauugugucuagcguuaacaugaucucccggaugcugauuaauagauucacaaugaagcauaaaaaggcuaccuacgagccugauguggaccugggcucugggacgcgcaacaucggaauugaaagcgagguccccaaucucgacaucauuggcaagcggaucgagaaaaucaagcaggaacacgagaccuccuggcacuaugaucaggaccauccguacaaaacaugggccuaucacggcagcuacgaaaccaagcagacagggucugcguccagcauggugaacggaguugugagacuucugaccaaaccuugggauguccugcccacagugacccaaauggccaugacggacacaaccccuuuuggccagcagcgcguguucaaggagaaggucgauacccggacacaggaacccaaagaggggacgaagaaacucaugaagauuaccgcugaguggcuguggaaagaacuuggaaagaaaaagacaccuagaauguguacccgcgaggaauuuacaagaaagguucggucuaaugccgcucugggcgccaucuucaccgacgagaacaaauggaaguccgcucgcgaggccguggaagauagcagauuuugggagcucguggacaaagaacggaaucugcaucuggaggggaagugcgaaacaugugucuauaacaugaugggaaaaagagagaagaagcucggcgaguucggcaaagcgaaggggucucgggccauuugguacauguggcugggagcucgcuuucuugaguucgaggcccugggcuuucucaaugaagaucacugguucuccagagagaacagccuguccgggguggaaggagagggccuucacaaacugggguacauccuccgggacguuagcaagaaagagggcggagcuauguaugccgaugacaccgccggcugggacacgcgcauuacccuggaagaucugaagaaugaggaaauggugacaaaccauauggagggggaacacaagaaacucgcggaggcuaucuuuaagcugaccuaccaaaauaaagucgugagaguucagcggcccacaccgcgcggaaccgugauggacaucauuucuagacgggaucagcgcggcagcgggcaagucggaacguauggccuuaacacauucaccaauauggaggcccagcugaucagacagauggaaggggagggcguguucaagaacauucagcaucucacagccaccgaagagaucgcuguucaaaacuggcuggcccgggugggacgcgagagacuuucccggauggcuauuucuggcgacgauugcgucgugaaaccucuggacgaucgcuuugccagcgcgcucacggcccugaaugacauggggaaggucagaaaggauauccagcagugggaacccucccggggauggaacgacuggacccaggugcccuucugcucucaccauuuucacgagcugaucaugaaagauggcagaguucucguggucccuugucgcaaucaagacgaacugauugggcgggcuagaaucagccagggagccggcuggucccuucgcgagacagcuugccuggggaagucuuacgcccagauguggagccucauguauuuccaccggagagaucugcgccuugcggccaacgcuauuuguuccgccgugccgagccauugggugcccaccucucggacaaccugguccauccacgcuaaacaugaauggaugacaaccgaggacaugcugacgguuuggaauagaguguggauucaggagaacccuuggauggaagacaagacacccgucgagagcugggaagagaucccuuaccucggcaaacgcgaagaucaauggugcggaucucugauuggccugaccucccgggccaccugggcuaagaauauccaggccgcgaucaaccaggugagaagccucauugggaaugaggaguauacagacuacaugcccuccaugaagcgcuuucggagagaagaggaagaggccggaguucugugguga

SEQ ID NO: 20340 - RNA, 9876 nt, Artificial Sequence
  derived and/or modified CDS sequence (opt5) from DENV-2__AF169682__SS-prME
uccgcuggcaugaucauuaugcugauccccaccgugauggcuuuccaccucaccacgagaaauggggagccucauaugauugucuccauccaggaaaagggaaaaucucugcuuuuuaagaccgaggacggcguuaauaugugcacgcugauggccauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaggaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucgggggaguguuuaccucuaucggcaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccuggcugaaaaugagguuaagcugacaauuaugaccggagauaucaaaggcauuaugcaagccgggaagcggagccuuagaccucagcccacagaacucaaauacuccuggaagaccuggggaaaggcgaaaaugcugagcacggagucucauaaccagaccuuccugaucgacggcccugaaacagccgagugccccaauaccaaccgcgcuuggaacucccucgagguggaagauuauggguuuggagucuucacaaccaacauuuggcugaaacuuaaagagaagcaggacgccuuuugugacagcaaacugaugucugcugccaucaaggauaaucgggcggugcacgccgacaugggcuacuggaucgaauccgcucucaacgauacauggaagauugagaaagccagcuucaucgagguuaagaauugccauuggccuaaaucucacacccuguggagcaacggcgugcuggaauccgagaugauuauccccaagaaccuugcugggccggucagccaacacaauuauagaccuggauaccauacgcagauugccggccccuggcaccucgggaaacuggaaauggacuucgauuuuugugacggaacaaccgugguggucaccgaggauugcggcaaccgcgggcccucucugcggacaaccacggccuccggaaagcucaucacagaauggugcuguagaagcugcacccugccuccgcuucgguaccgcggcgaggacggcuguugguaugggauggagauuagaccccugaaggaaaaagaggaaaaucucguuaacucccuggugacagcuggacauggccagguggauaauuucucucuggggguccuuggaauggcgcucuuucuggaggaaaugcugcggaccagagugggcacaaagcacgccauccuccugguugcugugagcuucgucacccuuaucacggggaacauguccuuuaaagaccugggacgcgugguugugauggucggcgccaccaugacagaugacauuggcaugggggugaccuaccucgcccugcuggcugccuucaagguucggccuacauuugcggcuggacuucugcucagaaaacugaccucuaaggagcucaugaugacgacaaucggcauugugcugcuuagccaauccaccauccccgagacaauucuggaacucaccgaugcccuggcccuggggaugaugguccuuaagaucgugcgcaauauggagaaauaucagcuggcugugaccaucauggccauucucugcgucccuaacgcgguuauccugcagaaugcuuggaaggugucuuguacaauucucgccguggucagcgugagcccccugauccuuacgagcucucagcagaagaccgacuggauuccucuggcccucacaaucaagggacugaaccccaccgcuaucuuccugacaacccuuuccagaacgaauaaaaagcggagcuggccgcugaacgaagccauuauggcuguuggcauggugucuauccucgccuccagccugcucaaaaaugacauuccuaugacagggccccuggucgcgggaggccuucugaccgugugcuacguucugaccggccgcucugccgaucucgagcuggaaagagcuacagacgugaagugggaggaucaggccgagaucuccgggagcuccccuagccuuucuauuaccaucagcgaagacggauccaugucuauuaagaacgaggaagaggagcagacacugacgauccucauccggaccggccugcucgucauuagcgggcuguuucccguguccaucccgauuacagcugccgccugguaucuuugggaagucaaaaagcagcgcgcuggagugcugugggauguuccuucucccccucccaugggcaaagcggagcuggaagacggggccuacagaaucaagcaaaaaggcauucugggauauagccagaucggcgcugggguguacaaggagggaaccuuccauacaauguggcacgucacccggggcgccgugcugaugcacaaggggaaacgcaucgaacccuccugggccgauguuaagaaagaccuuauuucuuacggaggcggguggaagcuggagggagaguggaaagaaggcgaggaagugcagguccucgcucuggagccuggcaagaauccgagagccgugcagacgaagcccgggcucuuuaaaaccaacacaggaaccaucggcgcggugagccuggauuucuccccugggacaagcggaucucccauuaucgacaagaaaggcaagguugucgggcuuuauggaaacggcguggugacccgguccggcgcuuacgucagcgccauugcccaaacagaaaaaucuaucgaggauaauccugagaucgaagacgauauuuuucgcaagagacggcugacgaucauggaccugcaucccggggcuggaaagaccaaaagauaucucccugccauugugcgcgaggcgaucaagcggggccugagaacacuuauucuggcuccgacccgcguuguggccgccgaaauggaggaagcucuccgggggcugcccaucagauaccagaccccugccauucgcgcugagcacacaggacgggagaucgucgaccucaugugucaugccacguucaccaugagacugcuuucccccgugcgcguuccuaacuauaaucugaucauuauggaugaagcgcacuucacagaccccgccagcaucgcugcccggggcuacauuuccaccagaguggagaugggggaagcugccggcaucuuuaugacagccaccccgccuggaucucgggaucccuucccccagagcaacgcuccuauuaucgacgaggagcgcgaaauccccgagagauccuggaauagcggccaugaaugggucacggauuuuaaagggaagacagugugguucguuccuucuauuaaagcgggaaacgacaucgccgcuugccugcggaagaauggcaagaaagugauucaacucucccgcaagaccuuugauagcgaguaugucaaaaccagaacaaacgacugggauuucguggugaccacagacaucucugaaaugggggccaauuuuaaggccgagcgggucauugauccgagacgcuguaugaaacccguuauccugaccgacggagaggaacgggugauccuugcuggcccuaugcccgugacgcacagcuccgccgcgcagagacgcgggcggauuggcagaaacccuaagaaugagaacgaccaguacaucuacaugggagaaccccuggagaaugaugaagacugcgcucacuggaaagaggccaagaugcuccuggauaacauuaauacaccggagggcaucauuccuucuauguucgaacccgagcgcgaaaaggucgacgccaucgauggggaguaucggcugagaggagaagcucgcaaaaccuuuguggaccucaugagacggggcgaucuuccuguuuggcuggccuacaagguggcggccgaggggauuaacuaugcugaccgcagaugguguuucgauggaaucaaaaacaaucagauccuggaggaaaacgucgagguggaaauuuggacaaaggagggcgagcggaaaaagcucaagccccgcuggcuggacgccagaaucuacagcgauccucuugcucugaaagaauuuaaggaguucgccgcugggcggaaaucccucgcccugaaucugauuaccgaaaugggcagacuccccacguucaugacccaaaagacacgcgacgcgcuugauaaccuggccguucugcauaccgcugaggccggaggccgggcuuauaaucacgcccucucugaacugccggagacacuugagacccugcuccugcugacacuccuugccaccgugacagggggaaucuuucuguuccugaugagcggcagagggauuggaaaaaugacacucggcaugugcugcaucaucaccgcuuccauucugcuuugguacgcgcagauccagccucauuggauugccgcuagcaucauucuggucuuuuuccucaucgugcugcugauccccgaacccgagaagcagcgcaccccucaagacaaccagcucacauaugucgugauugccauccuuaccguuguggccgcuacaauggccaaugaaaugggcuuucuggagaagacgaaaaaggaccugggguucggaucuauugcgacccagcagccggaauccaacauccucgauauugaccugcggcccgccagcgcuuggacacuuuacgccguggcuaccacauuugucaccccuaugcugagacacuccaucgaaaauucuagcguuaacgugucccucacggccauugcgaaucaagccaccgugcugaugggccuggggaaaggauggccccucucuaagauggauaucggcgucccucuucuggcuaucggguguuacagccaggugaaccccauuacacugaccgccgcucuccugcuucugguugcccacuaugcuaucauuggaccuggccuccaggccaaagcgacacgggaggcccagaagcgcgcugccgcuggcaucaugaagaauccgaccguggacgggauuacggucaucgaucuggaccccaucccuuacgaucccaaauucgaaaagcaacugggacaggugaugcuccuuguccugugcgugacacagguucugaugaugagaaccacaugggcccucugugaggcccugacccuugcgaccggcccuauuuccacacugugggaagggaaccccggacgguuuuggaauacgaccaucgcugugagcauggccaacauuuuccgcggcucuuaucucgcuggggccggacugcuguuuuccaucaugaaaaauacaaccaacacaagacggggcaccggcaacauuggggagacgcucggagaaaaguggaaaagccgccuuaaugcccugggcaagucugaguuccaaaucuacaaaaaguccgggauccaggaggucgacagaacacuggcuaaggaaggaauuaaacggggcgagaccgaucaucacgccgugagccgcgggucugcgaagcucagaugguuuguugaacggaacauggugaccccggagggaaaagucguggaccugggcugcggcagagggggauggagcuauuacuguggcgggcuuaagaaugugcgcgagguuaaaggacugacaaagggcgggccuggacaugaggagcccauccccauguccaccuauggcuggaaccucguccggcugcagucuggcguggauguguucuucacaccucccgaaaagugcgacacgcugcucugugauauuggggagagcuccccuaauccgaccgucgaagccggaagaacacuucgcguucugaaccugguggagaauuggcucaacaauaacacccaguuuugcaucaaagugcugaaucccuacaugccuagcgucauugagaagauggaagcccuucaacggaaauacggcggggcccuggugagaaacccccucucccgcaauucuacacacgagauguauuggguuagcaacgcuuccggaaauaucgugucuagcgucaacaugaucucccggaugcugauuaacagauucaccaugaagcauaaaaaggccacguacgaaccugacguggaccugggcucugggacccgcaauaucggaauugagagcgaaguucccaaccucgauaucauuggcaagcggaucgagaaaauuaagcaggagcacgaaacauccuggcacuaugaccaggaucauccguacaaaaccugggcguaucacggcagcuacgagacaaagcagaccgggucugccuccagcauggugaauggagucgugagacuucugacaaaaccuugggacgugcugcccaccgucacgcaaauggcuaugacagauaccaccccuuuuggccagcagcgcguuuucaaggaaaagguggacacacggacgcaggagcccaaagaagggaccaagaaacucaugaagaucacagccgaguggcuguggaaagagcuuggaaagaaaaagaccccuagaauguguacacgcgaagaguuuaccagaaaggugcggucuaacgcugcccugggcgcuaucuucacagaugaaaauaaauggaaguccgcccgcgaggcggucgaggacagcagauuuugggaacucguggauaaagagcggaaccugcaucuggaagggaagugcgagaccuguguuuauaauaugaugggaaaaagagaaaagaagcucggcgaguucggcaaagccaaggggucucgggcuauuugguacauguggcugggagcccgcuuucuugaguucgaagcucugggcuuucucaacgaggaccacugguucuccagagaaaauagccuguccgggguggagggagaaggccuucacaaacugggguacauccuccgggaugucagcaagaaagagggcggagccauguaugccgacgacacggcgggcugggauacccgcauuacacuggaggaccugaagaacgaagagauggugaccaaucauauggaaggggagcacaagaaacucgcugaagccaucuuuaagcugacauaccaaaacaaaguugugagaguccagcggcccaccccgcgcggaacggugauggauauuaucucuagacgggaccagcgcggcagcgggcaaguuggaacauauggccuuaauaccuucacaaacauggaggcccagcugaucagacagauggagggggaaggcguguucaagaauauucagcaucucaccgcuacggaggaaaucgccguccaaaacugccuggcucggcuuggacgcgagagacugucccggauggccauuucuggcgaugacugcguggucaaaccucucgaugaccgcuuugcgagcgcccugaccgcucugaacgauauggggaagaucagaaaggacauucagcagugggagcccucccggggauggaaugauuggacacaggugcccuucuguucucaccauuuucacgaacucaucaugaaagacggcagaguucugguggucccuugccgcaaccaagaugagcuuaucgggcgggccagaauuagccagggagcuggcuggucccugcgcgaaaccgccugucucgggaagucuuacgcgcagauguggagccugauguauuuccaccggagagaccuucgccuggccgcuaaugccaucugcuccgcugugccgagccauugggugcccacaucucggaccacaugguccauucacgccaaacaugaguggaugaccacggaagacaugcucacaguuuggaacagaguguggauccaggagaauccuuggauggaggauaagacccccgucgaaagcugggaggaaauuccuuaccugggcaaacgcgaggaccaaugguguggaucucugaucggccucaccucccgggcuacaugggccaagaacauucaggcggccaucaaucaggugagaagccugaucgggaacgaagaguauaccgauuacaugcccuccaugaagcgcuuucggagagaggaagaggaagcuggaguucuuugguga

SEQ ID NO: 20341 - RNA, 9876 nt, Artificial Sequence
  derived and/or modified CDS sequence (opt5) from DENV-2__AF169681__SS-prME
uccgccggcaugaucauuaugcugauccccaccgugauggcuuuccaccucacgacgagaaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucgggggaguguuuaccucuaucggcaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccuggcugaaaaugagguuaagcugacaauuaugaccggagauaucaaaggcauuaugcaagccgggaagcggagccuuagaccucagcccacagaacucaaauacuccuggaagaccuggggaaaggcgaaaaugcugagcacggagucucauaaccagaccuuccugaucgacggcccuaagacagccgaaugccccaauaccaaccgcgcuuggaacucccucgagguggaggauuauggguuuggagucuucacaaccaacauuuggcugaaacuuaaggaaaaacaggacgcccugugugacagcaagcucaugucugcugccaucaaggauaaucgggcggugcacgccgacaugggcuacuggaucgaguccgcucugaacgauacauggaaaauugaaaaggccagcuuuaucgagguuaaaaauugccauuggccuaagucucacacccuguggagcaacggcgugcuugaguccgaaaugauuauccccaaaaaccucgcugggccggucagccaacacaauuauagaccuggauaccauacgcagauugccggccccuggcaccuggggaagcuggagauggacuucgauuucugugacggaacaaccgugguggucaccgaagauugcggcaaccgcgggcccucucuccggacaaccacggccuccggaaagcugaucacagaguggugcuguagaagcugcacccuuccuccgcugcgguaccgcggcgaagacggcuguugguaugggauggagauuagaccccucaaagagaaggaagagaaucugguuaacucccuggugacagcuggacauggccagguggauaauuuuucucuugggguccucggaauggcgcuguuccuggaagagaugcuccggaccagagugggcacaaaacacgccauccugcuuguugcugugagcuuugucacccugaucacggggaacauguccuucaaggaccucggacgcgugguugugauggucggcgccaccaugacagaugacauuggcaugggggugaccuaccuggcccugcuugcugccuuuaaaguucggccuacauucgcggcuggacugcuccugagaaagcucaccucuaaggaacugaugaugacgacaaucggcauugugcuucugagccaauccaccauccccgagacaauucucgagcugaccgaugcccuggcccuugggaugaugguccugaaaaucgugcgcaauauggaaaaguaucagcucgcugugaccaucauggccauucugugcgucccuaacgcgguuauccuccagaaugcuuggaaagugucuuguacaauucuggccguggucagcgugagcccccuuauccugacgagcucucagcaaaagaccgacuggauuccucucgcccugacaaucaaaggacugaaccccaccgcuaucuuucuuacaacccuguccagaacgaauaagaaacggagcuggccgcucaacgaggccauuauggcuguuggcauggugucuauccuggccuccagccuccugaagaaugacauuccuaugacagggccccuugucgcgggaggccugcugaccgugugcuacguucucaccggccgcucugccgaucuggaacuugagagagcuacagacgugaagugggaaaaccaggccgagaucuccgggagcuccccuauucugagcaucaccauuucugaggauggaagcauguccaucaaaaaugaagaggaagaacagacacucacgauccugauucggaccggccuccuggucaucucugggcuuuuccccgugagcauuccgaucacagcugccgccugguaucugugggaggucaagaaacagcgcgcuggagugcugugggacguuccuucucccccucccaugggcaaggcggaacucgaggauggggccuacagaauuaaacaaaagggaauccugggcuauagccagaucggcgcugggguguacaaggaaggaaccuuucauacaauguggcacgucacccggggcgccgugcuuaugcacaaagggaagcgcauugagcccagcugggccgacguuaaaaaggaucugaucuccuacggaggcggguggaaacucgaaggagaguggaaggagggcgaagaggugcagguccuggcucucgaaccuggcaagaacccgagagccgugcagacgaaacccgggcuguucaagaccaacacaggaaccauuggcgcggugucucuugacuuuagcccugggacauccggaagccccaucauugauaaaaagggcaaaguugucgggcuguauggaaauggcguggugacccggucuggcgcuuacgucuccgccaucgcccaaacagaaaaguccaucgaagacaacccugagauugaggaugacaucuuccgcaagagacggcugacgauuauggaucuccaucccggggcuggaaaaaccaagagauaucugccugccaucgugcgcgaagcgauuaaacggggccuuagaacacugauccucgcuccgacccgcguuguggccgccgagauggaagaggcucugcgggggcuccccauuagauaccagaccccugccauccgcgcugaacacacaggacgggagaucgucgaccugaugugucaugccacguuuaccaugagacuucugucucccgugcgcguuccuaauuauaaccugauuaucauggacgaggcgcacuucacagaucccgccuccauugcugcccggggcuacaucagcaccagaguggaaaugggggaggcugccggcauuuucaugacagccaccccgccuggaucccgggaccccuuuccccagucuaaugcuccuaucaucgaugaggaacgcgagauucccgaaagaagcuggaacuccggccaugagugggucacggacuucaaggggaaaacagugugguuuguuccuagcaucaaggcgggaaaugauauugccgcuugccuccggaagaacggcaaaaaggugauccaacugucucgcaaaaccuucgacuccgaauaugucaagaccagaacaaaugauugggacuuuguggugaccacagauauuagcgagaugggggccaacuucaaagccgaacgggucaucgacccgagacgcuguaugaagcccguuauccuuaccgauggagaggagcgggugauucuggcuggcccuaugcccgugacgcacucuagcgccgcgcagagacgcgggcggaucggcagaaauccuaaaaacgaaaaugaccaguacauuuacaugggagagccccucgaaaacgacgaggauugcgcucacuggaaggaagccaagaugcugcuggacaauaucaacacaccggagggcauuaucccuuccauguuugagcccgaacgcgagaaagucgaugccauugacggggaauaucggcucagaggagaggcucgcaagaccuucguggaucuuaugagacggggcgaccugccuguuuggcuggccuacaaaguggcggccgaagggaucaacuaugcugaucgcagaugguguuuugacggaaucaagaauaaccagauucucgaggagaaugucgaaguggagaucuggacaaaagaaggcgagcggaagaagcugaaaccccgcuggcuugaugccagaauuuacucugacccucuggcucucaaggaguucaaagaauuugccgcugggagaaagagccuggcccugaaccucaucaccgagaugggccggcuucccacguucaugacccagaagacccgcgaugcgcuggacaaucuggccguucuccauaccgcugaagccggaggccgggcuuauaaccacgcccuguccgagcuuccggaaacacuggagacccuccugcugcucacacuucuggccaccgugacagggggaauuuuccuguuucucaugucuggcagagggaucggaaagaugacacugggcaugugcugcaucauuaccgcuagcauccuucugugguacgcgcagauucagccucauuggaucgccgcuuccauuauccucgucuucuuucugaucgugcugcucauucccgagcccgaaaagcagcgcaccccucaagauaaucagcuuacauaugucgugaucgccauucugaccguuguggccgcuacaauggccaacgagaugggcuuccuggagaaaacgaagaaagaccucggguuuggaagcaucgcgacccagcagccggagucuaauauucuggacaucgaucuucggcccgccuccgcuuggacacuguacgccguggcuaccacauucgucaccccuaugcucagacacagcauugaaaacuccucuguuaaugugagccugacggccaucgcgaaccaagccaccgugcugaugggccucgggaagggauggccccuuuccaaaauggacaucggcgucccucugcuggcuauuggguguuacucucaggugaaucccaucacacucaccgccgcucugcuucugcucguugcccacuaugcuauuaucggaccuggccugcaggccaaggcgacacgggaggcccagaagcgcgcugccgcuggcauuaugaaaaacccgaccguggaugggaucacggucaucgaccuggaucccauuccuuacgaccccaaguuugagaaacaacucggacaggugaugcuucugguccugugcgugacacagguucucaugaugagaaccacaugggcccugugugaagcccuuacccuggcgaccggcccuaucagcacacucugggaggggaaucccggacgguucuggaacacgaccauugcuguguccauggccaauaucuuucgcggcagcuaucuggcuggggccggacugcuguucucuauuaugaagaacacaaccaacacaagacggggcaccggcaauaucggggaaacgcuuggagagaaauggaagucccgccugaacgcccugggcaaaagcgaauuucaaaucuacaagaagucugggauucaggaggucgauagaacacucgcuaaagagggaaucaagcggggcgaaaccgaccaucacgccgugucccgcgggagcgcgaaacugagaugguucguugagcggaauauggugaccccggaaggaaaggucguggaucuuggcugcggcagagggggauggucuuauuacuguggcgggcugaaaaacgugcgcgagguuaagggacucacaaagggcgggccuggacaugaggaacccauucccaugagcaccuauggcuggaaucugguccggcugcaguccggcguggacguguuuuucaucccucccgagaaaugcgauacacuccuuugugacauuggggaaucuagcccuaacccgacggucgaggccggaagaacccugcgcguucugaaucucguggaaaacuggcugaauaacaauacacaguucugcaucaaggugcuuaaccccuacaugccuuccgucaucgagaaaauggaggcucugcaacggaaguacggcggggcccucgugagaaauccccugagccgcaacuccacccacgaaauguauuggguuucuaaugcuagcggaaacauuguguccucugucaacaugaucagccggaugcugauuaauagauuuacaaugcgccauaaaaaggccaccuacgagccugauguggaccucggcuccgggacgcggaacaucggaauugaaucugagauccccaaucuugacauuaucggcaagagaaucgagaaaauuaagcaggagcacgagaccagcuggcacuaugaucaggaccauccguacaaaacaugggcguaucacggcuccuacgaaaccaagcagacagggagcgccucuuccaugguuaacggagugguccgccugcugaccaaaccuugggaugugcuccccacagugacccaaauggcuaugacggacacaaccccuuucggccagcagcgggucuuuaaggagaagguugauaccagaacacaggaacccaaagaggggacgaagaaacugaugaagaucaccgccgaauggcuuuggaaagagcugggaaagaaaaagacaccucgcauguguaccagagaggaguucacacggaaggugcgcagcaaugcugcccucggcgcuauuuuuaccgacgagaacaaauggaagucugccagagaagcgguggaggauucccgguucugggagcuggucgacaaagaaagaaaucugcaucucgaggggaagugcgaaacauguguguauaacaugaugggaaaacgggagaagaagcugggcgaauuuggcaaagccaaggggagccgcgcuaucugguacauguggcuuggagccagauuccuggaguuugaggcucucggcuuccugaaugaagaucacugguuuucucgggagaacucccuuagcgggguugaaggagagggccugcacaaacuccgcuacauucugagagacguguccaagaaagaagggggcgccauguaugccgaugacaccgcgggaugggacacgcggaucacccuggaggaucucaagaaugaggaaauggucacaaaccauauggagggcgaacacaagaaacuggcugaggccaucuucaaacuuaccuaccaaaauaaagugguucgcgugcagagacccacaccgcgggggaccgucauggacauuaucagccgcagagaucagcggggaucuggccaaguggggacguauggacugaacacauuuaccaauauggaagcccagcucauucgccagauggagggcgaggggguuuucaagaacauccagcaucugacagcuaccgaagagauugccgugcaaaacuggcuugcuagagucggccgggaacgccugagcagaauggccaucuccggagacgauugcguggucaaaccucucgacgaucgguucgcgucugcccugacggcucugaaugacaugggcaagaucagaaaggauauucagcagugggagcccagccgcggguggaacgacuggacccaggugcccuuuugcucccaccauuuccacgagcucaucaugaaagauggacggguucugguggucccuuguagaaaucaagacgaacuuauuggccgcgcccggaucucucagggggcuggauggagccugagagagacagccugccucggcaaguccuacgcgcagauguggucucugauguauuuucaccgccgggaucuuagacuggccgcuaacgccauuuguagcgcugugccgucccauugggugcccaccagccgcacaaccuggucuauccacgccaaacaugaauggaugacaaccgaggacaugcucacgguuuggaaucggguguggauucaggaaaacccuuggauggaggacaagacacccgucgaguccugggaagagaucccuuaccuggggaaaagagaagaucaauggugcggcagccugaucggacucaccucucgcgcuaccugggccaagaauauucaggcggccaucaaccaggugcggucccugauuggcaaugaggaauauacagacuacaugcccagcaugaagagauuccggagagaggaggaagaggcugggguucuuugguga

SEQ ID NO: 20342 - RNA, 9876 nt, Artificial Sequence
  derived and/or modified CDS sequence (opt5) from DENV-2__AF169683__SS-prME
agcgccggaaugaucauuaugcugauccccaccgugauggcuuuccaccugaccacgagaaauggggaaccucauaugauugucuccauccaggaaaagggaaaaucucugcuuuuuaagaccgaggacggcguuaauaugugcacgcugauggccauggaucucggggaacugugugaggacaccauuacauacaaaugcccgcuucugcggcaaaaugaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaggacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucgggggaguguuuaccucuaucggcaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccuggcugaaaaugagguuaagcugacaauuaugaccggagauaucaaaggcauuaugcaugccgggaagcggagccuuagaccucaacccacagaacucaaauacuccuggaagaccuggggaaaggcgaaaaugcugagcacggagucucacaaccagaccuuccugaucgacggcccugaaacagccgagugccccaauaccaaccgcgcuuggaacucccucgagguggaagauuauggguuuggagucuucacaaccaacauuuggcugaaacuuaaagagaagcaggacgccuuuugugacagcaaacugaugucugcugccaucaaggauaaucgggcggugcaugccgacaugggcuacuggaucgaauccgcucucaacgauacauggaagauugagaaagccagcuucaucgagguuaagaauugccacuggccuaaaucucacacccuguggagcaacggcgugcuggaauccgagaugauuauccccaagaaccuugcugggccggucagccagcauaauuauagaccuggauaccacacgcaaauugccggccccuggcaucucgggaaacuggaaauggacuucgauuuuugugacggaacaaccgugguggucaccgaggauugcggcaaccgcgggcccucucugcggacaaccacggccuccggaaagcucaucacagaauggugcuguagaagcugcacccugccuccgcuucgguaccgcggcgaggacggcuguugguaugggauggagauuagaccccugaaggaaaaagaggaaaaucucguuaacucccuggugacagcuggacacggccagguggauaauuucucucuggggguccuuggaauggcgcucuuucuggaggaaaugcugcggaccagagugggcacaaagcaugccauccuccugguugcugugagcuucgucacccuuaucacggggaacauguccuuuaaagaccugggacgcgugguugugauggucggcgccaccaugacagaugacauuggcaugggggugaccuaccucgcccugcuggcugccuucaagguucggccuacauuugcggcuggacuucugcucagaaaacugaccucuaaggagcucaugaugacgacaaucggcauugugcugcuuagccaguccaccauccccgagacaauucuggaacucaccgaugcccuggcccuggggaugaugguccuuaagaucgugcgcaauauggagaaauaucaacuggcugugaccaucauggccauucucugcgucccuaacgcgguuauccugcagaaugcuuggaaggugucuuguacaauucucgccguggucagcgugagcccccugauccuuacgagcucucagcagaaaaccgacuggauuccucuggcccucacaaucaagggacugaaccccaccgcuaucuuccugacaacccuuuccagaacgaauaaaaagcggagcuggccgcugaacgaagccauuauggcuguuggcauggugucuauccucgccuccagccugcucaaaaaugacauuccuaugacagggccccuggucgcgggaggccuucugaccgugugcuacguucugaccggccgcucugccgaucucgagcuggaaagagcuacagacgugaagugggaggaucaagccgagaucuccgggagcuccccuauucuuagcaucaccauuucugaagacggaagcauguccaucaagaacgaggaagaggagcagacacugacgauccucauucggaccggccugcucgucaucucugggcuguuucccgugagcauuccgaucacagcugccgccugguaucuuugggaagucaaaaagcagcgcgcuggagugcugugggauguuccuucucccccucccaugggcaaagcggagcuggaagacggggccuacagaauuaagcagaaaggaauccucggcuauagccaaaucggcgcugggguguacaaggagggaaccuuccacacaauguggcacgucacccggggcgccgugcugaugcauaaggggaaacgcauugaacccagcugggccgauguuaagaaagaccuuaucuccuacggaggcggguggaagcuggagggagaguggaaagaaggcgaggaagugcagguccucgcucuggagccuggcaagaauccgagagccgugcagacgaagcccgggcucuuuaaaaccaacacaggaaccauuggcgcggugucucuggauuucagcccugggacauccggaagccccaucauugacaagaaaggcaagguugucgggcuuuauggaaacggcguggugacccggucuggcgcuuacgucuccgccaucgcccagacagagaaguccaucgaggauaauccugagauugaagacgauaucuuucgcaagagacggcugacgauuauggaccugcaccccggggcuggaaagaccaaaagauaucucccugccaucgugcgcgaggcgauuaagcggggccugagaacacuuauccuggcuccgacccgcguuguggccgccgaaauggaggaagcucuccgggggcugcccauuagauaccaaaccccugccauccgcgcugagcauacaggacgggagaucgucgaccucaugugucacgccacguucaccaugagacugcuuucucccgugcgcguuccuaacuauaaucugauuaucauggaugaagcgcauuucacagaccccgccuccauugcugcccggggcuacaucagcaccagaguggagaugggggaagcugccggcauuuuuaugacagccaccccgccuggaucccgggaucccuucccccagucuaacgcuccuaucaucgacgaggagcgcgaaauucccgagagaagcuggaacuccggccacgaaugggucacggauuuuaaagggaagacagugugguucguuccuagcaucaaagcgggaaacgacauugccgcuugccugcggaagaauggcaagaaagugauccagcucucucgcaagaccuuugauuccgaguaugucaaaaccagaacaaacgacugggauuucguggugaccacagacauuagcgaaaugggggccaauuuuaaggccgagcgggucaucgauccgagacgcuguaugaaacccguuauccugaccgacggagaggaacgggugauucuugcuggcccuaugcccgugacgcacuucucugccgcgcaaagacgcgggcggaucggcagaaacccuaagaaugagaacgaccaguacauuuacaugggagaaccccuggagaaugaugaagacugcgcucauuggaaagaggccaagaugcuccuggauaacaucaauacaccggagggcauuaucccuagcauguuugaacccgagcgcgaaaaggucgacgccauugauggggaguaucggcugagaggagaagcucgcaaaaccuucguggaccucaugagacggggcgaucuuccuguuuggcuggccuacaagguggcggccgaggggaucaacuaugcugaccgcagaugguguuuugauggaaucaaaaacaaucagauucuggaggaaaacgucgagguggaaaucuggacaaaggagggcgagcggaaaaagcucaagccccgcuggcuggacgccagaauuuacuccgauccucuugcucugaaagaguucaaggaguucgccgcugggcggaaaucucucgcccugaaucugaucaccgaaaugggcagacuccccacguuuaugacccagaagacacgcgacgcgcuugauaaccuggccguucugcacaccgcugaggccggaggccgggcuuauaaucaugcccucagcgaacugccggagacacuugagacccugcuccugcugacacuccuugccaccgugacagggggaauuuuccuguuucugauguccggcagagggaucggaaaaaugacacucggcaugugcugcaucauuaccgcuucuauccugcuuugguacgcgcaaauucagccucacuggaucgccgcuagcauuauccuggucuucuuucucaucgugcugcugauucccgaacccgagaagcagcgcaccccucaggacaaccaacucacauaugucgugaucgccauucuuaccguuguggccgcuacaauggccaaugaaaugggcuuccuggagaagacgaaaaaggaccugggguuuggauccaucgcgacccagcagccggaaagcaacauucucgauaucgaccugcggcccgccucugcuuggacacuuuacgccguggcuaccacauucgucaccccuaugcugagacacuccauugagaauagcuccguuaacgugucucucacggccaucgcgaaucaggccaccgugcugaugggccuggggaaaggauggccccucagcaagauggauaucggcgucccucuucuggcuauuggguguuacucccaagugaaccccaucacacugaccgccgcucuccugcuucugguugcccauuaugcuauuaucggaccuggccuccaggccaaagcgacacgggaggcccagaagcgcgcugccgcuggcauuaugaagaauccgaccguggacgggaucacggucaucgaucuggaccccauuccuuacgaucccaaauuugaaaagcagcugggacaagugaugcuccuuguccugugcgugacacagguucugaugaugagaaccacaugggcccucugugaggcccugacccuugcgaccggcccuaucucuacacugugggaagggaaccccggacgguucuggaauacgaccauugcugugagcauggccaacaucuuucgcggcuccuaucucgcuggggccggacugcuguucagcauuaugaaaaauacaaccaacacaagacggggcaccggcaacaucggggagacgcucggagaaaaguggaaaucucgccuuaaugcccugggcaaguccgagagccagaucuacaaaaagucugggauucaagaggucgacagaacacuggcuaaggaaggaaucaaacggggcgagaccgaucaccaugccgugucccgcgggagcgcgaagcucagaugguuuguugaacggaacauggugaccccggagggaaaagucguggaccugggcugcggcagagggggauggucuuauuacuguggcgggauuaagaaugugcgcgagguuaaaggacuuacaaagggcgggccuggacacgaagaacccauccccaugagcaccuauggcuggaaccugguccggcuccaguccggcguggauguguucuucauuccucccgaaaagugcgacacacugcugugugauaucggggagucuagcccuaauccgacggucgaagccggaagaacccuccgcguucuuaaccugguggagaauuggcugaacaauaacacacaguuuugcaucaaagugcucaaucccuacaugccuuccgucauugagaagauggaagcucugcagcggaaauacggcggggcccuugugagaaacccccugagccgcaauuccacccaugagauguauuggguuucuaacgcuagcggaaauaucguguccucugucaacaugauuagccggaugcucaucaacagauucacaaugcgccacaagaaagccaccuacgaaccugacguggaccugggcuccgggacgcggaauauuggaaucgagucugaaauucccaaccuggauaucaucggcaagagaauugagaagaucaaacaagagcacgaaaccagcuggcauuaugaccaggaucacccguacaagacaugggcguaucauggcuccuacgagaccaaacagacagggagcgccucuuccaugguuaauggagugguccgccuccuuaccaagccuugggacgugcugcccacagugacccagauggcuaugacggauacaaccccuuuuggccaacagcgggucuucaaagaaaagguugacaccagaacacaggagcccaaggaagggacgaaaaagcugaugaaaauuaccgccgaguggcucuggaaggagcugggcaaaaagaaaacaccucgcauguguaccagagaagaguuuacacggaaggugcgcagcaacgcugcccuuggcgcuaucuucaccgaugaaaauaaguggaaaucugccagagaggcgguggaggacucccgguuuugggaacuggucgauaaggagagaaaccuccaccuggaagggaaaugcgagacauguguguauaauaugaugggaaagcgggagaaaaagcugggcgaguucggcaaggccaaagggagccgcgcuauuugguacauguggcucggagccagauuucuggaguucgaagcucuuggcuuucugaacgaggaccacugguucucucgggaaaauucccucagcgggcuggagggagaaggccuucauaagcugggguacauccuccgcgauguuuccaaaaaggagggcggagccauguaugccgacgacaccgcgggcugggauacgagaaucacccuggaggaccugaaaaacgaagagauggugacaaaucacauggaaggggagcauaagaagcucgcugaagccauuuuuaaacugaccuaccagaacaaggucgugcggguucaacgccccacaccgagaggaaccgugauggauaucauuagccggcgcgaccagagaggcucugggcaggucggaacguauggccuuaauacauucaccaacauggaggcccaacugauccggcagauggagggggaaggcguguucaaaaauauucagcaccucacagcuaccgaggaaaucgccguucagaacuggcuggcucgcgugggaagagagcggcuuagccgcauggccaucuccggcgaugacugcgucgugaagccucuggaugacagauuugcgucugcccucacggcucugaacgauauggggaaaauucggaaggacauccaacagugggagcccagcagaggauggaaugauuggacccagguccccuucugcucccaucacuuucacgaacugauuaugaaggacggccgcgugcucguugugccuugucggaaccaggaugagcugaucgggagagcccgcauuucucaaggagcuggcuggagccuucgggaaacagccugccuggggaaauccuacgcgcagauguggucucucauguauuuccauagacgcgaccugcggcuugccgcuaaugccaucuguagcgcugucccgucccacugggugcccaccagcagaacaaccuggucuauucaugccaagcacgaguggaugacaaccgaagacaugcugacgguguggaaccgcguuuggauccaggagaauccuuggauggaggauaaaacacccguggaauccugggaggaaaucccuuaccucggcaagcgggaggaccaguggugcggaagccugauuggccugaccucuagagcuaccugggccaaaaacauccaagcggccauuaaucagguccgcucccucaucgggaacgaagaguauacagauuacaugcccagcaugaagcgguuuagacgggaggaagaggaagcuggagugcugugguga

SEQ ID NO: 20343 - RNA, 9876 nt, Artificial Sequence
  derived and/or modified CDS sequence (opt5) from DENV-2__AF169684__SS-prME
agcgcuggcaugaucauuaugcugauccccaccgugauggcuuuccaccugacaacgagaaauggggaaccucauaugauugucuccauccaggaaaagggaaaaucucugcuuuuuaagaccgaagacggcguuaauaugugcacacugauggccauggaucucggggaacugugugaagacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucgggggaguguuuaccucuaucggcaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccuggcugaaaaugagguuaagcugacaauuaugaccggagauaucaaaggcauuaugcaagccgggaagcggagccuuagaccucagcccacagaacucaaauacuccuggaagaccuggggaaaggcgaaaaugcugagcacggagucucauaaccagaccuuccugaucgacggcccugaaacagccgagugccccaauaccaaccgcgcuuggaacucccucgagguggaagauuauggguuuggagucuucacaaccaacauuuggcugaaacuuaaagagaagcaggacgccuuuugugacagcaaacugaugucugcugccaucaaggauaaucgggcggugcacgccgacaugggcuacuggaucgaauccgcucucaacgauacauggaagauugagaaagccagcuucaucgagguuaagaauugccauuggccuaaaucucacacccuguggagcaacggcgugcuggaauccgagaugauuauccccaagaaccuugcugggccggucagccaacacaauuauagaccuggauaccauacgcagauugccggccccuggcaccucgggaaacuggaaauggacuucgauuuuugugacggaacaaccgugguggucaccgaggauugcggcaaccgcgggcccucucugcggacaaccacggccuccggaaagcucaucacagaauggugcuguagaagcugcacccugccuccgcuucgguaccgcggcgaggacggcuguugguaugggauggagauuagaccccugaaggaaaaagaggaaaaucucguuaacucccuggugacagcuggacauggccagguggauaauuucucucuggggguccuuggaauggcgcucuuucuggaggaaaugcugcggaccagagugggcacaaagcacgccauccuccugguugcugugagcuucgucacccuuaucacggggaacauguccuuuaaagaccugggacgcgugguugugauggucggcgccaccaugacagaugacauuggcaugggggugaccuaccucgcccugcuggcugccuucaagguucggccuacauuugcggcuggacuucugcucagaaaacugaccucuaaggagcucaugaugacgacaaucggcauugugcugcuuagccaauccaccauccccgagacaauucuggaacucaccgaugcccuggcccuggggaugaugguccuuaagaucgugcgcaauauggagaaauaucagcuggcugugaccaucauggccauucucugcgucccuaacgcgguuauccugcagaaugcuuggaaggugucuuguacaauucucgccguggucagcgugagcccccugauccuuacgagcucucagcagaagaccgacuggauuccucuggcccucacaaucaagggacugaaccccaccgcuaucuuccugacaacccuuuccagaacgaauaaaaagcggagcuggccgcugaacgaagccauuauggcuguuggcauggugucuauccucgccuccagccugcucaaaaaugacauuccuaugacagggccccuggucgcgggaggccuucugaccgugugcuacguucugaccggccgcucugccgaucucgagcuggaaagagcuacagacgugaagugggaggaucaggccgagaucucccggagcuccccuauucuuagcaucaccauuucugaagacgggagcauguccaucaagaacgaggaagaggagcagacacugacgauccucauucgcaccggacugcucgucaucucuggccuguuucccgugagcauuccgaucacagcugccgccugguaucuuugggaagucaaaaagcagagagcuggggugcugugggauguuccuucucccccucccaugggaaaagcggagcuggaagacggcgccuaccggauuaagcaaaaagggauccucggauauagccagaucggcgcuggcguguacaaggaggggaccuuccauacaauguggcacgucacccgcggagccgugcugaugcacaagggcaaaagaauugaacccagcugggccgauguuaagaaagaccuuaucuccuacgggggaggcuggaagcuggagggggaguggaaagaaggagaggaagugcagguccucgcucuggagccuggcaagaauccgcgggccgugcagacgaagcccggccucuuuaaaaccaacacagggaccauuggagcggugucucuggauuucagcccuggcacauccgggagccccaucauugacaagaaaggaaagguugucggccuuuaugggaacggaguggugacccgcucuggcgcuuacgucuccgccaucgcccaaacagagaaauccaucgaggauaauccugagauugaagacgauaucuuuagaaagcggagacugacgauuauggaccugcaucccggcgcugggaagaccaaaaaguaucucccugccaucgugcgcgaggcgauuaaacggggacugagaacacuuauccuggcuccgacccgcguuguggccgccgaaauggaggaagcucuccggggccugcccauuagauaccagaccccugccauccgcgcugagcacacagggcgggagaucgucgaccucaugugucaugccacguucaccaugagacugcuuucucccgugcgcguuccuaacuauaaucugauuaucauggaugaagcgcacuucacagaccccgccuccauugcugcccggggauacaucagcaccagaguggagaugggcgaagcugccgggauuuuuaugacagccaccccgccuggcucccgggaucccuucccccagucuaacgcuccuaucaucgacgaggagcgcgaaauucccgagagaagcuggaacuccggacaugaaugggucacggauuuuaagggcaaaacagugugguucguuccuagcaucaaggcggggaacgacauugccgcuugccugcggaagaauggcaaaaaggugauccaacucucucgcaaaaccuuugauuccgaguaugucaagaccagaacaaacgacugggauuucguggugaccacagacauuagcgaaaugggcgccaauuuuaaagccgagcgggucaucgauccgagacgcuguaugaagcccguuauccugaccgacggggaggaacgggugauucuugcuggaccuaugcccgugacgcacuucucugccgcgcagagacgcggccggaucgggagaaacccuaaaaaugagaacgaccaguacauuuacaugggcgaaccccuggagaaugaugaagacugcgcucacuggaaggaggccaagaugcuccuggauaacaucaauacaccggagggaauuaucccuagcauguuugaacccgagcgcgaaaaagucgacgccauugauggcgaguaucggcugagaggggaagcucgcaagaccuucguggaccucaugagacggggagaucuuccuguuuggcuggccuacaaaguggcggccgagggcaucaacuaugcugaccgcagaugguguuuugaugggaucaagaacaaucagauucuggaggaaaacgucgagguggaaaucuggacaaaagagggagagcggaagaagcucaaaccccgcuggcuggacgccagaauuuacuccgauccucuugcucugaaggaguucaaagaguucgccgcuggccggaagucucucgcccugaaucugaucaccgaaauggggagacuccccacguuuaugacccagaaaacccgcgacgcgcuugauaaccuggccguucugcauaccgcugaggccggcggacgggcuuauaaucacgcccucagcgaacugccggagacacuugagacccugcuccugcugacacuccuugccaccgugacgggcgggauuuuccuguuucugauguccggaagaggcaucgggaagaugacacucggaaugugcugcaucauuaccgcuucuauccugcuuugguacgcgcagauucagccucauuggaucgccgcuagcauuauccuggaguucuuucucaucuuccugcugauucccgagcccgaaaagcagcgcaccccucaagacaaccagcucacauaugucgugaucgccauucuuaccgucguggccgcuacaauggccaaugagaugggcuuucuggagaaaacgaagaaagaccugggcuucggguccaucgcgacccagcagccggagagcaacauucucgauaucgaccugcggcccgccucugcuuggacacuuuacgccguugcuaccacauuugugaccccuaugcugagacacuccauugagaauagcuccgugaacgucucucucacggccaucgcgaaucaagccaccguucugaugggacugggcaagggguggccccucagcaaaauggauaucggagugccucuucuggcuauuggcuguuacucccaggugaaccccaucacacugaccgccgcucuccugcuucuggucgcccacuaugcuauuaucgggccuggacuccaggccaaggcgacacgggaagcccagaagcgcgcugccgcuggcauuaugaaaaauccgaccguggacggcaucacgguuaucgaucuggaccccauuccuuacgaucccaaguucgagaaacaacuggggcaagugaugcuccuuguccugugcgugacacagguccugaugaugagaaccacaugggcccucugugaagcccugacccuugcgaccggaccuaucucuacacugugggagggcaaccccgggcgguuuuggaauacgaccauugcugugagcauggccaacaucuuccgcggauccuaucucgcuggcgccgggcugcuguuuagcauuaugaagaauacaaccaacacaagacggggaaccggcaacaucggcgaaacgcucggggagaaauggaagucucgccuuaaugcccugggaaaauccgaguuccaaaucuacaaaaagagcggcauucaggaaguugacagaacacuggcuaaggaggggaucaagcggggagaaaccgaucaucacgccgugucucgcggcuccgcgaaacucagaugguucgucgagcggaacauggugaccccggaggggaagguuguggaccugggaugcggcagaggcggguggagcuauuacuguggaggccuuaaaaauguccgcgaagugaaggggcugacaaagggaggcccugggcaugaggaacccauucccaugucuaccuauggauggaaccucgugcggcugcagagcggcguugaugucuuuuucaucccucccgagaaaugcgacacacugcucugugauauuggcgaauccucuccuaauccgacgguggaggccgggagaacccuucgcgugcugaaccuggucgagaauuggcucaacaauaacacacaguuuugcaucaagguucugaaucccuacaugccuagcgugaucgagaaaauggaggcccuucaacggagauacggaggcgcccuggugcgcaacccccucucccggaauagcacccacgaaauguauugggucuccaacgcuucugggaauauugugagcuccguuaacaugaucucuagaaugcugauuaaccgcuucacaaugaagcauaaaaaggccaccuacgagccugacguggaccugggaagcggcacgcggaauaucgggauugaauccgagguccccaaccucgauaucauuggaaagagaaucgagaaaaucaagcaggaacacgagaccucuuggcacuaugaccaggaucauccguacaaaacaugggcguaucacggcagcuacgaaaccaagcagacaggcuccgccagcucuauggugaaugggguugugcgccuucugaccaaaccuugggacguccugcccacagugacccaaauggcuaugacggauacaaccccuuuuggacagcagcggguguucaaggagaaggucgacaccagaacacaggaacccaaagagggcacgaagaaacucaugaagauuaccgccgaguggcuguggaaagaacuugggaagaaaaagacaccucgcauguguaccagagaggaauuuacacggaagguucgcuccaacgcugcccugggagcuaucuucaccgaugagaauaaauggaaguccgccagagaggcgguggaagacucucgguuuugggagcucguggauaaagaaagaaaccugcaucuggagggcaagugcgaaacaugugucuauaauaugauggggaaacgggagaagaagcucggagaguucggcaaagccaagggcucccgcgcuauuugguacauguggcugggggccagauuucuugaguucgaggcucugggauuucucaacgaagaccacugguucagccgggaaaauucucuguccggcguggaaggggagggacuucacaaacugggcuacauccuccgcgauguuagcaagaaagaagggggagccauguaugccgacgacaccgcgggaugggauacgagaauuacccuggaagaccugaagaacgaggaaauggugacaaaucauauggagggcgaacacaagaaacucgcugaggccaucuucaagcugaccuaccaaaacaaagucgugcggguucagcgccccacaccgagagggaccgugauggauaucauuucccggcgcgaccagagaggaagcggccaagucgggacguauggacuuaauacauuuaccaacauggaggcccagcugauccggcagauggaaggcgaggggguguucaagaauauucagcaucucacagcuaccgaagagaucgccguucaaaacuggcuggcucgcgugggcagagagcggcuuucucgcauggccauuagcggagaugacugcgucgugaaaccucuggaugacagauuugcguccgcccucacggcucugaacgauaugggcaagauccggaaggacauccagcagugggaacccucuagaggguggaaugauuggacccagguccccuucugcagccaccauuuucacgagcugauuaugaaagacggacgcgugcucguugugccuugucggaaccaagaugaacugaucggcagagcccgcauuucccagggggcuggauggucucuucgggagacagccugccugggcaagagcuacgcgcagauguggucccucauguauuuccacagacgcgaccugcggcuugccgcuaaugccaucuguucugcugucccgagccauugggugcccaccuccagaacaaccuggagcauucacgccaaacaugaauggaugacaaccgaggacaugcugacgguguggaaccgcguuuggauccaggagaauccuuggauggaagauaagacacccguggagucuugggaagagauuccuuaccucgggaaacgggaagaccaauggugcggcucccugaucggacugaccagcagagcuaccugggccaagaacauccaggcggccauuaaucagguccgcucucucaucggcaacgaggaguauacagauuacaugcccuccaugaagcgguuuagacgggaagaggaagaggcuggggugcugugguga

SEQ ID NO: 20344 - RNA, 9876 nt, Artificial Sequence
  derived and/or modified CDS sequence (opt5) from DENV-2__AF169685__SS-prME
agcgcuggcaugaucauuaugcugauccccaccgugauggcuuuccaccugaccacgagaaauggggagccucauaugauugucuccauccaggaaaagggaaaaucucugcuuuuuaagaccgaggacggcguuaauaugugcacgcugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucgggggaguguuuaccucuaucggcaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccuggcugaaaaugagguuaagcugacaauuaugaccggagauaucaaaggcauuaugcaagccgggaagcggagccuuagaccucagcccacagaacucaaauacuccuggaagaccuggggaaaggcgaaaaugcugagcacggagucucauaaccagaccuuccugaucgacggcccugaaacagccgagugccccaauaccaaccgcgcuuggaacucccucgagguggaagauuauggguuuggagucuucacaaccaacauuuggcugaaacuuaaagagaagcaggacgccuuuugugacagcaaacugaugucugcugccaucaaggauaaucgggcggugcacgccgacaugggcuacuggaucgaauccgcucucaacgauacauggaagauugagaaagccagcuucaucgagguuaagaauugccauuggccuaaaucucacacccuguggagcaacggcgugcuggaauccgagaugauuauccccaagaaccuugcugggccggucagccaacacaauuauagaccuggauaccauacgcagauugccggccccuggcaccucgggaaacuggaaauggacuucgauuuuugugacggaacaaccgugguggucaccgaggauugcggcaaccgcgggcccucucugcggacaaccacggccuccggaaagcucaucacagaauggugcuguagaagcugcacccugccuccgcuucgguaccgcggcgaggacggcuguugguaugggauggagauuagaccccugaaggaaaaagaggaaaaucucguuaacucccuggugacagcuggacauggccagguggauaauuucucucuggggguccuuggaauggcgcucuuucuggaggaaaugcugcggaccagagugggcacaaagcacgccauccuccugguugcugugagcuucgucacccuuaucacggggaacauguccuuuaaagaccugggacgcgugguugugauggucggcgccaccaugacagaugacauuggcaugggggugaccuaccucgcccugcuggcugccuucaagguucggccuacauuugcggcuggacuucugcucagaaaacugaccucuaaggagcucaugaugacgacaaucggcauugugcugcuuagccaauccaccauccccgagacaauucuggaacucaccgaugcccuggcccuggggaugaugguccuuaagaucgugcgcaauauggagaaauaucagcuggcugugaccaucauggccauucucugcgucccuaacgcgguuauccugcagaaugcuuggaaggugucuuguacaauucucgccguggucagcgugagcccccugauccuuacgagcucucagcagaagaccgacuggauuccucuggcccucacaaucaagggacugaaccccaccgcuaucuuccugacaacccuuuccagaacgaauaaaaagcggagcuggccgcugaacgaagccauuauggcuguuggcauggugucuauccucgccuccagccugcucaaaaaugacauuccuaugacagggccccuggucgcgggaggccuucugaccgugugcuacguucugaccggccgcucugccgaucucgagcuggaaagagcuacagacgugaagugggaggaucaggccgagaucuccgggagcuccccuauucuuagcaucaccauuucugaagacggaagcauguccaucaagaacgaggaagaggagcagacacugacgauccucauucggaccggccugcucgucaucucugggcuguuucccgugagcauuccgaucacagcugccgccugguaucuuugggaagucaaaaagcagcgcgcuggagugcugugggauguuccuucucccccucccaugggcaaagcggagcuggaagacggggccuacagaauuaagcaaaaaggaauccucggcuauagccagaucggcgcugggguguacaaggagggaaccuuccauacaauguggcacgucacccggggcgccgugcugaugcacaaggggaaacgcauugaacccagcugggccgauguuaagaaagaccuuaucuccuacggaggcggguggaagcuggagggagaguggaaagaaggcgaggaagugcagguccucgcucuggagccuggcaagaauccgagagccgugcagacgaagcccgggcucuuuaaaaccaacacaggaaccauuggcgcggugucucuggauuucagcccugggacauccggaagccccaucauugacaagaaaggcaagguugucgggcuuuauggaaacggcguggugacccggucuggcgcuuacgucuccgccaucgcccaaacagagaaauccaucgaggauaauccugagauugaagacgauaucuuucgcaagagacggcugacgauuauggaccugcaucccggggcuggaaagaccaaaagauaucucccugccaucgugcgcgaggcgauuaagcggggccugagaacacuuauccuggcuccgacccgcguuguggccgccgaaauggaggaagcucuccgggggcugcccauuagauaccagaccccugccauccgcgcugagcacacaggacgggagaucgucgaccucaugugucaugccacguucaccaugagacugcuuucucccgugcgcguuccuaacuauaaucugauuaucauggaugaagcgcacuucacagaccccgccuccauugcugcccggggcuacaucagcaccagaguggagaugggggaagcugccggcauuuuuaugacagccaccccgccuggaucccgggaucccuucccccagucuaacgcuccuaucaucgacgaggagcgcgaaauucccgagagaagcuggaacuccggccaugaaugggucacggauuuuaaagggaagacagugugguucguuccuagcaucaaagcgggaaacgacauugccgcuugccugcggaagaauggcaagaaagugauccaacucucucgcaagaccuuugauuccgaguaugucaaaaccagaacaaacgacugggauuucguggugaccacagacauuagcgaaaugggggccaauuuuaaggccgagcgggucaucgauccgagacgcuguaugaaacccguuauccugaccgacggagaggaacgggugauucuugcuggcccuaugcccgugacgcacuucucugccgcgcagagacgcgggcggaucggcagaaacccuaagaaugagaacgaccaguacauuuacaugggagaaccccuggagaaugaugaagacugcgcucacuggaaagaggccaagaugcuccuggauaacaucaauacaccggagggcauuaucccuagcauguuugaacccgagcgcgaaaaggucgacgccauugauggggaguaucggcugagaggagaagcucgcaaaaccuucguggaccucaugagacggggcgaucuuccuguuuggcuggccuacaagguggcggccgaggggaucaacuaugcugaccgcagaugguguuuugauggaaucaaaaacaaucagauucuggaggaaaacgucgagguggaaaucuggacaaaggagggcgagcggaaaaagcucaagccccgcuggcuggacgccagaauuuacuccgauccucuugcucugaaagaguucaaggaguucgccgcugggcggaaaucucucgcccugaaucugaucaccgaaaugggcagacuccccacguuuaugacccaaaagacacgcgacgcgcuugauaaccuggccguucugcauaccgcugaggccggaggccgggcuuauaaucacgcccucagcgaacugccggagacacuugagacccugcuccugcugacacuccuugccaccgugacagggggaauuuuccuguuucugauguccggcagagggaucggaaaaaugacacucggcaugugcugcaucauuaccgcuucuauccugcuuugguacgcgcagauucagccucauuggaucgccgcuagcauuauccuggucuucuuucucaucgugcugcugauucccgaacccgagaagcagcgcaccccucaagacaaccagcucacauaugucgugaucgccauucuuaccguuguggccgcuacaauggccaaugaaaugggcuuccuggagaagacgaaaaaggaccugggguuuggauccaucgcgacccagcagccggaaagcaacauucucgauaucgaccugcggcccgccucugcuuggacacuuuacgccguggcuaccacauucgucaccccuaugcugagacacuccauugagaauagcuccguuaacgugucucucacggccaucgcgaaucaagccaccgugcugaugggccuggggaaaggauggccccucagcaagauggauaucggcgucccucuucuggcuauuggguguuacucccaggugaaccccaucacacugaccgccgcucuccugcuucugguugcccacuaugcuauuaucggaccuggccuccaggccaaagcgacacgggaggcccagaagcgcgcugccgcuggcauuaugaagaauccgaccguggacgggaucacggucaucgaucuggaccccauuccuuacgaucccaaauuugaaaagcaacugggacaggugaugcuccuuguccugugcgugacacagguucugaugaugagaaccacaugggcccucugugaggcccugacccuugcgaccggcccuaucucuacacugugggaagggaaccccggacgguucuggaauacgaccauugcugugagcauggccaacaucuuucgcggcuccuaucucgcuggggccggacugcuguucagcauuaugaaaaauacaaccaacacaagacggggcaccggcaacaucggggagacgcucggagaaaaguggaaaucucgccuuaaugcccugggcaaguccgaguuucaaaucuacaaaaagagcgggauucaggaggucgacagaacacuggcuaaggaaggaaucaaacggggcgagaccgaucaucacgccgugucucgcggguccgcgaagcucagaugguucguugaacggaacauggugaccccggagggaaaagucguggaccugggcugcggcagagggggauggagcuauuacuguggcgggcuuaagaaugugcgcgagguuaaaggacugacaaagggcgggccuggacaugaagaacccauucccaugucuaccuauggcuggaaccucguccggcugcagagcggcguggauguguucuuuaucccucccgaaaagugcgacacacugcucugugauauuggggaguccucuccuaauccgacggucgaagccggaagaacccuucgcguucugaaccugguggagaauuggcucaacaauaacacacaguucugcaucaaagugcugaaucccuacaugccuagcgucaucgagaagauggaagcccuucaacggagauacggcggggcccuggugcgcaacccccucucccggaauagcacccacgagauguauuggguuuccaacgcuucuggaaauauugugagcuccgucaacaugaucucuagaaugcugauuaaccgcuuuacaaugcggcauaaaaaggccaccuacgaaccugacguggaccugggcagcgggacgagaaauaucggaauugaguccgaaguucccaaccucgauaucauuggcaaacgcaucgagaagaucaagcaggagcacgaaaccucuuggcacuaugaccaggaucauccguacaaaacaugggcguaucacggcagcuacgagaccaagcagacaggguccgccagcucuauggugaauggagucgugcggcuucugaccaaaccuugggacgugcugcccacagucacccaaauggcuaugacggauacaaccccuuucggccagcagagaguuuuuaaggaaaaaguggacacccgcacacaggagcccaaggaagggacgaagaaacucaugaagauuaccgccgaguggcuguggaaagagcuuggaaagaaaaagacaccuagaauguguacccgggaagaguucacacgcaaagugagauccaacgcugcccugggcgcuaucuuuaccgaugaaaauaaguggaaaagcgcccgggaggcggucgaggacucuagauucugggaacucguggauaaggagcggaaccugcaucuggaagggaagugcgagacauguguuuauaauaugaugggaaaacgcgaaaagaaacucggcgaguuuggcaaggccaagggguccagagcuauuugguacauguggcugggagcccgguuccuugaguuugaagcucugggcuuccucaacgaggaccacugguuuagccgcgaaaauucucuguccgggguggagggagaaggccuucacaaacugggguacauccucagagaugucagcaagaaagagggcggagccauguaugccgacgacaccgcgggcugggauacgcggauuacccuggaggaccugaagaacgaagagauggugacaaaucauauggaaggggagcacaaaaagcucgcugaagccaucuucaagcugaccuaccaaaacaaaguugugcgcguccagagacccacaccgcggggaaccgugauggauaucauuucccgcagagaccagcggggcagcgggcaaguuggaacguauggccuuaauacauucaccaacauggaggcccagcugauccgccagauggagggggaaggcguguuuaagaauauucagcaucucacagcuaccgaggaaaucgccguccaaaacuggcuggcuagagugggacgggagcgccuuucuagaauggccauuagcggcgaugacugcgucgugaaaccucuggaugaccgguucgcguccgcccucacggcucugaacgauauggggaagaucagaaaagacauccagcagugggagcccucucgcggauggaaugauuggacccagguucccuuuugcagccaccauuuccacgaacugauuaugaaggacggccgggugcucgucgugccuuguagaaaccaagaugagcugaucgggcgcgcccggauuucccagggagcuggcuggucucuuagagaaacagccugccuggggaaguccuacgcgcagauguggucccucauguauuuucaccgccgggaccugagacuugccgcuaaugccaucuguucugcugugccgagccauuggguucccaccucccgcacaaccuggagcauucacgccaaacaugaguggaugacaaccgaagacaugcugacgguguggaaccgggucuggauccaggagaauccuuggauggaggauaagacacccguggaaucuugggaggaaauuccuuaccucggcaaaagagaggaccaauggugcggaucccugaucggccugaccagccgcgcuaccugggccaagaacauccaggcggccauuaaucagguucggucucucaucgggaacgaagaguauacagauuacaugcccuccaugaaaagauuccggagagaggaagaggaagcuggagugcugugguga

SEQ ID NO: 20345 - RNA, 9876 nt, Artificial Sequence
  derived and/or modified CDS sequence (opt5) from DENV-2__AF169686__SS-prME
agcgcuggcaugaucauuaugcugauccccaccgugauggcuuuccaccucacgacgagaaauggggagccucauaugauugucuccauccaagaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucggcgggguguuuaccucuaucgggaaggcucuccaucaggucuucggggccauuuauggcgcggcuuuuagcggaguguccuggacgaugaaaaucuucauuggcgugaucauuacauggaucgggaugaacagccggucuaccucccugagcguuucucugguccuugugggaaucgugacccucuaccugggcgucauggugcaggccgauuccggguguguugugagcuggaagaauaaagaacugaagugcggauccggcauuuuuaucacagacaacguccacaccuggacagagcaguauaaguuccaaccugaaucucccagcaaacucgccuccgcuauucagaaggcccaggaggaagggaucuguggcauuagaucugugacgcgccuggagaaucuuauguggaaacagaucaccccggagcugaaccacauccucgcugaaaaugagguuaagcugacaauuaugaccggagauaucaaaggcauuaugcaagccgggaagcggagccugagaccucagcccacagaacuuaaauacuccuggaagaccuggggaaaggcgaaaaugcucagcacggagucucauaaccagaccuuucugaucgacggcccugaaacagccgagugccccaauaccaaccgcgcuuggaacucccuggagguggaagauuauggguucggagucuuuacaaccaacauuuggcucaagcugaaagagaagcaggacgccuucugugacagcaaacuuaugucugcugccaucaaggauaaucgggcggugcacgccgacaugggcuacuggaucgaauccgcucugaacgauacauggaagauugagaaagccagcuucaucgagguuaagaauugccauuggccuaaaucucacacccucuggagcaacggcgugcuggaauccgagaugauuauccccaagaaccuggcugggccggucagccaacacaauuauagaccuggauaccauacgcagauugccggccccuggcaccuugggaaacucgaaauggacuuugauuucugugacggaacaaccgugguggucaccgaggauugcggcaaccgcgggcccucucugcggacaaccacggccuccggaaagcugaucacagaauggugcuguagaagcugcacccucccuccgcugcgguaccgcggcgaggacggcuguugguaugggauggagauuagaccccuuaaggaaaaagaggaaaaucugguuaacucccucgugacagcuggacauggccagguggauaauuuuucucuggggguccugggaauggcgcuuuuccucgaggaaaugcugcggaccagagugggcacaaagcacgccauccugcucguugcugugagcuuugucacccugaucacggggaacauguccuucaaagaccuuggacgcgugguugugauggucggcgccaccaugacagaugacauuggcaugggggugaccuaccuggcccuccuggcugccuuuaagguucggccuacauucgcggcuggacugcuucugagaaaacucaccucuaaggagcugaugaugacgacaaucggcauugugcuccugagccaauccaccauccccgagacaauucuugaacugaccgaugcccucgcccuggggaugaugguccugaagaucgugcgcaauauggagaaauaucagcuugcugugaccaucauggccauucugugcgucccuaacgcgguuauccuccagaaugcuuggaaggugucuuguacaauucuggccguggucagcgugagcccccugauccugacgagcucucagcagaaaaccgacuggauuccucuugcccugacaaucaagggacucaaccccaccgcuaucuuucugacaacccuguccagaacgaauaaaaagcggagcuggccgguuaacgaagccauuauggcugugggcauggucucuauccuugccuccagccugcucaaaaaugacauuccuaugacagggccccugguggcgggaggccuccugaccguuugcuacgugcuuaccggccgcucugccgaucuggagcuggaaagagcuacagacgucaagugggaggaucaggccgagaucuccgggagcuccccuauucucagcaucaccauuucugaagacggaagcauguccaucaagaacgaggaagaggagcagacacugacgauccuuauucggaccggccugcucgugaucucugggcuguuccccgucagcauuccgaucacagcugccgccugguaucucugggaagugaaaaagcagcgcgcuggaguucugugggaugugccuucucccccucccaugggcaaagcggagcuugaagacggggccuacagaauuaagcaaaaaggaauccugggcuauagccagaucggcgcuggggucuacaaggagggaaccuuucauacaauguggcacgugacccggggcgccguucugaugcacaaggggaaacgcauugaacccagcugggccgaugugaagaaagaccucaucuccuacggaggcggguggaagcuggagggagaguggaaagaaggcgaggaaguccaggugcuugcucuggagccuggcaagaauccgagagccgugcagacgaagcccggacucuucaaaaccaacacaggaaccauuggcgcgguuucucuggauuuuagcccugggacauccggaagccccaucauugacaagaaaggcaaggucguggggcucuauggaaacggcguggucacccggucuggcgcuuacguguccgccaucgcccaaacagagaaauccaucgaggauaauccugagauugaagacgauaucuuccgcaagagacggcugacgauuauggaccuucaucccggggcuggaaagaccaaaaaguaucugccugccaucguuagagaggcgauuaaacgcggccugcggacacucauccuggcuccgaccagaguggucgccgccgaaauggaggaagcccuucgcgggcugcccauucgguaccagaccccugccaucagagcugagcacacaggacgcgagaucguggaccucaugugucaugccacguucaccaugcggcugcucucucccguuagagugccuaacuauaaucugauuaucauggaugaagcgcacuuuacagaccccgccuccauugcugcccgcggcuacaucagcacccgggucgagaugggggaagcugccggcauuuucaugacagccaccccgccuggauccagagaucccuuuccccagucuaacgcuccuaucaucgacgaggagcgggaaauucccgagcgcagcuggaacuccggccaugaaugggugacggauuucaaggggaaaacaguuugguuugugccuagcaucaaggcgggaaacgacauugccgcuugccuuagaaagaauggcaaaaaggucauccaacugucucggaaaaccuucgauuccgaguaugugaagacccgcacaaacgacugggauuuuguggucaccacagacauuagcgaaaugggggccaauuucaaagccgagagaguuaucgauccgcggagauguaugaagcccgugauccugaccgacggagaggaacgcgugauucucgcuggcccuaugcccgucacgcacuuuucugccgcgcagcggagagggcgcaucggccggaacccuaaaaaugagaacgaccaguacauuuacaugggagaaccccuggagaaugaugaagacugcgcucacuggaaggaggccaagaugcuucuggauaacaucaauacaccggagggcauuaucccuagcauguucgaacccgagagagaaaaaguggacgccauugauggggaguaucgccuccggggagaagcuagaaagaccuuuguugaccugaugcgcagaggcgaucugccuguguggcucgccuacaaagucgcggccgaggggaucaacuaugcugaccggcgcugguguuucgauggaaucaagaacaaucagauucuugaggaaaacguggagguugaaaucuggacaaaagagggcgagagaaagaagcugaaaccccgguggcuggacgcccgcauuuacuccgauccucucgcucugaaggaguucaaagaguuugccgcugggagaaagucucuugcccugaaucucaucaccgaaaugggccggcugcccacguucaugacccagaaaaccagagacgcgcuggauaaccucgccgugcuucauaccgcugaggccggaggccgcgcuuauaaucacgcccugagcgaacugccggagacacucgagacccugcuucugcucacacugcuggccaccgucacaggcgggauuuuucucuuccuuauguccgggcgggggaucggaaagaugacacugggcaugugcugcaucauuaccgcuucuauccugcucugguacgcgcagauucagccucauuggaucgccgcuagcauuauccugguguuuuuccuuaucguccugcucauucccgaacccgagaagcagagaaccccucaagacaaccagcugacauaugugguuaucgccauucugaccgugguggccgcuacaauggccaaugaaaugggcuuucucgagaaaacgaagaaagaccuuggguucggauccaucgcgacccagcagccggaaagcaacauucuggauaucgaccugcgccccgccucugcuuggacacucuacgccgucgcuaccacauuuguuaccccuaugcugcggcacuccauugagaauagcuccgugaacgugucucuuacggccaucgcgaaucaagccaccguccugaugggccucgggaagggauggccccugagcaaaauggauaucggcgugccucugcucgcuauuggguguuacucccagguuaaccccaucacacuuaccgccgcucugcugcuccugguggcccacuaugcuauuaucggaccuggccuucaggccaaggcgacaagagaggcccagaagcgggcugccgcuggcauuaugaaaaauccgaccgucgacgggaucacggugaucgaucuggaccccauuccuuacgaucccaaguucgaaaaacaacucggacaggucaugcugcuggugcucugcguuacacaggugcuuaugaugcgcaccacaugggcccugugugaggcccugacccucgcgaccggcccuaucucuacacugugggaagggaaccccggaagauuuuggaauacgaccauugcugucagcauggccaacaucuuccggggcuccuaucuugcuggggccggacugcucuuuagcauuaugaagaauacaaccaacacacgcagaggcaccggcaacaucggggagacgcugggagaaaaauggaagucucggcugaaugcccucggcaaauccgaguuccaaaucuacaaaaagagcgggauucaggagguggaccgcacacuugcuaaggaaggaaucaagagaggcgagaccgaucaucacgccguuucucggggguccgcgaaacugcgcugguucguggaaagaaacauggucaccccggagggaaaggugguggaccugggcugcggcagagggggauggagcuauuacuguggcgggcucaaaaauguucgggaggucaagggacugacaaagggcgggccuggacaugaagaacccauucccaugucuaccuauggcuggaaccuugugcgccugcagagcggcguggaugucuuuuucacaccucccgaaaaaugcgacacgcuccugugugauaucggggaguccucuccuaauccgaccguugaagccggacggacacugagagugcucaaccuuguggagaauuggcugaacaauaacacccaguuuugcauuaagguccugaaucccuacaugccuagcgugaucgagaaaauggaagcucuccaacgccgguacggcggggcccugguuagaaacccccuuucccgcaauagcacacacgagauguauuggguguccaacgcuucuggaaauaucgucagcuccgugaacaugauuucucggaugcugaucaacagauucaccaugaagcauaaaaaggccacguacgaaccugacguugaccucggcagcgggacccgcaauauuggaaucgaguccgaagugcccaaccuggauauuaucggcaagcggauugagaaaaucaagcaggagcacgaaacaucuuggcacuaugaccaggaucauccguacaaaaccugggcguaucacggcagcuacgagacaaagcagaccggguccgccagcucuauggucaauggaguggugagacugcucacaaaaccuugggacguccuucccaccguuacgcaaauggcuaugacagauaccaccccuuuuggccagcagcgcguguucaaggaaaagguggacacacggacgcaggagcccaaagaagggaccaagaaacugaugaagaucacagccgaguggcuguggaaagagcucggaaagaaaaagaccccuagaauguguacacgcgaagaguuuaccagaaagguccgguccaacgcugcccugggcgcuauuuucacagaugaaaauaaauggaaguccgcccgcgaggcgguggaggacucuagauuuugggaacuuguugauaaagagcggaaccugcaucucgaagggaagugcgagaccuguguguauaauaugaugggaaaaagagaaaagaagcugggcgaguucggcaaagccaaggggucccgggcuaucugguacauguggcugggagcccgcuuucucgaguucgaaacgcugggcuuucuuaacgaggaccacugguucagcagagaaaauucucuguccggggucgagggagaaggccuccacaaacugggguacauucuucgggaugugagcaagaaagagggcggagcuauguaugccgacgacaccgccggcugggauacacgcaucacccuggaggaccucaagaacgaagagaugguuacaaaucauauggaaggggagcacaagaaacuggcggaagcuauuuucaagcugaccuaccaaaacaaaguggucagagugcagcggcccacgccgcgcggaacaguuauggauaucaucuccagacgggaccagcgcggcagcgggcaagugggaaccuauggccucaauacauuuaccaacauggaggcccagcugauuagacagauggagggggaaggcgucuucaagaauauccagcaucuuacggccaccgaggaaauugcugugcaaaacuggcuggcccgggucggacgcgagagacucucucggauggcuaucagcggcgaugacugcgugguuaaaccucuggaugaccgcuuugccuccgcgcuuacagcccugaacgauauggggaagauuagaaaggacauccagcagugggagcccucucggggauggaaugauuggacccaggugcccuucugcagccaccauuuucacgaacucaucaugaaagacggcagaguccugguggugccuugucgcaaccaagaugagcugauugggcgggcuagaaucucccagggagccggcuggucucuccgcgaaacagcuugccugggaaagagcuacgcccagauguggucccuuauguauuuccaccggagagaccugcgccucgcggccaaugcuauuuguucugccguuccgagccauugggugcccaccucccggacaaccuggagcauccacgcuaaacaugaguggaugacgacagaagacaugcuggccgucuggaacagaguguggauucaggagaauccuuggauggaggauaagacccccguugaaucuugggaggaaaucccuuaccuuggcaaacgcgaggaccaauggugcggaucccugauuggccucaccagccgggcuacaugggccaagaacauccaggcggccaucaaucaggugagaucucugauugggaacgaagaguauaccgauuacaugcccuccaugaagcgcuuucggagagaggaagaggaagcuggaguccugugguga

SEQ ID NO: 20346 - RNA, 9876 nt, Artificial Sequence
  derived and/or modified CDS sequence (opt5) from DENV-2__AF169687__SS-prME
agcgccggcaugaucauuaugcugauccccaccgugauggcuuuccaccugacaacgcggaacggggagccucauaugauugucuccauccaggaaaaggggaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaggaacaggacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcagaauccccuucgaaaucauggaccucgagaaacgcuacguucugggacggcugauuacggugaacccuaucgucaccgaaaaggauuccccggugaacauugaggccgaacccccuuuuggcgacagcuacaucauuaucgggguugagcccggccagcucaaacugaauugguucaagaagggaucuagcauuggccaaauguuugagacaaccaugagaggggcuaaacgcauggccauccuuggagauacagccugggacuucggcucccucggcgggguguuuaccucuaucgggaaggcucuccaucaggucuucggggccauuuauggcgcggcuuuuagcggaguguccuggacgaugaaaauccugauuggcgugaucauuacauggaucgggaugaacagccggucuaccucccugagcguuucucuuguccucgugggaaucgugacccuguaccugggcgucauggugcaggccgauuccggguguguugugagcuggaagaauaaagaacucaagugcggauccggcauuuucaucacagacaacguccacaccuggacagagcaguauaaguuucaaccugaaucucccagcaaacuggccuccgcuauucagaaggcccaggaggaagggaucuguggcauuagaucugugacgcgccuugagaaucugauguggaaacagaucaccccggagcucaaccacauccugagcgaaaaugagguuaagcugacaauuaugaccggagauaucaaaggcauuaugcaugcugggaagcggucccuuagaccucaacccacagaacucaaauacagcuggaagaccuggggaaucgccaagaugcugucuacggagucccacaaccagaccuuccugauugacggcccugaaacagcggagugccccaauaccaaccgcgccuggaauagccucgagguggaagauuauggguuuggagucuucacaaccaacaucuggcugaaacuuaaggagaaacaggacgcuuuuugugacucuaagcugauguccgccgcuaucaaagauaaucgggccgugcaugcggacaugggcuacuggauugaaagcgcccucaacgauacauggaagaucgagaaggcuucuuucauugagguuaaaaauugccacuggccuaagagccacacccugugguccaacggcgugcuggaaagcgagaugaucauucccaaaaaccuugccgggccggucucucagcauaauuauagaccuggauaccacacgcaaaucgcuggccccuggcaucucgggaagcuggaaauggacuucgauuuuugugacggaacaaccgugguggucaccgaggauugcggcaaccgcgggcccucccugcggacaaccacggccagcggaaaacucauuacagaauggugcuguagauccugcacccugccuccgcuucgguaccgcggcgaggacggcuguugguaugggauggagaucagaccccugaaggaaaaggaggaaaaucucguuaacucucuggugacagccggacacggccagguggauaauuucagccuggggguccuuggaauggcucucuuucuggaggaaaugcugcggaccagagugggcacaaaacaugcgauccuccugguugccguguccuucgucacccuuauuacggggaacaugucuuuuaaggaccugggacgcgugguugugaccgucggcgcuacaaugaccgaugacaucggcaugggggugacauaccucgcccugcuggccgcuuucaaaguucggccuaccuuugccgcgggacuucugcucagaaagcugacgagcaaagagcucaugaugacaaccauuggcaucgugcugcuuucccagucuacaauucccgagaccauccuggaacucaccgaugcucuggcccuggggaugaugguccuuaagaucgugcgcaauauggagaaguaucaacuggccgugacaauuauggcuauccucugcgucccuaacgccguuauucugcagaaugcguggaaagugagcuguacgauccucgcuguggucuccgugagcccccugauucuuaccucuucccagcagaagacagacuggaucccucuggcccucaccaucaaaggacugaaccccacagccauuuuccugaccacgcuuagcagaacaaauaagaaacggucuuggccgcugaacgaagcuaucauggccguuggcaugguguccauucucgcuagcucucugcucaagaaugacaucccuaugaccgggccccuggucgccggaggccuucugaccgugugcuacguucugacaggccgcuccgcggaucucgagcuggaaagagccaccgacgugaaaugggaggaucaagcugagauuagcggguccagcccuauccuuucuauuacaaucagcgaagacggauccaugucuaucaagaacgaggaagaggagcagacgcugaccauucucauccggacaggccugcucgucauuagcgggcuguuucccguguccaucccgauuaccgccgcugccugguaucuuugggaagucaagaaacagcgcgccggagugcugugggauguuccuucucccccucccaugggcaaggcugagcuggaagacggggcguacagaaucaaacagaagggaauccucggcuauagccaaauuggcgccgggguguacaaagagggaacauuccacaccauguggcacgucacgcggggcgcugugcugaugcauaaggggaagcgcaucgaacccuccugggccgauguuaaaaaggaccuuauuucuuacggaggcggguggaaacuggagggagaguggaaggaaggcgaggaagugcagguccucgcccuggagccuggcaaaaauccgagagcugugcagaccaagcccgggcucuuuaagacaaacaccggaacaaucggcgccgugagccuggauuucuccccugggaccagcggaucucccauuaucgacaaaaagggcaaaguugucgggcuuuauggaaacggcguggugacacgguccggcgcguacgucagcgcuaucgcccagacggaaaagucuauugaggauaauccugagaucgaagacgauauuuuucgcaaaagacggcugaccaucauggaccugcaccccggggccggaaagacaaagagauaucucccugcuauugugcgcgaggccaucaaacggggccugagaacccuuauucuggcgccgacccgcguuguggcugccgaaauggaggaagcccuccgggggcugcccaucagauaccaaaccccugcuauccgcgccgagcauacgggacgggagauugucgaccucaugugucacgcuaccuucacaaugagacugcuuucccccgugcgcguuccuaacuauaaucugaucauuauggaugaagcccauuucaccgaccccgcgagcaucgccgcucggggcuacauuuccacaagaguggagaugggggaagccgcuggcaucuuuaugaccgccacgccgccuggaucucgggaucccuucccccagagcaacgccccuaucauugacgaggagcgcgaaauccccgagagauccuggaauagcggccacgaaugggucacagauuuuaaggggaaaaccgugugguucguuccuucuauuaaggcuggaaacgacaucgcggccugccugcggaaaaauggcaagaaggugauucagcucucccgcaaaaccuuugauagcgaguaugucaagacaagaaccaacgacugggauuucguggugacaaccgacaucucugaaaugggggcuaauuuuaaagccgagcgggucaucgauccgagacgcuguaugaagcccguuauucugacggacggagaggaacgggugauccuugccggcccuaugcccgugacacacuucagcgcugcccaaagacgcgggcggauuggcagaaacccuaaaaaugagaacgaccaguacaucuacaugggagaaccccuggagaaugaugaagacugcgcgcauuggaaggaggcuaaaaugcuccuggauaacauuaauaccccggagggcaucauuccuuccauguuugaacccgagcgcgaaaaggucgacgccaucgauggggaguaucggcugagaggagaagcccgcaagacauucguggaccucaugagacggggcgaucuuccuguuuggcuggcuuacaaaguggccgcggaggggaucaacuaugccgaccgcagaugguguuuugauggaauuaagaacaaucagauccuggaggaaaacgucgagguggaaauuuggaccaaagagggcgagcggaagaaacucaagccccgcuggcuggacgcuagaaucuacucugauccucuugcccugaaggaguucaaagaguucgcugccgggagaaagagccucgcucugaaucugauuacggaaaugggcagacuccccaccuuuaugacacagaaaacccgcgacgcccuugauaaccuggcgguucugcacacagccgaggcuggaggccgggccuauaaucaugcucucuccgaacugccggagacccuugagacacugcuccugcugacccuccuugccacggugacagggggaaucuuccuguuucugaugucuggcagagggaucggaaagaugacccucggcaugugcugcauuaucaccgccagcauucugcuuugguacgcucaaauccagccucacuggauugcggccuccaucauccuggucuucuuucucauugugcugcugauccccgaacccgagaaacagcgcacaccucaggacaaccaacucaccuaugucgugauugcuauccuuacaguuguggccgccacgauggcuaaugaaaugggcuuccuggagaagaccaagaaagaccugggguuuggaagcauugccacacagcagccggaaucuaacauccucgauauugaccugcggcccgcguccgccuggacccuuuacgcuguggccacaaccuucgucacgccuaugcugagacacagcaucgaaaauuccucuguuaacgugagccucaccgcuaucgccaaucaggcgacagugcugaugggccuggggaagggauggccccucuccaaaauggauauuggcgucccucuucuggccaucggguguuacucucaagugaaccccauuacccugacagcugcccuccugcuucugguugcucauuaugccaucauuggaccuggccuccaggcuaaggccacccgggaggcgcagaaacgcgccgcugccggcaucaugaagaauccgacgguggacgggaucacagucauugaucuggaccccaucccuuacgaucccaaguuugaaaaacagcugggacaagugaugcuccuuguccugugcgugacccagguucugaugaugagaacaaccugggcucucugugaggcccugacccuugccacaggcccuauuagcacgcugugggaagggaaccccggacgguucuggaauaccacaaucgcgguguccauggcuaacauuuuucgcggcagcuaucucgccggggcuggacugcuguucucuaucaugaagaauaccacaaacaccagacggggcacgggcaacaucggggagacacucggagaaaaauggaagucccgccuuaaugcccugggcaaaagcgaguuucagauuuacaagaaaucugggauccaagaggucgacagaacccuggccaaggaaggaauuaagcggggcgagaccgaucaccaugcugugucccgcgggagcgccaaacucagaugguucguugaacggaacauggugacaccggagggaaaggucguggaccugggcucuggcagagggggauggagcuauuacugcggcgggcuuaaaaaugugcgcgagguuaagggacugaccaaaggcgggccuggacacgaggaacccauccccauguccacauauggcuggaaccucguccggcugcagucuggcguggauguguucuuuauuccucccgaaaagugugacacgcugcucugcgauaucggggagagcuccccuaauccgaccgucgaagcgggaagaacacuucgcguucugaaccugguggagaauuggcucaacaauaacacccaguucuguaucaaggugcugaaucccuacaugccuagcgucauugagaaaauggaagcccuucagcggaaguacggcggggcucuggugagaaacccccucucccgcaauucuacacaugagauguauuggguuagcaacgccuccggaaauaucgugucuagcgucaacaugauuucccggaugcugaucaacagauuuaccaugcgccacaaaaaggcuacguacgaaccugacguggaccugggcucugggacccggaauauuggaaucgagagcgaaauucccaaccucgauaucaucggcaaaagaauugagaagaucaagcaagagcacgaaacauccuggcauuaugaccaggaucacccguacaaaaccugggccuaucauggcagcuacgagacaaagcagaccgggucugcguccagcaugguuaauggagugguccgccuucugacaaaaccuugggacgugcugcccaccgugacgcagauggccaugacagauaccaccccuuucggccaacagcgggucuuuaaggaaaaaguugacacaagaacgcaggagcccaaggaagggaccaagaaacucaugaagauuacagcugaguggcuguggaaagagcuuggaaagaaaaagaccccucgcaugugcacaagagaagaguucacccggaaagugcgcucuaacgccgcucugggcgccaucuuuacagaugaaaauaaguggaaguccgcuagagaggccguggaggacagccgguucugggaacucgucgauaaagagagaaaccugcaccuggaagggaagugugagaccugcguguauaauaugaugggaaaacgggaaaagaaacucggcgaguuuggcaaggcgaaggggucucgcgccauuugguacauguggcugggagcuagauuccuugaguuugaagcccugggcuuccucaacgaggaccacugguuuucccgggaaaauagccuguccgggguugagggagaaggcagccauaaacuuggguacauccugcgcgaugugucuaagaaagagggcggagcuauguaugccgacgacacggccggcugggauaccagaaucacacucgaggaccugaagaacgaagagauggucaccaaucacauggaaggggagcauaaaaagcuggcggaagcuauuuucaagcucacauaccagaacaaagugguucgggugcaacgccccaccccgagaggaacggucauggauaucauuagccggcgcgaccagagaggcuccggacaggugggaacauauggccugaauaccuucacaaacauggaggcccaacuuauccggcagauggagggggaaggcguuuuuaagaauauucagcaccugaccgccacggaggaaaucgcugugcagaacuggcucgcccgcgucggaagagagcggcugucucgcauggcuaucagcggcgaugacuguguggucaaaccucuugaugacagauucgccuccgcgcugaccgcccucaacgauauggggaagauucggaaagacauccaacagugggagcccucuagaggauggaaugauuggacacaggugcccuuuugcagccaucacuuccacgaacugauuaugaaggacggccgcguucugguggucccuugccggaaccaggaugagcucaucgggagagcucgcauuucccaaggagccggcuggucucugcgggaaaccgcuugucuuggaaagagcuacgcccagauguggucccugauguauuuucauagacgcgaccuccggcuggcggccaaugcuaucugcagcgccgugccgucucacugggugcccacauccagaaccacauggagcauucaugcuaaacacgaguggaugaccacggaagacaugcuuacaguuuggaaccgcguguggauccaggagaauccuuggauggaggauaagacccccgucgaaucuugggaggaaaucccuuaccugggcaaacgggaggaccagugguguggaucccucauuggccugaccagcagagccacaugggcuaagaacauccaagccgcgauuaaucaggugcgcucccugaucgggaacgaagaguauaccgauuacaugcccucuaugaaacgguucagacgggaggaagaggaagccggaguucucugguga

SEQ ID NO: 20347 - RNA, 9876 nt, Artificial Sequence
  derived and/or modified CDS sequence (opt5) from DENV-2__AF169688__SS-prME
agcgccggcaugaucauuaugcugauccccaccgugauggcuuuccaccugacaacgagaaauggggaaccucauaugauugucuccauccaggaaaagggaaaaucucugcuuuuuaagaccgaagacggcguuaauaugugcacacugauggccauggaucucggggaacugugugaagacaccauuacauacaaaugcccgcuucugcggcaaaaugaacccgaggauaucgacuguuggugcaauuccaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaggacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagacaucuagcggcaaucuucuguuuaccggacaucucaagugccgccugagaauggacaaacuucaacugaagggcauguccuacagcauguguaccgggaaguucaaagucgugaaggaaauugcggagacacagcacggaacgaucgucauucgggugcaguaugagggcgaugggucucccugcagaauccccuucgaaaucauggaccucgagaaacgcuacguucugggacggcugauuaccgugaacccuaucgucacagaaaaggauuccccggugaacauugaggccgaacccccuuuuggcgacagcuacaucauuaucgggguugagcccggccagcucaaacugaauugguucaagaagggaucuagcauuggccaaauguuugagaccacaaugagaggggcuaaacgcauggccauccuuggagauaccgccugggacuucggcucccucggcgggguguuuacgucuaucgggaaggcucuccaucaggucuucggggccauuuauggcgcggcuuuuagcggaguguccuggacaaugaaaauccugauuggcgugaucauuaccuggaucgggaugaacagccggucuaccucccugagcguuucucuuguccucgugggaaucgugacacuguaccugggcgucauggugcaggccgauuccggguguguugugagcuggaagaauaaagaacucaagugcggauccggcauuuucaucaccgacaacguccacacauggacggagcaguauaaguuucaaccugaaucucccagcaaacuggccuccgcuauucagaaggcccaggaggaagggaucuguggcauuagaucugugacccgccuugagaaucugauguggaaacagaucacaccggagcucaaccacauccuggcugaaaaugagguuaagcugaccauuaugacaggagauaucaaaggcauuaugcaugccgggaagcggagccuuagaccucaacccaccgaacucaaauacuccuggaagacguggggaaaggcgaaaaugcugagcaccgagucucacaaccagacauuccugaucgacggcccugaaaccgccgagugccccaauacaaaccgcgcuuggaacucccucgagguggaagauuauggguuuggagucuucaccacaaacauuuggcugaaacuuaaagagaagcaggacgccuuuugugacagcaaacugaugucugcugccaucaaggauaaucgggcggugcaugccgacaugggcuacuggaucgaauccgcucucaacgauaccuggaagauugagaaagccagcuucaucgagguuaagaauugccacuggccuaaaucucacacgcuguggagcaacggcgugcuggaauccgagaugauuauccccaagaaccuugcugggccggucagccagcauaauuauagaccuggauaccacacacaaauugccggccccuggcaucucgggaaacuggaaauggacuucgauuuuugugacggaaccaccgugguggucacagaggauugcggcaaccgcgggcccucucugcggaccacgacagccuccggaaagcucaucaccgaauggugcuguagaagcugcacacugccuccgcuucgguaccgcggcgaggacggcuguugguaugggauggagauuagaccccugaaggaaaaagaggaaaaucucguuaacucccuggugaccgcuggacacggccagguggauaauuucucucuggggguccuuggaauggcgcucuuucuggaggaaaugcugcggacaagagugggcaccaagcaugccauccuccugguugcugugagcuucgucacgcuuaucaccgggaacauguccuuuaaagaccugggacgcgugguugugauggucggcgccacaaugaccgaugacauuggcaugggggugacauaccucgcccugcuggcugccuucaagguucggccuaccuuugcggcuggacuucugcucagaaaacugacgucuaaggagcucaugaugacaaccaucggcauugugcugcuuagccaguccacaauccccgagaccauucuggaacucaccgaugcccuggcccuggggaugaugguccuuaagaucgugcgcaauauggagaaauaucaacuggcugugacaaucauggccauucucugcgucccuaacgcgguuauccugcagaaugcuuggaaggugucuuguacgauucucgccguggucagcgugagcccccugauccuuaccagcucucagcagaaaacagacuggauuccucuggcccucaccaucaagggacugaaccccacagcuaucuuccugaccacgcuuuccagaacaaauaaaaagcggagcuggccgcugaacgaagccauuauggcuguuggcauggugucuauccucgccuccagccugcucaaaaaugacauuccuaugaccgggccccuggucgcgggaggccuucugaccgugugcuacguucugacaggccgcucugccgaucucgagcuggaaagagcuaccgacgugaagugggaggaucaagccgagaucuccgggagcuccccuauucuuagcaucacaauuucugaagacggaagcauguccaucaagaacgaggaagaggagcagacgcugaccauccucauucggacaggccugcucgucaucucugggcuguuucccgugagcauuccgaucaccgcugccgccugguaucuuugggaagucaaaaagcagcgcgcuggagugcugugggauguuccuucucccccucccaugggcaaagcggagcuggaagacggggccuacagaauuaagcagaaaggaauccucggcuauagccaaaucggcgcugggguguacaaggagggaacauuccacaccauguggcacgucacgcggggcgccgugcugaugcauaaggggaaacgcauugaacccagcugggccgauguuaagaaagaccuuaucuccuacggaggcggguggaagcuggagggagaguggaaagaaggcgaggaagugcagguccucgcucuggagccuggcaagaauccgagagccgugcagaccaagcccgggcucuuuaaaacaaacaccggaacaauuggcgcggugucucuggauuucagcccugggaccuccggaagccccaucauugacaagaaaggcaagguugucgggcuuuauggaaacggcguggugacacggucuggcgcuuacgucuccgccaucgcccagacggagaaguccaucgaggauaauccugagauugaagacgauaucuuucgcaagagacggcugaccauuauggaccugcaccccggggcuggaaagacaaaaagauaucucccugccaucgugcgcgaggcgauuaagcggggccugagaacccuuauccuggcuccgacccgcguuguggccgccgaaauggaggaagcucuccgggggcugcccauuagauaccaaaccccugcuauccgcgcugagcauacgggacgggagaucgucgaccucaugugucacgccaccuucacaaugagacugcuuucucccgugcgcguuccuaacuauaaucugauuaucauggaugaagcgcauuucaccgaccccgccuccauugcugcccggggcuacaucagcacaagaguggagaugggggaagcugccggcauuuuuaugaccgccacgccgccuggaucccgggaucccuucccccagucuaacgcuccuaucaucgacgaggagcgcgaaauucccgagagaagcuggaacuccggccacgaaugggucacagauuuuaaagggaagaccgugugguucguuccuagcaucaaagcgggaaacgacauugccgcuugccugcggaagaauggcaagaaagugauccagcucucucgcaagaccuuugauuccgaguaugucaaaacaagaaccaacgacugggauuucguggugacaaccgacauuagcgaaaugggggccaauuuuaaggccgagcgggucaucgauccgagacgcuguaugaaacccguuauccugacggacggagaggaacgggugauucuugcuggcccuaugcccgugacacacuucucugccgcgcaaagacgcgggcggaucggcagaaacccuaagaaugagaacgaccaguacauuuacaugggagaaccccuggagaaugaugaagacugcgcucauuggaaagaggccaagaugcuccuggauaacaucaauaccccggagggcauuaucccuagcauguuugaacccgagcgcgaaaaggucgacgccauugauggggaguaucggcugagaggagaagcucgcaaaacauucguggaccucaugagacggggcgaucuuccuguuuggcuggccuacaagguggcggccgaggggaucaacuaugcugaccgcagaugguguuuugauggaaucaaaaacaaucagauucuggaggaaaacgucgagguggaaaucuggaccaaggagggcgagcggaaaaagcucaagccccgcuggcuggacgccagaauuuacuccgauccucuugcucugaaagaguucaaggaguucgccgcugggcggaaaucucucgcccugaaucugaucacggaaaugggcagacuccccaccuuuaugacacagaagacccgcgacgcgcuugauaaccuggccguucugcacacagcugaggccggaggccgggcuuauaaucaugcccucagcgaacugccggagacccuugagacacugcuccugcugacccuccuugccacggugacagggggaauuuuccuguuucugauguccggcagagggaucggaaaaaugacccucggcaugugcugcaucauuaccgcuucuauccugcuuugguacgcgcaaauucagccucacuggaucgccgcuagcauuauccuggucuucuuucucaucgugcugcugauucccgaacccgagaagcagcgcacaccucaggacaaccaacucaccuaugucgugaucgccauucuuacaguuguggccgcuacgauggccaaugaaaugggcuuccuggagaagaccaaaaaggaccugggguuuggauccaucgcgacacagcagccggaaagcaacauucucgauaucgaccugcggcccgccucugcuuggacccuuuacgccguggcuacaaccuucgucacgccuaugcugagacacuccauugagaauagcuccguuaacgugucucucaccgccaucgcgaaucaggccacagugcugaugggccuggggaaaggauggccccucagcaagauggauaucggcgucccucuucuggcuauuggguguuacucccaagugaaccccaucacccugacagccgcucuccugcuucugguugcccauuaugcuauuaucggaccuggccuccaggccaaagcgacccgggaggcccagaagcgcgcugccgcuggcauuaugaagaauccgacgguggacgggaucacagucaucgaucuggaccccauuccuuacgaucccaaauuugaaaagcagcugggacaagugaugcuccuuguccugugcgugacccagguucugaugaugagaacaaccugggcccucugugaggcccugacccuugcgacaggcccuaucucuacgcugugggaagggaaccccggacgguucuggaauaccacaauugcugugagcauggccaacaucuuucgcggcuccuaucucgcuggggccggacugcuguucagcauuaugaaaaauaccacaaacaccagacggggcacgggcaacaucgggaagacacucggagagaaauggaagucucgccuuaaugcccugggcaaaaucgaauuucagauuuacaagaaguccgggauccaagaggucgacagaacccuggcuaaagagggaauuaagcggggcgaaaccgaucaccaugccgugagccgcgggucugcgaaacucagaugguucguugagcggaacauggugacaccggaaggaaaggucguggaccugggcugcggcagagggggaugguccuauuacuguggcgggcuuaaaaaugugcgcgagguuaagggacugaccaagggcgggccuggacacgaggaacccauccccaugagcacauauggcuggaaccucguccggcugcagucuggcguggauguguucuuuauuccucccgagaaaugcgacacgcugcucugugauaucggggaaagcuccccuaauccgaccgucgaggccggaagaacacuucgcguucugaaccugguggaaaauuggcucaacaauaacacccaguucugcaucaaggugcugaaucccuacaugccuucugucauugagaaaauggaggcccuucagcggaaguacggcggggcccuggugagaaacccccucagccgcaauuccacacaugaaauguauuggguuagcaacgcuuccggaaauaucgugucuagcgucaacaugauuucccggaugcugaucaacagauuuaccaugcgccacaaaaaggccacguacgagccugacguggaccugggcucugggacccggaauauuggaaucgaaagcgagauucccaaccucgauaucaucggcaagagaauugagaaaaucaagcaagagcacgagacauccuggcauuaugaccaggaucacccguacaaaaccugggcguaucauggcucuuacgaaacaaagcagaccgggagcgccuccagcaugguuaauggagugguccgccuucugacaaaaccuugggacgugcugcccaccgugacgcagauggcuaugacagauaccaccccuuucggccaacagcgggucuuuaaggagaagguugacacaagaacgcaggaacccaaagaggggaccaagaaacucaugaagauuacagccgaauggcuguggaaagagcuuggaaagaaaaagaccccucgcauguguacaagagaggaguucacccggaaggugcgcucuaacgcugcccugggcgcuaucuuuacagaugagaauaaauggaaguccgccagagaagcgguggaggacagccgguucugggagcucgucgauaaagaaagaaaccugcaccuggaggggaagugcgaaaccuguguguauaauaugaugggaaaacgggagaagaagcucggcgaauuuggcaaagccaaggggucucgcgcuauuugguacauguggcugggagccagauuccuugaguuugaggcucugggcuuccucaacgaagaccacugguuuucccgggagaauagccugucugggguugaaggagagggccuucauaaacugggguacauccuccgcgauguguccaagaaagaaggcggagccauguaugccgacgacacggcgggcugggauaccagaaucacacuggaggaccugaagaacgaggaaauggucaccaaucacauggagggggaacauaagaaacucgcugaggccauuuucaagcugacauaccagaacaaagugguucgggugcaacgccccaccccgagaggaacggucauggauaucauuagccggcgcgaccagagaggcuccggacaggugggaacauauggccuuaauaccuucacaaacauggaagcccaacugauccggcagauggagggggagggcguuuuuaagaauauucagcaccucaccgcuacggaagagaucgccgugcagaacuggcuggcucgcgucggaagagaacggcuuagccgcauggccaucucuggcgaugacugcguggucaaaccucuggaugacagauucgcgagcgcccucaccgcucugaacgauauggggaagauucggaaggacauccaacagugggagcccuccagaggauggaaugauuggacacaggugcccuuuugcucucaucacuuccacgagcugauuaugaaagacggccgcguucucguggucccuugucggaaccaggaugaacugaucgggagagcccgcauuagccaaggagcuggcuggucccuucgggagaccgccugccuggggaagucuuacgcgcagauguggagccucauguauuuucauagacgcgaccugcggcuugccgcuaaugccaucuguuccgcugugccgucucacugggugcccacaagcagaaccacaugguccauucaugccaaacacgaauggaugaccacggaggacaugcugacaguuuggaaccgcguguggauccaggaaaauccuuggauggaggauaagacccccgucgagagcugggaagagaucccuuaccucggcaaacgggaagaccaguggugcggaucucugauuggccugaccuccagagcuacaugggccaagaacauccaagcggccauuaaucaggugcgcagccucaucgggaacgaggaauauaccgauuacaugcccucuaugaagcgguucagacgggaggaggaagaggcuggaguucugugguga

SEQ ID NO: 20348 - RNA, 9873 nt, Artificial Sequence
  derived and/or modified CDS sequence (opt5) from DENV-3__AB189125__SS-prME
accagccucugccucaugaugaugcugcccgccacccuugcuuuccaccugacgucccgggacggagaaccucggaugaucguggggaagaaugaacgcggaaagucucuccuguuuaagaccgccagcggaauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcaucggcgggacaagcgcucuguggcccuggccccucacgucgggaugggacucgauacaagagcucaaaccuggaugagcgccgagggcgcuuggcggcaggucgaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucgggggaguucugaacucucugggcaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggcauucuugagcagggcaaacgcacacugacaccccagccuauggagcucaaguauuccuggaagacgugggggaaagccaagaucguuaccgcugaaauccaaaauagcucuuuuauuaucgauggacccaacacaccugagugccccaacgcgucccgggccuggaaugugugggaagucgaggacuacggcuucggcguguuuaccacaaacauuuggcugaaacugagagaaauguauacccagcuuugugaccaccgccucaugagcgcugccgugaaggaugagcgggccguccacgcugacaugggguacuggaucgagucccagaaaaauggaucuuggaagcuggaaaaggccagccugauugagguuaaaacaugcaccuggccgaagucccauacgcucuggucuaacggcgugcuggaaagcgauaugaucaucccuaaaucccuugcggggcccauuagccagcacaauuacagaccuggauaucauacacaaaccgcuggccccuggcaccuggggaagcucgagcuggacuucaacuacugcgagggaaccacaguggucaucaccgaaaauuguggcacgcgcggcccuucucugcggacaaccacaguguccgggaaacuuauucacgaguggugcuguagaagcugcacccugcccccgcugcgcuauaugggagaagauggcuguugguacgggauggagauccggccuauuaacgaaaaggaggagaauaugguuaagucucugguguccgccggaagcggcaaagucgacaacuuuacaaugggggugcucugccuggccauccuuuucgaagagguuaugagaggaaaguucggcaaaaagcauaugauugcuggcgugcuguuuaccuucguccuccugcugucugggcagaucacguggcgggauauggcccgcacccuuaucaugauuggaagcaaugcguccgacagaaugggcaugggggugacauaucuggcucucaucgccaccuuuaaaauucagcccuuccuggcccucggauuuuuccugcggaaacuuacaagcagagaaaaccugcuccugggcguugggcuggcuauggccaccacgcuucaacugcccgaggauaucgaacagauggcuaauggaauugcccucggccugauggcgcucaagcugaucacacaguuugagaccuaccagcuuuggacagcccuggugucucucauguguuccaacaccaucuucacccugacagucgcuuggcgcacggccacccugauucuugcuggcaucagccugcucccugugugccaauccucuagcaugcggaaaacagacuggcugccgaugaccguggccgccaugggggugcccccucucccccuguuuauuuucucccuuaaggauacacugaaaagacgcucuuggccucugaaugagggaguuauggcugugggccucgugagcauccuggcguccucucuucugagaaacgacguccccauggccgggccucucguggcuggaggccugcucauugccuguuauguuaucaccgggacgagcgccgaucugacaguggaaaaggcugccgacgucaccugggaggaagaggcggaacagaccggagugucccacaaccuuaugaucacaguugacgaugacggcaccaugcggauuaaagaugacgagacagagaauauccugacggugcugcucaagaccgcucugcuuauugucagcggcaucuuucccuacucuauuccggccacacugcucguguggcauaccuggcagaaacagacacaacgcuccgggguccugugggaugugccuucucccccugaaacccagaaggccgagcucgaagagggaguuuacagaaucaagcagcagggcauuuucgggaaaacgcaagugggagucggcgugcagaaggaggggguuuuucacaccauguggcaugugacacggggagcuguccugaccuauaacggcaaacgccuugaacccuccugggccuccgugaagaaagaccugaucagcuacggcgggggauggagacugucugcgcaguggcaaaagggcgaggaagugcagguuaucgcugucgagccggggaagaauccuaaaaacuuccagacaaugcccggaauuuuccagaccacaacgggcgaaaucggggccauugcccucgauuuuaagccuggaaccuccggcagccccaucauuaaucgggagggcaaagugguggggcuguauggaaacggcgucgugacaaagaaugggggauacguuuccggcaucgcucaaaccaacgccgagcccgacgggccuaccccggaacuugaggaagagauguucaaaaagcgcaaucugacaaucauggaucuccaccccggcagcggaaagacgagaaaauaucugccugcuauugugcgggaagccaucaagcgcagacuccggacccugauucuugcgcccacaagagucguggccgcugagauggaggaagcccugaaaggccugccuauccgcuaccagaccacagcuaccaagucugagcacacggggaaagaaauuguugaccucaugugccaugccacauuuaccaugcggcugcuuagccccgugagagucccuaacuauaaucugaucaucauggaugaggcccacuucaccgacccggcuuccauugcggcccgcggauacaucucuacacgggugggcaugggggaagcugccgccauuuuuaugaccgcuacacccccuggaaccgccgaugcguucccccagagcaacgcuccuauccaggacgaggagagagacauucccgaacgcuccuggaacucuggcaacgauuggaucacggacuuugccgggaagacaguuugguucgugccgagcauuaaggccggcaaugauaucgcuaacugucuccggaaaaacggaaagaaagucauccaacuguccagaaagaccuuugacacagaguaccagaaaaccaagcugaaugauugggacuucguggugacgaccgauauuucugaaaugggcgccaacuuuaaggcggaccgcgucaucgauccucggagaugccucaaacccguuauucuuacagacgggcccgagcgggugauccuggccggaccuaugcccgugaccgucgcuagcgccgcucagcgcagaggccggguggggcgcaauccucagaaggagaacgaucaauauauuuucacaggacagccgcugaauaacgacgaagaccaugcccacuggaccgaggcuaaaaugcuccuggauaauaucaacacacccgaaggcaucauuccugcccuuuucgagcccgaaagagagaaguccgcggccaucgacggggaguaccggcugaaaggcgaaagcagaaagaccuuuguugagcucaugcgccggggagaucugccuguguggcuggcucauaaagucgccucugaaggcauuaaguauacggacagaaaguggugcuucgauggggagcgcaauaaccagauccucgaagagaauguggacguugagauuuggacaaaagaaggagagaagaagaaacuucggcccagauggcuggaugcucgcaccuacuccgacccgcuggcccucaaagaauuuaaagauuucgccgcuggcagaaagagcaucgcgcuggaccuugugaccgagaucgggagagucccuucucaccuggcccaccgcacaagaaacgcucucgauaaucuggugaugcugcauaccuccgaacacggaggccgggccuaucgccaugccgucgaggagcuccccgaaacaauggagacgcuucugcugcucggccugaugauucuucugaccgggggagugaugcucuuucugaucagcggcaaagggguuggaaagacauccauuggccugaucugugugguggcuucuagcgggaugcucuggauggccgacauuccucuucaguggaucgcguccgccauuguccuggaguucuuuaugaugguucugcucauccccgagccugagaaacaaagaacaccccaggauaaccagcuggcuuacguggugaucggcauucuuacacuggccgcuaucgucgccgcgaaugaaaugggccuccuggagaccacgaagcgggaccugggcaugagcaaagaaccgggggugguuucuccuaccuccuaucucgacguggaucuucaccccgccagcgcuuggacacuguacgccgucgcuaccacagugauuacccccaugcugcgccacacgaucgagaacucuacagccaaugucagccucgcugccauugcgaaccaagccgugguucugaugggacuugacaagggcuggccuaucuccaagauggaucugggggugccgcuccuggcucugggaugcuacucucaggucaacccccucacccuuacagccgcugugcugcugcucguuacccauuaugccaucauuggcccugggcugcaggccaaagcgaccagagaagcucagaagcggacagccgcuggaaucaugaaaaaucccacgguggacggcauuaugaccaucgaucuugacccugucauuuacgauagcaaguucgagaaacaacugggccaggugaugcuccuggugcugugugccguucagcuccuucugaugagaacauccugggccuuuugcgaggcucugacccucgccacagggcccaucaccacgcugugggaaggaucuccuggcaaguucuggaacacaaccaucgcggucagcauggccaauauuuuucgcggguccuaucuugcuggagccggccuggcuuucagcaucaugaagucuguggggaccggaaaacggggcacaggcucccagggggagacccucggagaaaaguggaaaaagaaacugaaccaacugagcagaaaggaguuugaccucuacaaaaaguccggcauuacagaaguggaucgcacggaggccaaggaggggcuuaaacggggagaaaucacccaccaugcggucucuagaggcagcgccaagcugcagugguucguugagcggaauauggugauuccggaagggcgcgugaucgaccugggauguggcagaggcgggugguccuauuacugcgcuggacucaaaaaggucacagaggugcggggcuauaccaaagggggacccggccacgaagaaccuguucccaugucuacauacggguggaacauugugaagcugaugagcggaaaggaugucuucuaccuuccucccgagaaaugugacacccugcucugcgauaucggcgaauccagcccgucuccuacgguggaggaaucccgcaccaucagaguucugaagaugguggagcccuggcugaaaaauaaccaguuuuguauuaagguccucaaucccuauaugccugccgugaucgagcaucuugaacggcugcagcgcaaacacggcgggaugcuggugagaaacccccucagcagaaauucuacacacgagauguacuggauuuccaacggaaccggcaauaucgucagcucuguuaacauggugagccgccugcuucugaauagauucacaaugaccuaucggagaccuacaauugaaaaggacguggaccucggggcuggaacccgccaugucaacgccgagccggaaacgcccaacauggaugugaucggcgagcggaucagacgcauuaaggaggaacacuccucuacauggcauuacgacgaugagaauccuuauaaaaccugggcuuaccacgggagcuaugaaguuaaggccaccggauccgcgagcuccaugaucaacggcguggucaaacugcugacaaagcccugggacgugguuccuacggugacccaaauggccaugacagauaccacacccuuuggccagcagcgggucuucaaagagaagguggacaccagaacaccgaagccuaugcccgggacccgcaaaguuauggaaauuacggcugaguggcucuggcggacccugggaagaaauaagcgcccucggcuuugcacaagagaggaauuuaccaaaaaggugcgcacaaacgccgcuaugggcgccgucuucaccgaggaaaaucaaugggauucugcccgggcggcuguggaggacgaagaguuuuggaaacuggucgauagagagcgcgaacuccacaagcuggggaaauguggaagcugcguguacaacaugaugggcaagagagagaagaaacuuggggaguucggcaaggccaaaggaucccgggccaucugguacauguggcugggcgcucgcuaucucgaguuugaggcccugggguuccugaaugaagaccauugguuuucuagagagaacagcuacuccggaguugaaggcgaggggcuccacaagcugggauauauucuucgggauaucucuaaaauccccggcggggcuauguacgccgacgacacggcgggcugggauacaagaauuaccgaagacgaucugcauaaugaggagaagaucacacagcagauggacccugaacaccggcagcucgccaacgcuauuuucaagcugaccuaucaaaauaaaguggucaaggugcagcgccccacgccgaaaggaaccgugauggauaucauuagcagaaaggaccagcggggcuccgggcagguuggaacauacggccuuaacaccuuuacaaauauggaggcccaacugauccgccagauggaaggggagggagugcucagcaaaaccgaucuggaaaacccucaucugcucgagaagaagaucacacaguggcuggagaccaaaggcgucgaaagacuuaagcggauggcuauuucuggggacgauugcgugguuaaacccaucgacgaucgcuucgccaaugcgcugcucgcccugaacgacaugggcaaggugagaaaagauauuccccaguggcaaccuuccaagggauggcacgacuggcagcaggucccguucuguagccaccauuuucacgagcuuaucaugaaggacggccggaaacuggugguccccugccgcucucaggaugaacucauugggagagcucggaucucccaaggagccggcuggagccugaaggagacggcuugucuggggaaagccuaugcucagaugugggcccucauguacuuccaucgcagagaccugcggcuugcgucuaacgccauuugcuccgcugugccuguucacugggugcccacaagccgcaccaccugguccauccacgcccaucaccaguggaugacaaccgaagauaugcugacagucuggaauagaguguggaucgaggacaacccuuggauggaggauaagacgcccguuaccacaugggaagacgugccuuaccucggaaaacgggaggaucaaugguguggcagccugauugggcuuaccucuagagccacaugggcucagaauauccugaccgccauucagcagguccgcagccucaucggcaacgaagaguuucuggacuauaugcccuccaugaagcgguucagaaaggaggaagagucugaaggagcgauuugguga

SEQ ID NO: 20349 - RNA, 9873 nt, Artificial Sequence
  derived and/or modified CDS sequence (opt5) from DENV-3__AB189126__SS-prME
accagccugugccucaugaugaugcugcccgccacccuugcuuuccaccugacgucccgggacggagagccucggaugaucguggggaagaacgaacgcggaaagucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucagaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucggcgggguucugaacucucuggggaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggaguucuugagcagggcaaacgcacacugacaccccagccuauggagcucaaguauuccuggaagacgugggggaaagccaagguggucaccgcugaaauucaaaauagcucuuuuaucaucgauggacccaacacaccugagugccccaacgcgucccgggccuggaaugugugggaaguggaggacuacggcuucggcgucuuuaccacaaacauuuggcugaaacugagagaaauguauacccagcuuugugaccaccgccucaugagcgcugccguuaaggaugagcgggccgugcacgcugacaugggguacuggaucgagucccagaaaaauggaucuuggaagcuggaaaaggccagccugauugaggugaaaacaugcaccuggccgaagucccauacgcucuggucuaacggcguccuggaaagcgauaugaucauuccuaaaucccuugcggggcccaucagccagcacaauuacagaccuggauaucauacacaaaccgcuggccccuggcaccuggggaagcucgagcuggacuucaacuacugcgagggaaccacagugguuaucaccgaaaauuguggcacgcgcggcccuucucugcggacaaccacaguguccgggaaacuuauucacgaguggugcuguagaagcugcacccugcccccgcugcgcuauaugggagaagauggcuguugguacgggauggagauccggccuauuaacgaaaaggaggagaauauggucaagucucugguguccgccggaagcggcaaaguugacaacuuuacaaugggggugcucugccuggccauccuuuucgaagaggucaugagaggaaaguucggcaaaaagcauaugauugcuggcauccuguuuauuuucgugcuccugcugucugggcagaucaccuggcgggauauggcccgcacgcuuaucaugauuggaagcaaugcguccgacagaaugggcauggggguuaccuaucuggcucucaucgccacauuuaaaauucagcccuuccuggcccucggauuuuuccugcggaaacuuaccagcagagaaaaccugcuccugggcguggggcuggcuauggccacaacccuucaacugcccgaggauaucgaacagauggcuaauggaauugcccucggccugauggcgcucaagcugaucacgcaguuugagacauaccagcuuuggaccgcccuggucucucucacauguuccaacaccaucuucacccugacaguggcuuggcgcacggccacccugauucuugcuggcaucagccugcucccugugugccaauccucuagcaugcggaaaacagacuggcugccgaugaccgucgccgccauggggguucccccucucccccuguuuauuuucucccuuaaggauacacugaaaagacgcucuuggccucugaaugagggagugauggcugugggccucgucagcauccuggcguccucucuucugagaaacgacgugcccauggccgggccucucguugcuggaggccugcucauugccuguuaugugaucaccgggacgagcgccgaucugacagucgaaaaggcugccgacgugaccugggaggaagaggcggaacagaccggaguuucccacaaccuuaugaucacaguggacgaugacggcaccaugcggauuaaagaugacgagacagagaauauccugacgguccugcucaagaccgcucugcuuauugugagcggcaucuuucccuacucuauuccggccacacugcucgucuggcauaccuggcagaaacagacacaacgcuccggggugcugugggauguuccuucucccccugaaacccagaaggccgagcucgaagagggaguguacagaaucaagcagcagggcauuuucgggaaaacgcaagucggagugggcguucagaaggaggggguguuucacaccauguggcaugucacacggggagcugugcugaccuauaacggcaaacgccuugaacccaauugggccuccgugaagaaagaccugaucuccuacggcgggggauggagacugagcgcgcaguggcaaaagggcgaggaaguucaggucaucgcuguggagccggggaagaacccuaaaaauuuccagacaaugcccggaauuuuccagaccacaacgggcgaaaucggggccauugcccucgauuuuaagccuggaaccucuggcucccccaucauuaaccgggagggcaaaguggucgggcuguauggaaauggcgugguuacaaagaacgggggauacgugagcggcaucgcucaaaccaaugccgagcccgacgggccuaccccggaacuugaggaagagauguucaaaaagcgcaaccugacaaucauggaucuccaccccggcuccggaaagacgagaaaauaucugccugcuauuguccgggaagccaucaagcgcagacuccggacccugauucuugcgcccacaagagugguugccgcugagauggaggaagcccugaaaggccugccuauccgcuaccagaccacagcuaccaagagcgagcacacggggaaagaaauuguggaccucaugugccaugccacauuuaccaugcggcugcuuucucccgucagagugccuaauuauaaccugaucaucauggaugaggcccacuucaccgacccggcuagcauugcggcccgcggauacaucuccacacggguuggcaugggggaagcugccgccauuuuuaugaccgcuacacccccuggaaccgccgaugcguucccccagucuaaugcuccuauccaggacgaggagagagacauucccgaacgcagcuggaacuccggcaaugauuggaucacggacuuugccgggaagacagugugguucgucccgucuauuaaggccggcaacgauaucgcuaacugucuccggaaaaauggaaagaaagugauccaacugagcagaaagaccuuugacacagaguaccagaaaaccaagcugaacgauugggacuucguggucacgaccgauauuuccgaaaugggcgccaauuuuaaggcggaccgcguuaucgauccucggagaugccucaaacccgugauucuuacagacgggcccgagcgggugauccuggccggaccuaugcccgucaccguggcuucugccgcucagcgcagaggccggguugggcgcaacccucagaaggagaaugaucaauauauuuucacaggacagccgcugaacaaugacgaagaccaugcccacuggaccgaggcuaaaaugcuccuggauaacaucaauacacccgaaggcaucauuccugcccuuuucgagcccgaaagagaaaagagcgcggccaucgacggggaguaccggcugaaaggcgaauccagaaagaccuuuguggagcucaugcgccggggagaucugccugucuggcuggcucauaaaguggccagcgaaggcauuaaguauacggacagaaaguggugcuucgauggggagcgcaacaaucagauccucgaagagaacauggacguugagauuuggacaaaagaaggagagaagaagaaacuucggcccagauggcuggaugcucgcaccuacucugacccgcuggcccucaaagaauuuaaagauuucgccgcuggccggaaguccaucgcgcuggaccuugugaccgagaucgggagagucccuagccaccuggcccaccgcacaagaaaugcucucgauaaccuggugaugcugcauaccucugaacacggaggccgggccuaucgccaugccgucgaggagcuccccgaaacaauggagacgcuucugcugcucggccugaugauucuucugaccgggggagcuaugcucuuucugaucuccggcaaaggggugggaaagacaagcauuggccugaucuguguuguggccuccucugggaugcucuggauggcggacauuccucuucaguggaucgccagcgcuauugugcuggaguucuuuaugaugguccugcucauccccgagccugagaaacaaagaacaccccaggauaaucagcuggccuacguugugaucggcauucuuacacuggcugccaucguggcggccaacgaaaugggccuccuggagaccacgaagcgggaccugggcauguccaaagaaccgggggucgugccucccaccagcuaucucgacguugaucuucaccccgcuucugccuggacacuguacgcuguggccaccacagucauuaccccuaugcugcgccacacgaucgaaaauuccacagcuaacgugagccucgccgcgauugccaaccaagcugucgugcugaugggacuugacaagggcuggccgaucucuaagauggaucuggggguuccccuccuggcccugggaugcuacagccaggugaauccucucacccuuacagcugccguccugcugcucgugacccauuaugccaucauuggccccgggcugcaggcgaaagcuaccagagaagcccagaagcggacagcugccggaaucaugaaaaacccuacgguugacggcauuaugaccaucgaucuugaccccgugauuuacgauuccaaguucgagaaacaacugggccaggucaugcuccuggugcugugugccgugcagcuccuucugaugagaacaucuugggcuuuuugcgaggcccugacccucgcgacagggccuaucaccacgcugugggaaggaagcccgggcaaguucuggaauacaaccaucgccguuuccauggcuaacauuuuucgcgggucuuaucuugccggagcuggccuggccuucagcaucaugaaguccgucgggaccggaaaacggggcacaggcagccagggggagacccucggagaaaaguggaaaaagaaacugaaucaacugucuagaaaggaguuugaccucuacaaaaaguccggcauuacagaaguggaucgcacggaggcgaaggaggggcuuaaacggggagaaaucacccaccaugccgugagcagaggcuccgcuaagcugcagugguucgucgagcggaacaugguuauucccgaagggcgcgugaucgaccugggauguggcagaggcggguggucuuauuacugcgccggacucaaaaaggugacagagguccggggcuauaccaaagggggaccuggccacgaggaacccgugccuaugagcacauacggguggaauauuguuaagcugauguccggaaaggauguguucuaccuucccccggagaaaugugacacccugcucugcgauaucggcgaaucuagcccuucccccacggucgaggaaagccgcaccaucagagugcugaagaugguugagcccuggcugaaaaacaaucaguuuuguauuaaggugcucaacccuuauaugcccacagucaucgagcaucuugaacggcugcagcgcaaacacggcgggaugcuggugagaaauccucucucucggaacuccacccacgagauguacuggauuagcaauggaacaggcaacaucgugucuuccgucaauaugguuagccgccugcuucugaacagauucaccaugacacaucggagaccgaccauugaaaaggacguggaccucggggcuggaacgcgccacgugaacgccgagcccgaaacaccuaauauggaugucaucggcgagcggaucagacgcauuaaggaggaacauucuagcaccuggcacuaugacgaugagaaccccuacaaaaccugggcuuaucacggguccuacgaagugaaggccacaggaucugcgagcuccaugaucaauggcguugugaaacugcugacgaagccuugggacgucgugcccaccguuacacaaauggccaugaccgauacaaccccguuuggccagcagcggguguucaaagagaaggucgacacaagaaccccuaagcccaugccugggacgcgcaaagugauggaaauuaccgcugaguggcucuggcggacacugggaagaaacaagcgcccccggcuuugcaccagagaggaauuuaccaagaagguucgcaccaaugccgcuaugggcgccguguucacggaggaaaaccaaugggauagcgcccgggcggcugucgaggacgaagaguuuuggaaacugguggauagagagcgcgaacuccauaagcuggggaaauguggauccugcgucuauaauaugaugggcaagagagagaagaaacuuggggaguucggcaaggccaaaggaucucgggccaucugguacauguggcugggcgcucgcuaccucgaguuugaggcccugggguuccugaacgaagaccacugguuuagcagagaaaauuccuauucuggaguggaaggcgaggggcuccauaagcugggauacauucuucgggauaucagcaaaaucccuggcggggcuauguaugccgacgacacagcgggcugggauaccagaauuacagaagacgaucugcacaacgaggagaagaucacccagcagauggaccccgaacaucggcagcucgccaaugcuauuuucaagcugacguaccaaaacaaaguugugaagguccagcgcccgaccccuaaaggaacagugauggauaucauuuccagaaaggaccagcggggcucuggacaggugggaaccuauggccuuaauacauuuaccaacauggaggcccaacugauccgccagauggaaggggagggaguucucagcaaaacagaucuggaaaauccccaccuccucgagaagaagaucacccaguggcuggagacgaaaggcguggaaagacuuaagcggauggcuauuuccggggacgauugcgucgugaaacccaucgacgaucgcuucgccaacgcgcugcucgcccugaacgacaugggcaagguuagaaaagauauuccucaguggcaaccgagcaagggauggcacgacuggcaacaggugcccuucuguucucaucacuuucaugagcuuaucaugaaggacggccggaaacuggucgugccuugccgcccccaggaugaacucauugggagagcucggaucucccaaggagccggcuggagccugaaggagacagcuugucuggggaaagccuacgcucagaugugggcccucauguauuuccaccgcagagaccugcggcuugcgucuaaugccauuugcuccgcugucccugugcacuggguucccaccagccgcaccacauggucuauccaugcccaccaucaguggaugaccacagaagauaugcugacgguguggaacagagucuggaucgaggacaauccuuggauggaggauaagacccccgugacaaccugggaagacguuccguaccucggaaaacgggaggaucaaugguguggcucccugauugggcuuacaagcagagccaccugggcucagaacauccugacggccauucaacaggugcgcucccucaucggcaaugaagaguuucuggacuacaugccuagcaugaagcgguucagaaaggaggaggagcuggaaggagcgauuugguga

SEQ ID NO: 20350 - RNA, 9873 nt, Artificial Sequence
  derived and/or modified CDS sequence (opt5) from DENV-3__AB189127__SS-prME
accagccugugccucaugaugaugcugcccgccacccuugcuuuccaccugacgucccgggacggagagccucggaugaucguggggaagaaugaacgcggaaagucucuccuguuuaagaccgccagcggcauuaauauguguacacuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucaaaccuggaugagcgccgagggcgcuuggcggcaggucgaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucggcgggguucugaacucucuggggaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggaguucuugagcagggcaaacgcacacugacaccccagccuauggagcucaaguauuccuggaagacgugggggaaagccaagguggucaccgcugaaauucaaaauagcucuuuuaucaucgauggacccaacacaccugagugccccaacgcgucccgggccuggaaugugugggaaguggaggacuacggcuucggcgucuuuaccacaaacauuuggcugaaacugagagaaauguauacccagcuuugugaccaccgccucaugagcgcugccguuaaggaugagcgggccauccacgcugacaugggguacuggauugagucccagaaaaauggaucuuggaagcuggaaaaggccagccugaucgaggugaaaacaugcaccuggccgaagucccauacgcucuggucuaacggcgugcuggaaagcgauaugauuaucccuaaaucccuugcggggcccaucagccagcacaauuacagaccuggauaucauacacaaaccgcuggccccuggcaccuggggaagcucgagcuggacuucaacuacugcgagggaaccacagucgugauuaccgaaaauuguggcacgcgcggcccuucucugcggacaaccacaguuuccgggaaacuuauccacgaguggugcuguagaagcugcacccugcccccgcugcgcuauaugggagaagauggcuguugguacgggauggagauucggccuaucaacgaaaaggaggagaauauggugaagucucuggucuccgccggaagcggcaaaguggacaacuuuacaauggggguucucugccuggccauucuuuucgaagaggugaugagaggaaaguucggcaaaaagcauaugaucgcuggcauucuguuuauguucguccuccugcugucugggcagaucaccuggcgggauauggcccgcacgcuuaucaugauuggaagcaaugcguccgacagaaugggcaugggggugaccuaucuggcucucaucgccacauuuaaaauucagcccuuccuggcccucggauuuuuccugcggaaacuuaccagcagagaaaaccugcuccugggcguugggcuggcuauggccacaacccuucaacugcccgaggauaucgaacagauggcuaauggaauugcccucggccugauggcgcucaagcugaucacgcaguuugagacauaccagcuuuggaccgcccuggugucucucacauguuccaacaccaucuucacccugacagucgcuuggcgcacggccacccugauucuugcuggcaucagccugcucccugugugccaauccucuagcaugcggaaaacagacuggcugccgaugaccguggccgccaugggggugcccccucucccccuguuuauuuucucccuuaaggauacacugaaaagacgcucuuggccucugaaugagggaguuauggcugugggccucgugagcauccuggcguccucucuucugagaaacgacguccccauggccgggccucucguggcuggaggccugcucauugccuguuauguuaucaccgggacgagcgccgaucugacaguggaaaaggcugccgacgucaccugggaggaagaggcggaacagaccggagugucccacaaccuuaugaucacaguugacgaugacggcaccaugcggauuaaagaugacgagacagagaauauccugacggugcugcucaagaccgcucugcuuauugucagcggcaucuuucccuacucuauuccggccacacugcucguguggcauaccuggcagaaacagacacaacgcuccgggguccugugggaugugccuucucccccugaaacccagaaggccgagcucgaagagggaguuuacagaaucaagcagcagggcauuuucgggaaaacgcaagugggagucggcgugcagaaggaggggguuuuucacaccauguggcaugugacacggggagcuguccugaccuauaacggcaaacgccuugaacccuccugggccuccgugaagaaagaccugaucagcuacggcgggggauggagacugucugcgcaguggcaaaagggcgaggaagugcagguuaucgcugucgagccggggaagaauccuaaaaacuuccagacaaugcccggaauuuuccagaccacaacgggcgaaaucggggccauugcccucgauuuuaagccuggaaccuccggcagccccaucauuaaucgggagggcaaagugguggggcuguauggaaacggcgucgugacaaagaaugggggauacguuuccggcaucgcucaaaccaacgccgagcccgacgggccuaccccggaacuugaggaagagauguucaaaaagcgcaaucugacaaucauggaucuccaccccggcagcggaaagacgagaaaauaucugccugcuauugugcgggaagccaucaagcgcagacuccggacccugauucuugcgcccacaagagucguggccgcugagauggaggaagcccugaaaggccugccuauccgcuaccagaccacagcuaccaagucugagcacacggggaaagaaauuguugaccucaugugccaugccacauuuaccaugcggcugcuuagccccgugagagucccuaacuauaaucugaucaucauggaugaggcccacuucaccgacccggcuuccauugcggcccgcggauacaucucuacacgggugggcaugggggaagcugccgccauuuuuaugaccgcuacacccccuggaaccgccgaugcguucccccagagcaacgcuccuauccaggacgaggagagagacauucccgaacgcuccuggaacucuggcaacgauuggaucacggacuuugccgggaagacaguuugguucgugccgagcauuaaggccggcaaugauaucgcuaacugucuccggaaaaacggaaagaaagucauccaacuguccagaaagaccuuugacacagaguaccagaaaaccaagcugaaugauugggacuucguggugacgaccgauauuucugaaaugggcgccaacuuuaaggcggaccgcgucaucgauccucggagaugccucaaacccguuauucuuacagacgggcccgagcgggugauccuggccggaccuaugcccgugaccgucgcuagcgccgcucagcgcagaggccggguggggcgcaauccucagaaggagaacgaucaauauauuuucacaggacagccgcugaauaacgacgaagaccaugcccacuggaccgaggcuaaaaugcuccuggauaauaucaacacacccgaaggcaucauuccugcccuuuucgagcccgaaagagagaaguccgcggccaucgacggggaguaccggcugaaaggcgaaagcagaaagaccuuuguugagcucaugcgccggggagaucugccuguguggcuggcucauaaagucgccucugaaggcauuaaguauacggacagaaaguggugcuucgauggggagcgcaauaaccagauccucgaagagaauauggacguggagauuuggacaaaagaaggagagaagaagaaacuucggcccagauggcuggaugcucgcaccuacuccgacccgcuggcccucaaagaauuuaaagauuucgccgcuggcagaaagagcaucgcgcuggaccuuguuaccgagaucgggagagugccuucucaccuggcccaccgcacaagaaacgcucucgauaaucuggucaugcugcauaccuccgaacacggaggccgggccuaucgccaugccguggaggagcuccccgaaacaauggagacgcuucugcugcucggccugaugauucuucugaccgggggagcuaugcucuuucugaucagcggcaaaggggucggaaagacauccauuggccugaucugugugguugccucuagcgggaugcucuggauggcggacauuccucuucaguggaucgccuccgcuauugugcuggaguucuuuaugauggugcugcucauccccgagccugagaaacaaagaacaccccaggauaaccagcuggccuacgucguuaucggcauucuuacacuggcugccaucguggcggccaaugaaaugggccuccuggagaccacgaagcgggaccugggcaugagcaaagaaccggggguggucccucccaccucuuaucucgacguggaucuucaccccgcuuccgccuggacacuguacgcuguugccaccacagugauuaccccuaugcugcgccacacgaucgagaacagcacagcuaaugucucucucgccgcgauugccaaccaagcugugguccugaugggacuugacaagggcuggccgaucagcaagauggaucugggggugccccuccuggcccugggaugcuacucccagguuaacccucucacccuuacagcugccgugcugcugcucgucacccauuaugccaucauuggccccgggcugcaggcgaaagcuaccagagaagcccagaagcggacagcugccggaaucaugaaaaauccuacgguggacggcauuaugaccaucgaucuugaccccguuauuuacgauucuaaguucgagaaacaacugggccaggugaugcuccugguccugugugccgugcagcuccuucugaugagaacaagcugggcuuuuugcgaggcccugacccucgcgacagggccuaucaccacgcugugggaaggauccccgggcaaguucuggaacacaaccaucgccgugucuauggcuaauauuuuucgcgggagcuaucuugccggagcuggccuggccuucuccaucaugaaaagcguugggaccggaaaacggggcacaggcucucagggggagacccucggagaaaaguggaaaaagaaacugaaccaacuguccagaaaggaguuugaccucuacaaaaagagcggcauuacagaagucgaucgcacggaggcgaaggaggggcuuaaacggggagaaaucacccaccaugccguguccagaggcucugcuaagcugcagugguucguggagcggaauauggucauucccgaagggcgcguuaucgaccugggauguggcagaggcggguggagcuauuacugcgccggacucaaaaaggugacagaggugcggggcuauaccaaagggggaccuggccacgaagaacccgucccuauguccacauacggguggaacauugugaagcugaugucuggaaaggauguuuucuaccuucccccggagaaaugugacacccugcucugcgauaucggcgaaagcuccccuagccccacgguggaggaaucucgcaccaucagaguccugaagaugguggagcccuggcugaaaaauaaccaguuuuguauuaagguucucaauccuuauaugcccacagugaucgagcaucuugaacggcugcagcgcaaacacggcgggaugcuggucagaaacccucucucccggaauagcacccacgagauguacuggauuucuaacggaacaggcaauaucguguccagcgugaacauggucucucgccugcuucugaauagauucaccaugacacaucggagaccgaccauugaaaaggacguugaccucggggcuggaacgcgccacgugaacgccgagcccgaaacaccuaacauggaugugaucggcgagcggaucagacgcauuaaggaggaacauagcuccaccuggcacuaugacgaugagaaucccuacaaaaccugggcuuaucacgggucuuacgaagucaaggccacaggaagcgcguccagcaugaucaacggcgugguuaaacugcugacgaagccuugggacgugguccccaccgugacacaaauggccaugaccgauacaaccccguuuggccagcagcggguuuucaaagagaagguggacacaagaaccccuaagcccaugccugggacgcgcaaagucauggaaauuaccgcugaguggcucuggcggacacugggaagaaauaagcgcccccggcuuugcaccagagaggaauuuaccaagaaggugcgcaccaacgccgcuaugggcgccguuuucacggaggaaaaucaaugggauuccgcccgggcggcuguggaggacgaagaguuuuggaaacuggucgauagagagcgcgaacuccauaagcuggggaaauguggaucuugcguguauaacaugaugggcaagagagagaagaaacuuggggaguucggcaaggccaaaggaagccgggccaucugguacauguggcugggcgcucgcuaccucgaguuugaggcccugggguuccugaaugaagaccacugguuuuccagagagaacucuuauagcggagucgaaggcgaggggcuccauaagcugggauacauucuucgggauaucuccaaaaucccuggcggggcuauguaugccgacgacacagcgggcugggauaccagaauuacagaagacgaucugcacaaugaggagaagaucacccagcagauggaccccgaacaucggcagcucgccaacgcuauuuucaagcugacguaccaaaauaaagugguuaaggugcagcgcccgaccccuaaaggaacagucauggauaucauuucuagaaaggaccagcggggcagcggacaggugggaaccuauggccuuaacacauuuaccaauauggaggcccaacugauccgccagauggaaggggagggagugcucuccaaaacagaucuggaaaacccccaccuccucgagaagaagaucacccaguggcuggagacgaaaggcguugaaagacuuaagcggauggcuauuagcggggacgauugcguggucaaacccaucgacgaucgcuucgccaaugcgcugcucgcccugaacgacaugggcaaggugagaaaagauauuccucaguggcaaccgucuaagggauggcacgacuggcagcagguucccuucuguucccaucacuuucaugagcuuaucaugaaggacggccggaaacugguggucccuugccgcccccaggaugaacucauugggagagcucggaucagccaaggagccggcuggucucugaaggagacagcuugucuggggaaagccuacgcucagaugugggcccucauguauuuccaccgcagagaccugcggcuugcguccaacgccauuugcagcgcugugccuguccacugggugcccaccucucgcaccacaugguccauccaugcccaccaucaguggaugaccacagaagauaugcugacgguuuggaauagaguguggaucgaggacaacccuuggauggaggauaagacccccgucacaaccugggaagacgugccguaccucggaaaacgggaggaucaaugguguggcagccugauugggcuuacauccagagccaccugggcucagaauauccugacggccauucagcagguucgcagccucaucggcaacgaagaguuucuggacuacaugccuucuaugaagcgguucagaaaggaggaagaacuggaaggagcgauuugguga

SEQ ID NO: 20351 - RNA, 9873 nt, Artificial Sequence
  derived and/or modified CDS sequence (opt5) from DENV-3__AB189128__SS-prME
accagccucugccucaugaugauccugcccgccacccuugcuuuccaccugacgucccgggacggagaaccucggaugauuguggggaagaacgaacgcggaaagucucuccuguuuaagaccgccagcggcaucaauauguguacccuuauugcgauggaucugggggaaaugugcgacgauaccgugaccuacaaauguccgcucaucaccgaaguugagcccgaagacauugauugcugguguaaccugaccuccaccugggugacguauggaaccugcaaucaggcuggcgagcaucggcgggacaagcgcucuguggcccuggccccucacgucgggaugggacucgauacaagaacccaaacauggaugagcgcugagggcgccuggagacagguggaaaaaguugagaccugggcuuuccgccaucccggcuuuacggugcuggcccuuuuccuggcgcacuuuaucgggacaucccucacccagaaggucgugaucuucauucugcuuaugcugguuacaccuucuaugaccaugagaugugugggagucggcaaccgggacuuuguggaagggcucagcggagccaccuggguggaugucguucuggagcauggcgggugcgugacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuacgucuguaaacacaccuauguggaucggggcugggggaacggaugcggccuguucgggaagggaagccuuguuacaugcgcgaaguuucaaugucuggagucuaucgagggcaaagugguccagcacgaaaaucucaaguacaccgugauuaucacaguucauacgggggaccagcaccaggugggaaacgagacccaaggcgucacagccgaaaucacaccccaggcuuccacaguggaggccauucugccugaauauggcacccuggggcucgagugcagcccccgcacgggacuggacuucaaugagaugauccuucugaccaugaaaaacaaggcuuggaugguccauagacagugguuuuucgaucucccucugcccuggacaucuggcgccaccacagaaaccccgacguggaauaaaaaggagcuucuggugacauuuaaaaacgcccacgcuaagaagcaagaaguugugguccucgggucccaggagggagcgaugcacaccgcccugacaggcgcuaccgaaauucagaccagcgggggcacaucuaucuucgccggacaucugaaaugucggcucaagauggacaaacuggagcuuaagggcauguccuacgccaugugccugaaugcuuucgugcucaaaaaggagguuagcgaaacgcagcacgggaccauucugaucaagguggaguauaaaggagaagaugccccuuguaagauccccuuuuccacagaggacggccaagggaaagcgcauaacggacgccugauuaccgcuaacccugucgugacaaagaaagaggaacccgugaauaucgaggccgaacccccuuucggcgagucuaacauuguuaucgggauuggcgauaaggcccuuaagaucaauugguacaaaaagggaagcuccaucggcaaaauguuugaagcuaccgccagaggggcucggagaauggccauucucggagacacggcgugggauuucggcagcgucgggggagugcugaacucucugggcaagauggugcaccagaucuuuggguccgccuacacagcucucuucagcggcgucucuuggauuaugaaaaucggaauuggcgugcugcuuaccuggaucgggcugaauagcaagaacaccuccaugucuuuuagcugcauuguuaucggaaucauuacacucuaucugggcgccgugguccaggcugacaccgggugugugaucaauuggaagggaaaagagcugaagugcggcuccgggauuuucguuacaaacgaggugcauacguggaccgaacaguacaaauuucaagccgauagcccgaagcgccuugcgacagccaucgcuggcgccugggagaauggagucuguggcauucggucuaccacaagaauggaaaaccuccuguggaaacagaucgcuaaugagcugaacuauauccucugggaaaauaacauuaagcugaccgugguugugggggacaucauuggaguccuugagcagggcaaacgcacgcugacaccccagccuacagagcucaaguacuccuggaagaccugggggaaagccaagaucgugacagccgaaacccaaaauagcucuuucauuaucgauggacccaacacaccugagugccccuccgcuagccgggcguggaacgugugggaagucgaggaauauggcuuuggcguuuucaccacgaauaucuggcugaaacugagagagauguacacacagcuuugugaccaccgccucauguccgccgcugugaaggacgagcgggccgugcacgccgauaugggguauuggauugaaucucagaaaaacggaagcuggaagcuggagaaggcuucccugaucgaagucaaaaccugcaccuggccgaagucucauacacucuggagcaauggcgugcuggaguccgacaugauuaucccuaaaagccuugccgggcccauuucucagcacaacuacagaccuggauaccauacccaaacggcgggccccuggcaccuggggaagcucgagcuggauuuuaauuauugcgaaggaacaaccguugugaucacagagaacuguggcacccgcggcccuucccugcggacaaccacggucagcgggaaacuuauccacgaauggugcuguagaucuugcacccugcccccgcugcgcuacaugggagaggacggcuguugguaugggauggaaauucggccuaucaaugagaaggaggaaaacauggugaagucccugguuagcgcuggaucuggcaaaguggauaauuucacaauggggguccucugccuggccauucuuuucgaggaagugaugagaggaaaguuuggcaaaaagcauaugaucgccggcguucuguucaccuuugugcuccugcugagcgggcagauuacauggcgggacauggcucgcacccuuaucaugauuggauccaacgccagcgauagaaugggcaugggggucacguaccuggcgcucaucgcuacauucaaaauccagcccuuucuggcccucggauucuuucugcggaaacuuaccucuagagagaaucugcuccugggcguggggcuggccauggcuacaacccuucaacugcccgaagacauugagcagauggccaacggaaucgcucucggccugauggcccucaagcugauuacccaguucgagacauaucagcuuuggacggcgcuggugucccucauguguagcaauaccaucuuuacacugaccgucgccuggcgcacagcuacccugauucuugccggcaucucccugcucccuguuugccaaucuagcuccaugcggaaaacggauuggcugccgaugacaguggcugccaugggggugcccccucucccccuguucaucuuuucucuuaaggacacccugaaaagacgcagcuggccucugaacgaaggagucauggccgugggccucguuuccauucuggcuucuagccuucugagaaaugaugugcccauggcggggccucucgucgccggaggccugcucaucgcuuguuacgugauuaccgggacauccgccgaccugaccguugagaaggccgcuaacgugacaugggaagaggaagccgagcagacgggagucagccacaaccuuaugaucaccguggaugacgacggcacaaugcggauuaaagaugacgagaccgaaaauauccugacaguccugcucaagaccgcgcugcuuaucgugucuggcauuuuccccuauuccaucccggcuacgcugcucguuuggcauaccuggcagaaacagacacaacgcagcggggugcugugggaugucccuucucccccugagacccagaaggccgaacucgaggacggaguguacagaauuaagcagcagggcaucuuugggaaaacacaaguuggagugggcguccagaaggaggggguguuccacaccauguggcaugugacacggggagccguucugacgcacaacggcaaacgccuugaacccaauugggcuuccgucaagaaagaucugauuagcuacggcgggggauggagacugucugcccaguggcaaaagggcgaggaaguccaggugaucgcggucgagccggggaagaacccuaaaaauuuccagaccaugcccggaauuuuucagacaaccaccggcgaaaucggggcuaucgcccucgacuucaagccuggaacauccggcagccccauuaucaaccgggagggcaaagugguugggcuguauggaaauggcguggucacgaagaacgggggauacguguccggcauugcccaaaccaaugcugagcccgaugggccuacaccggaacuugaggaagagauguuuaaaaagcgcaaccugaccaucauggaccuccaccccggcagcggaaagacaagaaaauaucugccugccauuguucgggaagcuaucaagcgcagacuccggacccugauccuugcccccacgagaguggucgcggccgagauggaggaagcucugaaaggccugccuauucgcuaccagacaaccgccaccaagucugagcauacagggaaagaaaucguggaucucaugugccacgcuaccuucacaaugcggcugcuuagccccguuagagugccuaauuauaaccugauuaucauggacgaggcccauuuuaccgauccggccuccauugcugcgcgcggauacaucucuacgcgggucggcaugggggaagccgcugccaucuucaugacagccacacccccuggaacagcugacgccuuuccccagagcaaugcgccuauucaggaugaggagagagacauccccgaacgcuccuggaacucuggcaaugaguggauuaccgacuucgcugggaagacggugugguuugugccgagcaucaaggccggcaacgauauugccaacugucuccggaaaaauggaaagaaagucauccaacuguccagaaagaccuucgacacagaauaucagaaaaccaagcugaacgauugggacuuuguugugacaaccgauauuucugagaugggcgcuaauuucaaggccgaccgcgugaucgauccucggagaugccucaaacccgucauccuuacagacgggcccgagcgggugauucuggcgggaccuaugcccguuaccguggccagcgcugcccagcgcagaggccgggucgggcgcaacccucagaaggaaaaugaucaauacaucuucacgggacagccgcugaacaaugacgaggaucacgcucauuggacagaagccaaaaugcuccuggacaacauuaauacccccgagggcaucauuccugcucuuuuugaacccgagagagagaaguccgccgcgaucgacggggaauaccggcugaaaggcgagagcagaaagaccuucguggaacucaugcgccggggagaucugccuguuuggcuggcccacaaaguggcuucugagggcaucaaguauacagacagaaaguggugcuuugauggggaacgcaacaaucagauucucgaggagaacauggacgucgaaaucuggaccaaagagggagaaaagaagaaacuucggcccagauggcuggaugcccgcacauacuccgacccgcuggcucucaaagaguucaaagauuuugccgccggcagaaagagcauugcucuggaccuugugacggaaaucgggagagucccuucucaccuggcgcaucgcaccagaaaugcccucgauaaccuggugaugcugcacacauccgagcauggaggccgggcuuaucgccacgccguugaggaacuccccgagaccauggaaacacuucugcugcucggccugaugauucuucugaccgggggagccaugcuguuccugaucagcggcaaagggaucggaaagacguccauuggccugaucugugugguggcuucuagcgggaugcucuggauggccgacgucccucuucaguggauugcguccgccaucguucuggaguuuuucaugauggugcugcucauucccgagccugaaaaacaaagaacaccccaggauaaucagcuggcuuacguggucaucggcauucuuacacuggccgcuaucguggccgcgaacgagaugggccuccuggaaaccacaaagcgggaccugggcaugagcaaagagccggggguugugucuccuaucuccuaucucgaugucgaccuucaccccgccagcgcuuggacccuguacgccguggcuacgacagucauuacccccaugcugcgccauacaaucgaaaauucuaccgccaacgugagccucgcugccauugcgaaccaagccguugugcugaugggacuugacaagggcuggccuaucuccaagauggaucugggggucccgcuccuggcucugggaugcuauucucaggugaauccccucacccuuacagccgcuguucugcugcucgugacgcacuacgccauuaucggcccugggcugcaggccaaagcgaccagagaggcucagaagcggacagccgcuggaaucaugaaaaaccccaccgucgacggcauuaugacaaucgaucuugacccugugauuuacgauagcaaguuugagaaacaacugggccaggugaugcuccugauccugugugccguucagcuccuucugaugagaaccuccugggccuucugcgaagcucugacgcucgccacagggcccauuaccacccugugggagggaucuccuggcaaguuuuggaauacaaccaucgcggucagcauggccaacaucuuccgcggguccuaucuugcuggagccggccuggcuuuuagcauuaugaagucuguggggacaggaaaacggggcacgggcucccagggggaaacccucggagagaaguggaaaaagaaacugaaucaacugagcagaaaggaguucgaccucuacaaaaaguccggcaucacagagguggaucgcaccgaggccaaggaagggcuuaaacggggagagauuacacaucacgcggucucuagaggcagcgccaagcugcagugguucguugaacggaacauggugaucccggaggggcgcgugauugaccugggauguggcagaggcgggugguccuauuacugcgcuggacucaaaaaggucaccgaagugcggggcuauacgaaagggggacccggccaugaggagccuguucccaugucuaccuacggguggaauaucgugaagcugaugagcggaaaggaugucuuuuaucuuccucccgaaaaaugugacacacugcucugcgauauuggcgaguccagcccgucuccuaccguggaagagucccgcacaaucagaguucugaagaugguggagcccuggcugaaaaacaaucaguucuguaucaagguccucaaccccuacaugccuaccgugauugaacaccuugagcggcugcagcgcaaacacggcgggaugcuggugagaaauccccucagccggaacucuacacaugaaauguacuggaucuccaauggaaccggcaacauugucagcucuguuaauauggugagccgccugcuucugaacagauuuacgaugacacaccggagaccuaccaucgagaaggacguggaucucggggccggaacccgccaugucaacgcugaaccggagacacccaauauggacgugauuggcgagcggaucagacgcaucaaggaagaacacuccucuacguggcacuaugacgaugaaaacccuuacaaaaccugggccuaucaugggagcuacgagguuaaggcuacaggauccgccagcuccaugauuaauggcguggucaaacugcugaccaagcccugggacgugguuccuacagugacccaaauggcgaugacagauaccacgcccuucggccagcagcgggucuuuaaagaaaagguggacaccagaacaccgcgcccuaugcccgggacccggaagguuauggagaucacagccgaguggcucuggagaacccugggacgcaacaaacggccuagacuuugcacgcgcgaagaguucacaaagaaagugcggaccaaugcugccaugggcgcugucuuuacagaagagaaccaaugggauucugccagagccgcgguggaagacgaggaguucuggaagcuggucgaucgcgaaagagagcuccacaaacuggggaaguguggaagcugcguguauaauaugaugggcaaacgggaaaagaaacuuggggaguuuggcaaagcuaagggaucccgcgccauuugguacauguggcugggcgccagauaucucgaguucgaagcucugggguuucugaacgaggaccauugguucucucgggaaaauagcuacuccggaguugagggcgaagggcuccacaaacugggauacauccuuagagauauuucuaagauccccggcggggccauguaugcugacgauaccgccggcugggacacgcggaucaccgaggacgaucugcauaacgaggagaagauuacacagcagauggacccugagcaccgccagcucgcgaaugccaucuuuaagcugaccuaccaaaacaagguggucaaagugcagagacccacaccgaagggaaccgugauggauauuaucagccggaaagaccagcgcggcuccgggcagguuggaacauauggccuuaauaccuucacgaacauggaagcucaacugauuagacagauggagggggaaggagugcucagcaaggccgaucuggagaauccucaccuccucgagaaaaagaucacacaguggcuggaagcugagggcgucgaacggcuuaagcgcauggccaucucuggggacgauugcgugguuaaacccauugacgauagauucgcgaacgcccugcucgcucugaacgacaugggcaaggugcggaaagauaucccccaguggcaaccuuccaagggauggcaugacuggcagcaggucccguuuuguagccaccauuuccacgagcuuauuaugaaagauggccgcaagcuggugguccccugcagaccucaggacgaacucaucgggcgggcccgcauuucucaaggagcuggcuggucccugaaggagaccgccugucuggggaaggcuuacgcccagaugugggcgcucauguauuuucacagacgggaccugcgccuugccagcaaugcuaucugcucugccgugcccguucauugggugccuaccuccagaacaaccuggagcauucacgcccaucaccaguggaugacaacggaggauaugcugaccgucuggaaccggguguggaucgaagacaaucccuggauggaggauaagacaccuguuaccacaugggaagacgugcccuaccucggaaaaagagaggaucaaugguguggcucccugaucgggcauaccagccgcgcuacgugggcccagaacauucuuaccgcgauccagcagguccggucucugauuggcaaugaggaguuccucgacuauaugccgagcaugaagagauuucgcaaagaggaagaguccgaaggagcuaucugguga

SEQ ID NO: 20352 - RNA, 9873 nt, Artificial Sequence
  derived and/or modified CDS sequence (opt5) from DENV-3__AB214879__SS-prME
accagccugugccucaugaugaugcugcccgccacacuugcuuuccaccugacgucccgggacggagagccucggaugaucguggggaagaacgagcgcgggaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccagacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccgugcugccugaauacggcacccuggggcucgagugcagcccccgcacgggacuggacuuuaaugagaugauucuucugaccaugaaaaacaaggcuuggaugguccauagacagugguucuuugaucucccucugcccuggacaucuggcgccaccacagaaaccccgacguggaauaaaaaggagcuucuggugacauucaaaaacgcccacgcuaagaagcaagaaguugugguccucgggucccaggagggagcgaugcacaccgcccugacaggcgcuaccgaaauccagaccagcgggggcacaucuguguuugccggacaucugaaaugucggcucaagauggacaaacuggagcuuaagggcauguccuaugccaugugcagcaaugcuuucguucugaaaaaggagguguccgaaacgcagcacgggaccauucucaucaaggucgaguacaaaggagaagaugccccuuguaagauucccuucucuacagaggacggccaagggaaagcgcauaacggacgccugaucaccgcuaacccuguggugacaaagaaagaggaacccguuaauaucgaggccgaacccccuuuuggcgagagcaacauuaucauugggaucggcgauaaggcccugaagauuaauugguacaaaaagggauccagcaucggcaaaauguucgaagcuaccgccagaggggcucggagaauggccauccuuggagacacggcgugggauuuuggcucugucgggggagugcucaacucccugggcaagauggugcaccagauuuucgggagcgccuauacagcucuguuuucuggcgucagcuggaucaugaaaauuggaaucggcgugcuccugaccuggauugggcuuaauuccaagaacaccucuaugagcuucuccugcaucguuauuggaaucaucacacuguaccucggcgccgugguccaggcugacauggggugugugauuaauuggaagggaaaagagcugaagugcggcagcgggaucuuuguuaccaacgaggugcauacauggacggaacaguauaaauuccaagccgauucuccgaagcgccuggcgaccgccauugcuggcgccugggagaauggagucuguggcauccgguccacaaccagaauggaaaaccuucucuggaaacagauugcuaaugagcugaacuacauccugugggaaaauaacaucaagcucacagugguugugggggacauuaucggaguccuggagcagggcaaacgcacccuuacgccccagccuauggagcugaaguauagcuggaagaccugggggaaagccaagauugugacagccgaaacccaaaauucuuccuuuaucauugauggacccaacacaccugagugccccagcgcuucccgggcguggaacgugugggaagucgaggacuacggcuucggcguuuuuaccacaaauaucuggcucaaacugagagaaauguauacccagcugugugaccaccgccuuaugucugccgcugugaaggaugagcgggccgugcacgccgacaugggguacuggaucgagagccagaaaaacggauccuggaagcucgaaaaggcuucucugauugaggucaaaacgugcacauggcccaagagccauacccugugguccaauggcgugcucgaaagcgauaugaucauuccuaaaucucuggccgggcccaucucccagcacaacuacagaccuggauaucauacccaaacagcgggccccuggcaccuugggaagcuggagcucgacuucaauuacugcgagggaaccacgguugugauuacagaaaacuguggcacccgcggcccuagccugcggacaaccacagucucugggaaacugauccacgaguggugcuguagauccugcacccuucccccgcuccgcuauaugggagaagauggcuguugguacgggauggagauccggccuauuaaugaaaaggaggagaacauggucaagagccugguuucugcuggaagcggcaaaguggacaauuuuacgauggggguccugugccucgccauccuguucgaagaggugaugagaggaaaguucggcaaaaagcauaugauugccggcguucuuuuuaccuucgugcugcuccuguccgggcagaucacauggcgggauauggcucgcacccugauuaugaucggaagcaacgccucugacagaaugggcaugggggucacauaucuugcgcugauugcuaccuuuaaaauccagcccuuccucgcccugggauuuuuccuccggaagcugacguccagagaaaaucuucugcucggcguggggcuggccauggcuacaacccugcaacuucccgaggauaucgaacagauggccaacggaauugcucugggccucauggcccugaagcucaucacacaguuugagaccuaccagcuguggaccgcgcuuacaagccugauguguuccaauacgauuuucacccucacaguggccuggcgcaccgcuacacugauccuggccggcauuucucuucugccugucugccaaagcuccucuaugcggaaaaccgacuggcucccgaugacgguugcugccaugggggugcccccucugccccucuuuaucuucagccugaaggauacacuuaaaagacgcuccuggccucugaacgagggagugauggccgucggccuggugucuauccucgcuagcucccugcuuagaaaugacguucccauggcggggccucugguggccggaggccuccugauugcuuguuaugucaucaccgggaccagcgccgaucucacaguggaaaaggccgcugacguuaccugggaggaagaggccgaacagacaggagugucucacaaccugaugauuacggucgacgaugacggcaccaugcggaucaaagaugacgagacagagaacauucuuaccgugcugcugaagacagcgcuccugaucgucuccggcaucuuucccuacagcauuccggcuacccuucugguguggcauacguggcagaaacagacccaacgcucugggguucucugggaugugccuagcccgccugaaacacagaaggccgagcuggaagagggagucuacagaaucaagcagcagggcauuuucgggaaaacccaagugggaguuggcgugcagaaggagggggucuuucacacaauguggcaugugacccggggagccgugcucacacacaauggcaaacgccuggaacccaacugggcuagcguuaagaaagaccuuaucucuuauggcgggggauggagacuguccgcccaguggcaaaagggcgaggaaguccaggugauugcgguggagccggggaagaauccuaaaaacuuccagacgaugcccggaaucuuccagaccacaaccggcgaaauuggggcuaucgcccuggauuuuaagccuggaaccagcggcucccccaucauuaaucgggagggcaaagucguggggcucuacggaaacggcguugugacaaagagcgggggauaugucucuggcaucgcccaaacgaaugcugagcccgacgggccuaccccggaacuggaggaagagauguucaaaaagcgcaaccuuacaauuauggaucugcaccccggcagcggaaagaccagaaaauaccucccugccaucgugcgggaagcuauuaagcgcagacugcggacacucauccuggcccccaccagaguuguggcggccgagauggaggaagcucuuaaaggccugccuauccgcuaucagacgacagccaccaaguccgagcauaccgggaaagaaauugucgaccugaugugccacgcuacauuuaccaugcggcuccugucucccgugagaguuccuaauuacaaccuuaucauuauggaugaggcccauuucacagacccggccagcaucgcugcgcgcggauauauuuccacccgggugggcaugggggaagccgcugccaucuuuaugacggccacacccccuggaaccgcugaugccuucccccagucuaaugcgccuauccaggacgaggagagagacauucccgaacgcagcuggaacuccggcaaugauuggaucacagacuuugcugggaagaccgucugguucgugccgucuauuaaggccggcaacgauaucgccaauugucugcggaaaaacggaaagaaagugauucaacucagcagaaagacguuugacaccgaguaccagaaaacaaagcugaacgauugggacuucgucguuaccacagauaucuccgaaaugggcgcuaauuuuaaggccgaccgcgugauugauccucggagaugccugaaacccgugauccucaccgacgggcccgagcgggucauccuugcgggaccuaugcccgugacaguugccagcgcugcccagcgcagaggccggguggggcgcaacccucagaaggagaaugaucaauacauuuucaccggacagccgcugaacaaugacgaagaccacgcucauuggacggaggccaaaaugcugcucgauaacaucaauacacccgaaggcauuaucccugcucuguucgagcccgaaagagagaagucugccgcgauugacggggaguaucggcuuaaaggcgaauccagaaagaccuuugucgagcugaugcgccggggagaucucccuguguggcuggcccacaaaguugcuagcgaaggcaucaaguacaccgacagaaaguggugcuucgauggggagcgcaacaaucagauccuggaagagaacauggacguggagauuuggacaaaagaaggagagaagaaaaagcuccggcccagauggcuugaugcccgcaccuauucugacccgcuggcucugaaagaauuuaaggauuucgccgccggccggaaguccaucgcuuuugaccucgucacagagauugggagagugccuagccaccuggcgcaucgcacgagaaaugcccuugauaaccuggucaugcuccacaccuccgaacauggaggccgggcuuaccgccacgccguggaggagcugcccgaaacaauggagacccugcuccuucugggccugaugauccuccugacagggggagccaugcuuuuccugauuucuggcaaagggaucggaaagaccagcaucggccucauuuguguuguggcuuccagcgggaugcuguggauggccgacaucccucugcaguggauugcgucugccaucgugcucgaauuuuucaugaugguccuucugauucccgagccugagaaacaaagaacgccccaggauaaucagcuggcuuauguugugaucggcauucucacccuggccgcuaucguggccgcgaacgaaaugggccuucuggagacaaccaagcgggaccucggcauguccaaagaaccgggggucgugagcccuacaucuuaccuggacguugaucugcaccccgccagcgcuuggacccucuaugccguggcuacgacagucaucacccccaugcuucgccauacaauugaaaauuccaccgccaacgugucucuggcugccaucgcgaaucaagccgucgugcugaugggacucgacaagggcuggccuauuagcaagauggaucuggggguuccgcuucuggcucucggaugcuacucccaggugaacccccugacccugacagccgcuguccuccuucuggugacgcacuacgccaucauuggcccugggcugcaggccaaagcgaccagagaagcucagaagcggacagccgcuggaaucaugaaaaaccccaccguugacggcaucaugacaauugaucucgacccugugaucuaugauucuaaguuugagaaacaacugggccaggucaugcuucuggugcucugugccgugcagcugcugcucaugagaaccagcugggccuucugcgaggcucuuacgcuggccacagggcccauuaccacccugugggaaggauccccuggcaaguuuuggaauacaaccaucgcgguuagcauggccaacauuuuccgcgggucuuaccucgcuggagccggccuggcuuuuuccaucaugaaguccgucgggacaggaaaacggggcacgggcucccagggggagacccuuggagaaaaguggaaaaagaaacugaaucaacucucuagaaaggaguucgaccuguauaaaaagagcggcaucacagaaguggaucgcaccgaggccaaggaggggcugaaacggggagaaauuacacaucacgcgguguccagaggcucugccaagcuccagugguucgucgagcggaacaugguuaucccggaagggcgcgugauugaccuuggauguggcagaggcggguggagcuacuauugcgcuggacugaaaaaggugaccgagguccggggcuacacgaaagggggacccggccaugaggaaccugugcccauguccaccuauggguggaauaucguuaagcugaugagcggaaaggauguguuuuaccucccucccgagaaaugugacacacugcuuugcgauauuggcgaaucuuccccgagcccuaccgucgaggaaucucgcacaaucagagugcugaagaugguugagcccuggcucaaaaacaaucaguucuguauuaaggugcugaaccccuacaugccuaccgucaucgagcaccuggaacggcuccagcgcaaacacggcgggaugcuugugagaaauccccugucccggaacagcacacaugagauguauuggaucucuaauggaaccggcaacauugugagcuccgucaauaugguuucucgccugcuccugaacagauuuacgaugacauaccggagaccuaccaucgaaaaggacguggaccuuggggccggaacccgccacgugaaugcugagccggaaacacccaacauggaugucauuggcgagcggaucagacgcauuaaggaggaacauagcuccacguggcacuaugacgaugagaacccuuacaaaaccugggccuaucacgggagcuacgaagugaaggcuacaggauccgccucuagcaugaucaauggcguugugaaacugcucaccaagcccugggacgucgugccuacaguuacccaaauggcgaugacagauaccacgcccuucggccagcagcggguguuuaaagagaaggucgacaccagaacaccgaagccuaugcccgggacccgcaaagugauggaaaucacagccgaguggcuguggcggacccugggaagaaacaagcgcccucggcucugcacgagagaggaguucaccaaaaagguucgcaccaaugcugccaugggcgcuguguuuacagaggaaaaccaaugggauuccgcccgggccgcggucgaggacgaagaguucuggaaacugguggauagagagcgcgaacuucauaagcuggggaaauguggaucuugcgucuauaauaugaugggcaagagagagaagaaacucggggaauuuggcaaggcuaaaggaagccgggccauuugguacauguggcugggcgcccgcuaccuugaguucgaggcucugggguuucucaacgaagaccacugguucuccagagaaaauucuuauagcggaguggaaggcgaggggcugcauaagcugggauacauccuccgggauauuuccaaaauccccggcggggccauguaugcugacgacaccgccggcugggauacgagaauuaccgaagacgaucugcacaacgaggagaagaucacacagcagauggacccugaacaucggcagcuugcgaaugccaucuuuaagcugaccuaccaaaacaaaguugugaagguccagcgccccacaccgaaaggaaccgugauggauauuaucagcagaaaggaccagcggggcucuggacaggugggaacauauggccucaauaccuucacgaacauggaggcucaacugauucgccagauggaaggggagggaguucuuuccaaaacagaucuggaaaauccucaccuccuggagaagagaaucacccaguggcuggagaccaagggcguggaacggcucaaacgcauggccauuagcggggacgauugcgucgugaagcccaucgacgauagauucgcuaacgcccugcuugcgcugaaugacaugggcaaaguucggaaggauaucccccaguggcaaccuucuaaaggauggcacgacuggcaacaggugccguuuuguucccaucacuuccaugagcucauuaugaaggacggccgcaagcuggucgugcccugcagaccucaggaugaacuuaucgggcgggcccgcauuagccaaggagcuggcuggucucugaaagagacagccugucucgggaaggcuuacgcccagaugugggcucugauguauuuucacagacgggaccugcgccucgccuccaacgcgaucugcagcgccguccccgugcacuggguuccuaccuccagaacaacguggagcauucaugcucaccaucaguggaugaccacagaagauaugcugaccguguggaaccgggucuggaucgaggacaaucccuggauggaggauaaaacaccugugaccacgugggaagacguucccuaccuuggaaagagagaggaucaaugguguggcucucugauugggcucaccagccgcgccacaugggcccagaacauccugaccgcuauccaacaggugcggucccuuauuggcaaugaagaguuccuggacuacaugccgucuaugaaaagauuucgcaaggaggaagagagcgaaggagccaucugguga

SEQ ID NO: 20353 - RNA, 9873 nt, Artificial Sequence
  derived and/or modified CDS sequence (opt5) from DENV-3__AB214880__SS-prME
accagccugugccucaugaugaugcugcccgccacccuugcuuuccaccugacgucccgggacggcgagccucggaugaucguggggaagaacgagcgcgggaaaucucuccuguuuaagaccgccagcggcauuaauauguguacccuuaucgcgauggaucugggggagaugugcgacgauaccguuacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccgugcugccugaauacggcacccuggggcucgagugcagcccccgcacgggacuggacuuuaaugagaugauucuucugaccaugaaaaacaaggcuuggaugguccauagacagugguucuuugaucucccucugcccuggacaucuggcgccaccacagaaaccccgacguggaauaaaaaggagcuucuggugacauucaaaaacgcccacgcuaagaagcaagaaguugugguccucgggucccaggagggagcgaugcacaccgcccugacaggcgcuaccgaaauccagaccagcgggggcacaucuauuuuugccggacaucugaaaugucggcucaagauggacaaacuggagcuuaagggcauguccuaugccaugugcagcaaugcuuucgugcugaaaaaggagguuuccgaaacgcagcacgggaccauccucauuaagguggaguacaaaggagaagaugccccuuguaagauccccuucucuacagaggacggccaagggaaagcgcauaacggacgccugaucaccgcuaacccugucgugacaaagaaagaggaacccgugaauauugaggccgaacccccuuuuggcgagagcaacaucauuaucgggauuggcgauaaggcccugaagaucaauugguacaaaaagggauccagcaucggcaaaauguucgaagcuaccgccagaggggcucggagaauggccauucuuggagacacggcgugggauuuuggcucuguugggggaguccucaacucccugggcaagauggugcaccagaucuucgggagcgccuauacagcucuguuuucuggcgugagcuggauuaugaaaaucggaauuggcguccuccugaccuggaucgggcuuaauuccaagaacaccucuaugagcuucuccugcauugugaucggaaucauuacacuguaccucggcgccguugugcaggcugacauggggugugucaucaauuggaagggaaaagagcugaagugcggcagcgggauuuuugugaccaacgagguucauacauggacggaacaguauaaauuccaagccgauucuccgaagcgccuggcgaccgccaucgcuggcgccugggagaauggaguguguggcauucgguccacaaccagaauggaaaaccuucucuggaaacagaucgcuaaugagcugaacuacauccugugggaaaauaacauuaagcucacagucgugguuggggacaucauuggagugcuggagcagggcaaacgcacccuuacgccccagccuauggagcugaaguauagcuggaagaccugggggaaagccaagaucgucacagccgaaacccaaaauucuuccuuuauuaucgauggacccaacacaccugagugccccagcgcuucccgggcguggaacgugugggaaguggaggacuacggcuucggcgucuuuaccacaaauaucuggcucaaacugagagaaauguauacccagcugugugaccaccgccuuaugucugccgcuguuaaggaugagcgggccgugcacgccgacaugggguacuggauugagagccagaaaaacggauccuggaagcucgaaaaggcuucucugaucgaggugaaaacgugcacauggcccaagagccauacccugugguccaauggcguccucgaaagcgauaugauuaucccuaaaucucuggccgggcccauuucccagcacaacuacagaccuggauaucauacccaaacagcgggccccuggcaccuugggaagcuggagcucgacuucaauuacugcgagggaaccacggugguuaucacagaaaacuguggcacccgcggcccuagccugcggacaaccacagugucugggaaacugauccacgaguggugcuguagauccugcacccuucccccgcuccgcuauaugggagaagauggcuguugguacgggauggagauucggccuaucaaugaaaaggaggagaacauggucaagagccuggugucugcuggaagcggcaaaguugacaauuuuacgaugggggugcugugccucgccauucuguucgaagaggucaugagaggaaaguucggcaaaaagcauaugaucgccggcgugcuuuuuaccuucguucugcuccuguccgggcagauuacauggcgggauauggcucgcacccugaucaugauuggaagcaacgccucugacagaaugggcaugggggugacauaucuugcgcugaucgcuaccuuuaaaauccagcccuuccucgcccugggauuuuuccuccggaagcugacguccagagaaaaucuucugcucggcgucgggcuggccauggcuacaacccugcaacuucccgaggauauugaacagauggccaacggaaucgcucugggccucauggcccugaagcucauuacacaguuugagaccuaccagcuguggaccgcgcuugccagccugauguguuccaauacaaucuucacgcucaccguggcuuggcgcacagccacccugauucuggcuggcaucucucuucugccugugugccaaagcuccucuaugcggaaaacagacuggcucccgaugaccgucgccgccauggggguucccccucugccccucuuuaucuucagccugaaggauacgcuuaaaagacgcuccuggccucugaacgagggagugauggcugugggccuggucucuauucucgcgagcucccugcuuagaaaugacgugcccauggccgggccucugguugcuggaggccuccugaucgccuguuaugugauuacagggaccagcgccgaucucaccgucgaaaaggcugccgacgugacaugggaggaagaggcggaacagaccggaguuucucacaaccugaugaucacaguggacgaugacggcacgaugcggauuaaagaugacgagaccgagaacauccuuacaguccugcugaagaccgcucuccugaucguguccggcauuuuucccuacagcaucccggccacacuucuggucuggcauaccuggcagaaacagacgcaacgcucuggggugcucugggauguuccuagcccgccugaaacccagaaggccgagcuggaagagggaguguacagaauuaagcagcagggcaucuucgggaaaacacaagucggagugggcguucagaaggaggggguguuucacaccauguggcaugucacacggggagcugugcucacccacaauggcaaacgccuggaacccaacugggccagcgugaagaaagaccuuauuucuuauggcgggggauggagacuguccgcgcaguggcaaaagggcgaggaaguucaggucaucgcuguggagccggggaagaauccuaaaaacuuccagacaaugcccggaauuuuccagacgaccacaggcgaaaucggggccaucgcccuggauuuuaagccuggaaccagcggcucccccauuaucaaucgggagggcaaaguggucgggcucuacggaaacggcgugguuaccaagagcgggggauaugugucuggcauugcucaaacaaaugccgagcccgacgggccuacgccggaacuggaggaagagauguucaaaaagcgcaaccuuaccaucauggaucugcaccccggcagcggaaagacaagaaaauaccucccugcuauuguccgggaagccaucaagcgcagacugcggacccucauccuggcgcccacaagagugguugccgcugagauggaggaagcccuuaaaggccugccuauucgcuaucagaccacggcuacaaaguccgagcauaccgggaaagaaaucguggaccugaugugccacgccaccuuuacaaugcggcuccugucucccgucagagugccuaauuacaaccuuauuaucauggaugaggcccauuucaccgacccggcuagcauugcggcccgcggauauaucuccacacggguuggcaugggggaagcugccgccaucuuuaugaccgcuacgcccccuggaacagccgaugcguucccccagucuaaugcuccuauucaggacgaggagagagacauccccgaacgcagcuggaacuccggcaaugauuggauuaccgacuuugccgggaagacagugugguucgucccgucuaucaaggccggcaacgauauugcuaauugucugcggaaaaacggaaagaaagugauccaacucagcagaaagaccuuugacacggaguaccagaaaaccaagcugaacgauugggacuucguggucacaaccgauauuuccgaaaugggcgccaauuuuaaggcggaccgcguuaucgauccucggagaugccugaaacccgugauccucacagacgggcccgagcgggugauucuugccggaccuaugcccgucaccguggcuagcgccgcucagcgcagaggccggguugggcgcaacccucagaaggagaaugaucaauacaucuucacaggacagccgcugaacaaugacgaagaccacgcccauuggaccgaggcuaaaaugcugcucgauaacauuaauacgcccgaaggcaucauuccugcccuguucgagcccgaaagagagaagucugcggccaucgacggggaguaucggcuuaaaggcgaauccagaaagacauuuguggagcugaugcgccggggagaucucccugucuggcuggcucacaaaguggccagcgaaggcaucaaguacaccgacagaaaguggugcuucgauggggagcgcaacaaucagauucuggaagagaacauggacguugagaucuggaccaaagaaggagagaagaaaaagcuccggcccagauggcuugaugcucgcacauauucugacccgcuggcccugaaagaauuuaaggauuucgccgcuggccggaaguccauugcguuugaccucgugaccgagaucgggagagucccuagccaccuggcccaucgcacaagaaaugcucuugauaaccuggugaugcuccacacguccgaacauggaggccgggccuaccgccacgccgucgaggagcugcccgaaaccauggagacacugcuccuucugggccugaugauucuccugaccgggggagcuaugcuuuuccugaucucuggcaaagggaucggaaagacaagcauuggccucaucugugugguugccuccagcgggaugcuguggauggcggacauuccucugcaguggaucgccucugcuauugugcucgaauuuuucaugauggugcuucugauccccgagccugagaaacaaagaacaccccaggauaaucagcuggccuaugucguuauuggaauccucacgcuggcugccaucguggcggccaacgaaaugggccuucuggagaccacaaagcgggaccucggcauguccaaagaaccggggguggucagcccuaccucuuaccuggacguggaucugcaccccgcuagcgccuggacacucuaugcuguugccaccacggugauuacacccaugcuucgccauaccaucgaaaauuccacagcuaacgucucucuggccgcgauugccaaucaagcugugguccugaugggacucgacaagggcuggccuaucagcaagauggaucugggggugccgcuucuggcccucggaugcuacucccagguuaacccccugacccugaccgcugccgugcuccuucuggucacacacuacgccauuaucggcccugggcugcaggcgaaagcuacgagagaagcccagaagcggaccgcugccggaaucaugaaaaaccccacaguggacggcauuaugaccaucgaucucgacccuguuauuuaugauucuaaguuugagaaacaacugggccaggugaugcuucugguccucugugccgugcagcugcugcucaugagaacaagcugggcuuucugcgaggcccuuacccuggcgacggggcccaucacaacccugugggaaggauccccuggcaaguuuuggaauaccacaauugccgugagcauggcuaacaucuuccgcgggucuuaccucgccggagcuggccuggccuuuuccaucaugaaguccguugggaccggaaaacggggcacaggcucccagggggagacgcuuggagaaaaguggaaaaagaaacugaaucaacucucuagaaaggaguucgaccuguauaaaaagagcggcauuaccgaagucgaucgcacagaggcgaaggaggggcugaaacggggagaaaucacccaucacgccguguccagaggcucugcuaagcuccagugguucguggagcggaacauggucauuccggaagggcgcguuaucgaccuuggauguggcagaggcggguggagcuacuauugcgccggacugaaaaaggugacagaggugcggggcuacaccaaagggggacccggccaugaggaaccuguccccauguccacguauggguggaauauugugaagcugaugagcggaaaggaugucuuuuaccucccucccgagaaaugugacacccugcuuugcgauaucggcgaaucuuccccgagcccuacaguggaggaaucucgcaccauuagaguccugaagaugguggagcccuggcucaaaaacaaucaguucuguaucaagguucugaaccccuacaugccuacagugaucgagcaccuggaacggcuccagcgcaaacacggcgggaugcuugucagaaauccccugucccggaacagcacccaugagauguauuggauuucuaauggaacaggcaacaucgugagcuccgugaauauggucucucgccugcuccugaacagauuuaccaugacguaccggagaccuacaauugaaaaggacguugaccuuggggcuggaacccgccacgugaaugccgagccggaaacccccaacauggaugugaucggcgagcggauuagacgcaucaaggaggaacauagcuccacauggcacuaugacgaugagaacccuuacaaaacgugggcuuaucacgggagcuacgaagucaaggccaccggauccgcgucuagcaugaucaauggcgugguuaaacugcucacaaagcccugggacguggucccuaccgugacacaaauggccaugaccgauacaacccccuucggccagcagcggguuuuuaaagagaagguggacacgagaaccccgaagccuaugcccgggacacgcaaagucauggaaauuaccgcugaguggcuguggcggacacugggaagaaacaagcgcccucggcucugcaccagagaggaguucacgaaaaaggugcgcacaaaugccgcuaugggcgccguuuuuaccgaggaaaaccaaugggauuccgcccgggcggcuguggaggacgaagaguucuggaaacuggucgauagagagcgcgaacuucauaagcuggggaaauguggaucuugcguguauaauaugaugggcaagagagagaagaaacucggggaauuuggcaaggccaaaggaagccgggccaucugguacauguggcugggcgcucgcuaccuugaguucgaggcccugggguuucucaacgaagaccacugguucuccagagaaaauucuuauagcggagucgaaggcgaggggcugcauaagcugggauacauucuccgggauaucuccaaaauucccggcggggcuauguaugccgacgacacagcgggcugggauaccagaaucacggaagacgaucugcacaacgaggagaagaucacccagcagauggacccugaacaucggcagcuugccaaugcuauuuuuaagcugacauaccaaaacaaagugguuaaggugcagcgccccaccccgaaaggaacagucauggauaucauuagcagaaaggaccagcggggcucuggacaggugggaaccuauggccucaauacauucaccaacauggaggcccaacugauccgccagauggaaggggagggagugcuuuccaaaacggaucuggaaaauccucaccuccuggagaagagaauuacacaguggcuggagaccaagggcguugaacggcucaaacgcauggcuaucagcggggacgauugcguggucaagcccaucgacgauagauucgccaacgcgcugcuugcccugaaugacaugggcaaagugcggaaggauauuccccaguggcaaccuucuaaaggauggcacgacuggcagcagguuccguuuuguucccaucacuuccaugagcucaucaugaaggacggccgcaagcuggugguccccugcagaccucaggaugaacuuauugggcgggcucgcaucagccaaggagccggcuggucucugaaagagaccgcuugucucgggaaggccuacgcucagaugugggcccugauguauuuucacagacgggaccugcgccucgcguccaacgccauuugcagcgcugugcccguccacugggugccuacauccagaaccacauggagcauccaugcccaccaucaguggaugacgaccgaagauaugcugacaguuuggaaccggguguggauugaggacaaucccuggauggaggauaaaaccccugucacaaccugggaagacgugcccuaccuuggaaagagagaggaucaaugguguggcucucugaucgggcucacgagccgcgccaccugggcucagaacauccugacagccauucagcagguucggucccuuaucggcaaugaagaguuccuggacuacaugccgucuaugaaaagauuucgcaaggaggaagagagcgaaggagcgauuugguga

SEQ ID NO: 20354 - RNA, 9873 nt, Artificial Sequence
  derived and/or modified CDS sequence (opt5) from DENV-3__AB214881__SS-prME
accagccugugccucaugaugaugcugcccgccacccuugcuuuccaccugacguccagagacggcgagccucggaugaucguggggaagaacgaacgcggaaaaucucuccuguuuaagaccgccagcggcauuaauauguguacccuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccagacauggaugagcgcugagggcgccuggcggcaggucgaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccgugcugccugaauacggcacccuggggcucgagugcagcccccgcacgggacuggacuuuaaugagaugauucuucugaccaugaaaaacaaggcuuggaugguccauagacagugguucuuugaucucccucugcccuggacaucuggcgccaccacagaaaccccgacguggaauaaaaaggagcuucuggugacauucaaaaacgcccacgcuaagaagcaagaaguugugguccucgggucccaggagggagcgaugcacaccgcccugacaggcgcuaccgaaauccagaccagcgggggcacaucuauuuuugccggacaucugaaaugucggcucaagauggacaaacuggagcuuaagggcauguccuaugccaugugcagcaaugcuuucgugcugaaaaaggagguuuccgaaacgcagcacgggaccauccucauuaagguggaguacaaaggagaagaugccccuuguaagauccccuucucuacagaggacggccaagggaaagcgcauaacggacgccugaucaccgcuaacccugucgugacaaagaaagaggaacccgugaauauugaggccgaacccccuuuuggcgagagcaacaucauuaucgggauuggcgauaaggcccugaagaucaauugguacaaaaagggauccagcaucggcaaaauguucgaagcuaccgccagaggggcucggagaauggccauucuuggagacacggcgugggauuuuggcucuguugggggaguccucaacucccugggcaagauggugcaccagaucuucgggagcgccuauacagcucuguuuucuggcgugagcuggauuaugaaaaucggaauuggcguccuccugaccuggaucgggcuuaauuccaagaacaccucuaugagcuucuccugcauugugaucggaaucauuacacuguaccucggcgccguugugcaggcugacauggggugugucaucaauuggaagggaaaagagcugaagugcggcagcgggauuuuugugaccaacgagguucauacauggacggaacaguauaaauuccaagccgauucuccgaagcgccuggcgaccgccaucgcuggcgccugggagaauggaguguguggcauucgguccacaaccagaauggaaaaccuucucuggaaacagaucgcuaaugagcugaacuacauccugugggaaaauaacauuaagcucacagucgugguuggggacaucauuggaauccuggagcagggcaaacgcacccuuacgccccagccuauggagcugaaguauagcuggaagaccugggggaaagccaagauugugacagccgaaacccaaaauucuuccuuuaucaucgauggacccaacacaccugagugccccagcgcuucccgggcguggaacgucugggaaguggaggacuacggcuucggcguguuuaccacaaauauuuggcucaaacugagagaaauguauacccagcugugugaccaccgccuuaugucugccgcugucaaggaugagcgggccguucacgccgacaugggguacuggaucgagagccagaaaaacggauccuggaagcucgaaaaggcuucucugauugaggugaaaacgugcacauggcccaagagccauacccugugguccaauggcgugcucgaaagcgauaugaucauuccuaaaucucuggccgggcccaucucccagcacaacuacagaccuggauaucauacccaaacagcgggccccuggcaccuugggaagcuggagcucgacuucaauuacugcgagggaaccacggucgugaucacagaaaacuguggcacccgcggcccuagccugcggacaaccacaguuucugggaaacugauucacgaguggugcuguagauccugcacccuucccccgcuccgcuauaugggagaagauggcuguugguacgggauggagauccggccuauuaaugaaaaggaggagaacauggucaagagccuggucucugcuggaagcggcaaaguggacaauuuuacgauggggguucugugccucgccauccuguucgaagaggugaugagaggaaaguucggcaaaaagcauaugauugccggcguccuuuuuaccuucgugcugcuccuguccgggcagaucacauggcgggauauggcucgcacccugauuaugaucggaagcaacgccucugacagaaugggcauggggguuacauaucuugcgcugaucgcuaccuuuaaaauucagcccuuccucgcccugggauuuuuccuccggaagcugacguccagagaaaaucuucugcucggcguggggcuggccauggcuacaacccugcaacuucccgaggauaucgaacagauggccaacggaauugcucugggccucauggcccugaagcucaucacacaguuugagaccuaccagcuguggaccgcgcuugccagccugauguguuccaauacaauuuucacgcucaccgucgcuuggcgcacagccacccugauccuggcuggcaucucucuucugccugugugccaaagcuccucuaugcggaaaacagacuggcucccgaugaccguggccgccaugggggugcccccucugccccucuuuauuuucagccugaaggauacgcuuaaaagacgcuccuggccucugaacgagggaguuauggcugugggccuggugucuauccucgcgagcucccugcuuagaaaugacguccccauggccgggccucugguggcuggaggccuccugauugccuguuauguuaucacagggaccagcgccgaucucaccguggaaaaggcugccgacgucacaugggaggaagaggcggaacagaccggagugucucacaaccugaugauuacaguugacgaugacggcacgaugcggaucaaagaugacgagaccgagaacauccuuacagugcugcugaagaccgcucuccugauugucuccggcaucuuucccuacagcauuccggccacacuucugguguggcauaccuggcagaaacagacgcaacgcucugggguccucugggaugugccuagcccgccugaaacccagaaggccgagcuggaagagggaguuuacagaaucaagcagcagggcauuuucgggaaaacacaagugggagucggcgugcagaaggaggggguuuuucacaccauguggcaugugacacggggagcuguccucacccacaauggcaaacgccuggaacccaacugggccagcgugaagaaagaccuuaucucuuauggcgggggauggagacuguccgcgcaguggcaaaagggcgaggaagugcagguuauugcugucgagccggggaagaauccuaaaaacuuccagacaaugcccggaaucuuccagacgaccacaggcgaaaucggggccauugcccuggauuuuaagccuggaaccagcggcucccccaucauuaaucgggagggcaaagugguggggcucuacggaaacggcgucgugaccaagagcgggggauauguuucuggcaucgcucaaacaaaugccgagcccgacgggccuacgccggaacuggaggaagagauguucaaaaagcgcaaccuuaccauuauggaucugcaccccggcagcggaaagacaagaaaauaccucccugcuaucgugcgggaagccaucaagcgcagacugcggacccucauucuggcgcccacaagagucguggccgcugagauggaggaagcccuuaaaggccugccuauccgcuaucagaccacggcuacaaaguccgagcauaccgggaaagaaauuguugaccugaugugccacgccaccuuuacaaugcggcuccugucucccgugagagucccuaauuacaaccuuaucauuauggaugaggcccauuucaccgacccggcuagcaucgcggcccgcggauauaucuccacacgggugggcaugggggaagcugccgccauuuuuaugaccgcuacgcccccuggaacagccgaugcguucccccagucuaaugcuccuauccaggacgaggagagagacauucccgaacgcagcuggaacuccggcaaugauuggaucaccgacuuugccgggaagacaguuugguucgugccgucuauuaaggccggcaacgauaucgcuaauugucugcggaaaaacggaaagaaagucauucaacucagcagaaagaccuuugacacggaguaccagaaaaccaagcugaacgauugggacuucguggugacaaccgauaucuccgaaaugggcgccaauuuuaaggcggaccgcgucaucgauccucggagaugccugaaacccguuauucucacagacgggcccgagcgggugauccuugccggaccuaugcccgugaccgucgcuagcgccgcucagcgcagaggccggguggggcgcaacccucagaaggagaaugaucaauacauuuucacaggacagccgcugaacaaugacgaagaccacgcccauuggaccgaggcuaaaaugcugcucgauaacaucaauacgcccgaaggcauuaucccugcccuguucgagcccgaaagagagaagucugcggccaucgacggggaguaucggcuuaaaggcgaauccagaaagacauuuguugagcugaugcgccggggagaucucccuguguggcuggcucacaaagucgccagcgaaggcauuaaguacaccgacagaaaguggugcuucgauggggagcgcaacaaucagauccuggaagagaacauggacguggagauuuggaccaaagaaggagagaagaaaaagcuccggcccagauggcuugaugcucgcacauauucugacccgcuggcccugaaagaauuuaaggauuucgccgcuggccggaaguccaucgcguuugaccucguuaccgagauugggagagugccuagccaccuggcccaucgcacaagaaaugcucuugauaaccuggucaugcuccacacguccgaacauggaggccgggccuaccgccacgccguggaggagcugcccgaaaccauggagacacugcuccuucugggccugaugauccuccugaccgggggagcuaugcuuuuccugaucucuggcaaagggauuggaaagacaagcaucggccucauuugugucguggccuccagcgggaugcuguggauggcggacaucccucugcaguggauugccucugcuaucguucucgaauuuuucaugauggugcuucugauucccgagccugagaaacaaagaacaccccaggauaaucagcuggccuauguggucaucggaauccucacgcuggcugccauuguugcggccaacgaaaugggccuucuggagaccacaaagcgggaccucggcauguccaaagaaccggggguggugagcccuaccucuuaccuggacgucgaucugcaccccgcuagcgccuggacacucuaugcuguggccaccacgguuaucacacccaugcuucgccauaccauugaaaauuccacagcuaacgugucucuggccgcgaucgccaaucaagcugucgugcugaugggacucgacaagggcuggccuauuagcaagauggaucugggggucccgcuucuggcccucggaugcuacucccaggugaacccccugacccugaccgcugccguucuccuucuggugacacacuacgccaucaucggcccugggcugcaggcgaaagcuacgagagaagcccagaagcggaccgcugccggaauuaugaaaaaccccacagucgacggcaucaugaccauugaucucgacccugugaucuaugauucuaaguuugagaaacaacugggccagguuaugcuucuggugcucugugccguccagcugcugcucaugagaacaagcugggcuuucugcgaggcccuuacccuggcgacggggcccauuacaacccugugggaaggauccccuggcaaguuuuggaauaccacaaucgccgugagcauggcuaacaucuuccgcgggucuuaccucgccggagcuggccuggccuuuuccauuaugaaguccguggggaccggaaaacggggcacaggcucccagggggagacgcuuggagaaaaguggaaaaagaaacugaaucaacucucuagaaaggaguucgaccuguauaaaaagagcggcaucaccgaaguugaucgcacagaggcgaaggaggggcugaaacggggagaaauuacccaucacgccgucuccagaggcucugcuaagcuccagugguucguggagcggaacauggugaucccggaagggcgcgucauugaccuuggauguggcagaggcggguggagcuacuauugcgccggacugaaaaagguuacagaggugcggggcuacaccaaagggggacccggccaugaggaaccugugcccauguccacguauggguggaauaucgucaagcugaugagcggaaaggauguguuuuaccucccucccgagaaaugugacacccugcuuugcgauauuggcgaaucuuccccgagcccuacaguugaggaaucucgcaccaucagagugcugaagauggucgagcccuggcucaaaaacaaucaguucuguaucaaggugcugaaccccuacaugccuacaguuauugagcaccuggaacggcuccagcgcaaacacggcgggaugcuugugagaaauccccugucccggaacagcacccaugagauguauuggaucucuaauggaacaggcaacauugucagcuccgugaauauggugucucgccugcuccugaacagauuuaccaugacguaccggagaccuacaaucgaaaaggacgucgaccuuggggcuggaacccgccacguuaaugccgagccggaaacccccaacauggaugugauuggcgagcggaucagacgcaucaaggaggaacauagcuccacauggcacuaugacgaugagaacccuuacaaaacgugggcuuaucacgggagcuacgaagugaaggccaccggauccgcgucuagcaugauuaauggcgucgugaaacugcucacaaagcccugggacguugugccuaccgucacacaaauggccaugaccgauacaacccccuucggccagcagcggguguuuaaagagaagguugacacgagaaccccgaagccuaugcccgggacacgcaaagugauggaaaucaccgcugaguggcuguggcggacacugggaagaaacaagcgcccucggcucugcaccagagaggaguucacgaaaaagguccgcacaaaugccgcuaugggcgccguguuuaccgaggaaaaccaaugggauuccgcccgggcggcuguugaggacgaagaguucuggaaacugguggauagagagcgcgaacuucauaagcuggggaaauguggaucuugcgucuauaauaugaugggcaagagagagaagaaacucggggaauuuggcaaggccaaaggaagccgggccauuugguacauguggcugggcgcucgcuaccuugaguucgaggcccugggguuucucaacgaagaccacugguucuccagagaaaauucuuauagcggaguggaaggcgaggggcugcauaagcugggauacauccuccgggauauuuccaaaauccccggcggggcuauguaugccgacgacacagcgggcugggauaccagaaucacggaagacgaucugcacaacgaggagaagauuacccagcagauggacccugaacaucggcagcuugccaaugcuaucuuuaagcugacauaccaaaacaaagucgugaagguucagcgccccaccccgaaaggaacagugauggauauuaucagcagaaaggaccagcggggcucugggcaggucggaaccuauggccucaauacauucaccaacauggaggcccaacugauucgccagauggaaggggagggagugcuuuccaaaacggaucuggaaaauccucaccuccuggagaagagaaucacacaguggcuggagaccaagggcguggaacggcucaaacgcauggcuaucagcggggacgauugcguugugaagcccauugacgauagauucgccaacgcgcugcuugcccugaaugacaugggcaaaguccggaaggauaucccccaguggcaaccuucuaaaggauggcacgacuggcaacaggugccguuuuguucccaucacuuccaugagcucauuaugaaggacggccgcaagcugguugugcccugcagaccucaggaugaacuuaucgggcgggcucgcauuagccaaggagccggcuggucucugaaagagaccgcuugucucgggaaggccuacgcucagaugugggcccugauguauuuucacagacgggaccugcgccucgcguccaacgccaucugcagcgcuguccccgugcacugggucccuacauccagaaccacauggagcauucaugcccaccaucaguggaugacgaccgaagauaugcugacaguguggaaccggguuuggaucgaggacaaucccuggauggaggauaaaaccccugugacaaccugggaagacguccccuaccuuggaaagagagaggaucaaugguguggcucucugaucgggcucacgagccgcgccaccugggcucagaacauucugacagccauccaacaggugcggucccuuauuggcaaugaagaguuccuggacuacaugccgucuaugaaaagauuucgcaaggaggaggagcucgaaggagcgaucugguga

SEQ ID NO: 20355 - RNA, 9873 nt, Artificial Sequence
  derived and/or modified CDS sequence (opt5) from DENV-3__AB214882__SS-prME
accagccugugccucaugaugaugcugcccgccacccuugcuuuccaccugacguccagagacggagagccucggaugaucguggggaagaacgagcgcggaaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccagacauggaugagcgcugagggcgccuggcggcaggucgaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccgugcugccugaauacggcacccuggggcucgagugcagcccccgcacgggacuggacuuuaaugagaugauucuucugaccaugaaaaacaaggcuuggaugguccauagacagugguucuuugaucucccucugcccuggacaucuggcgccaccacagaaaccccgacguggaauaaaaaggagcuucuggugacauucaaaaacgcccacgcuaagaagcaagaaguugugguccucgggucccaggagggagcgaugcacaccgcccugacaggcgcuaccgaaauccagaccagcgggggcacaucuauuuuugccggacaucugaaaugucggcucaagauggacaaacuggagcuuaagggcauguccuaugccaugugcagcaaugcuuucgugcugaaaaaggagguuuccgaaacgcagcacgggaccauccucauuaagguggaguacaaaggagaagaugccccuuguaagauccccuucucuacagaggacggccaagggaaagcgcauaacggacgccugaucaccgcuaacccugucgugacaaagaaagaggaacccgugaauauugaggccgaacccccuuuuggcgagagcaacaucauuaucgggauuggcgauaaggcccugaagaucaauugguacaaaaagggauccagcaucggcaaaauguucgaagcuaccgccagaggggcucggagaauggccauucuuggagacacggcgugggauuuuggcucuguugggggaguccucaacucccugggcaagauggugcaccagaucuucgggagcgccuauacagcucuguuuucuggcgugagcuggauuaugaaaaucggaauuggcguccuccugaccuggaucgggcuuaauuccaagaacaccucuaugagcuucuccugcauugugaucggaaucauuacacuguaccucggcgccguugugcaggcugacauggggugugucaucaauuggaagggaaaagagcugaagugcggcagcgggauuuuugugaccaacgagguucauacauggacggaacaguauaaauuccaagccgauucuccgaagcgccuggcgaccgccaucgcuggcgccugggagaauggaguguguggcauucgguccacaaccagaauggaaaaccuucucuggaaacagaucgcuaaugagcugaacuacauccugugggaaaauaacauuaagcucacagucgugguuggggacaucaccggcauucuggagcagggcaaacgcacgcuuacaccccagccuauggagcugaaguauagcuggaagacaugggggaaagccaagaucgugaccgccgaaacacaaaauucuuccuuuauuaucgauggacccaacaccccugagugccccagcgcuucccgggcguggaacgucugggaaguggaggacuacggcuucggcguguuuacaaccaauaucuggcucaaacugagagaaauguauacgcagcugugugaccaccgccuuaugucugccgcugucaaggaugagcgggccguucacgccgacaugggguacuggauugagagccagaaaaacggauccuggaagcucgaaaaggcuucucugaucgaggugaaaacaugcaccuggcccaagagccauacccugugguccaauggcgugcucgaaagcgauaugauuaucccuaaaucucuggccgggcccauuucccagcacaacuacagaccuggauaucauacacaaaccgcgggccccuggcaccuugggaagcuggagcucgacuucaauuacugcgagggaacgacagucgugaucaccgaaaacuguggcacacgcggcccuagccugcggaccacaaccguuucugggaaacugauccacgaguggugcuguagauccugcacgcuucccccgcuccgcuauaugggagaagauggcuguugguacgggauggagauucggccuaucaaugaaaaggaggagaacauggucaagagccuggucucugcuggaagcggcaaaguggacaauuuuaccauggggguucugugccucgccauucuguucgaagaggugaugagaggaaaguucggcaaaaagcauaugaucgccggcguccuuuuuacauucgugcugcuccuguccgggcagauuaccuggcgggauauggcucgcacacugaucaugauuggaagcaacgccucugacagaaugggcauggggguuaccuaucuugcgcugaucgcuacguuuaaaauccagcccuuccucgcccugggauuuuuccuccggaagcugacauccagagaaaaucuucugcucggcguggggcuggccauggcuaccacacugcaacuucccgaggauauugaacagauggccaacggaaucgcucugggccucauggcccugaagcucauuacccaguuugagaccuaccagcuguggacagcgcuugccagccugauguguuccaauacgaucuucacccucacagucgcuuggcgcaccgccacacugauucuggcuggcaucucucuucugccugugugccaaagcuccucuaugcggaaaaccgacuggcucccgaugacgguggccgccaugggggugcccccucugccccucuuuaucuucagccugaaggauacacuuaaaagacgcuccuggccucugaacgagggaguuauggcugugggccuggugucuauucucgcgagcucccugcuuagaaaugacguccccauggccgggccucugguggcuggaggccuccugaucgccuguuauguuauuaccgggaccagcgccgaucucacaguggaaaaggcugccgacgucaccugggaggaagaggcggaacagacaggagugucucacaaccugaugaucacgguugacgaugacggcaccaugcggauuaaagaugacgagacagagaacauccuuaccgugcugcugaagacagcucuccugaucgucuccggcauuuuucccuacagcaucccggccacccuucugguguggcauacguggcagaaacagacccaacgcucugggguccucugggaugugccuagcccgccugaaacacagaaggccgagcuggaagagggaguuuacagaauuaagcagcagggcaucuucgggaaaacccaagugggagucggcgugcagaaggaggggguuuuucacacaauguggcaugugacccggggagcuguccucacacacaauggcaaacgccuggaacccaacugggccagcgugaagaaagaccuuauuucuuauggcgggggauggagacuguccgcgcaguggcaaaagggcgaggaagugcagguuaucgcugucgagccggggaagaauccuaaaaacuuccagacgaugcccggaauuuuccagaccacaaccggcgaaaucggggccaucgcccuggauuuuaagccuggaaccagcggcucccccauuaucaaucgggagggcaaagugguggggcucuacggaaacggcgucgugacaaagagcgggggauauguuucuggcauugcucaaacgaaugccgagcccgacgggccuaccccggaacuggaggaagagauguucaaaaagcgcaaccuuacaaucauggaucugcaccccggcagcggaaagaccagaaaauaccucccugcuauugugcgggaagccaucaagcgcagacugcggacacucauccuggcgcccaccagagucguggccgcugagauggaggaagcccuuaaaggccugccuauucgcuaucagacgacagcuaccaaguccgagcauaccgggaaagaaaucguugaccugaugugccacgccacauuuaccaugcggcuccugucucccgugagagucccuaauuacaaccuuauuaucauggaugaggcccauuucacagacccggcuagcauugcggcccgcggauauaucuccacccgggugggcaugggggaagcugccgccaucuuuaugacggcuacacccccuggaaccgccgaugcguucccccagucuaaugcuccuauucaggacgaggagagagacauccccgaacgcagcuggaacuccggcaaugauuggauuacagacuuugccgggaagaccguuugguucgugccgucuaucaaggccggcaacgauauugcuaauugucugcggaaaaacggaaagaaagucauccaacucagcagaaagacguuugacaccgaguaccagaaaacaaagcugaacgauugggacuucguggugaccacagauauuuccgaaaugggcgccaauuuuaaggcggaccgcgucaucgauccucggagaugccugaaacccguuauccucaccgacgggcccgagcgggugauucuugccggaccuaugcccgugacagucgcuagcgccgcucagcgcagaggccggguggggcgcaacccucagaaggagaaugaucaauacaucuucaccggacagccgcugaacaaugacgaagaccacgcccauuggacggaggcuaaaaugcugcucgauaacauuaauacacccgaaggcaucauuccugcccuguucgagcccgaaagagagaagucugcggccaucgacggggaguaucggcuuaaaggcgaauccagaaagaccuuuguugagcugaugcgccggggagaucucccuguguggcuggcucacaaagucgccagcgaaggcaucaaguacaccgacagaaaguggugcuucgauggggagcgcaacaaucagauucuggaagagaacauggacguggagaucuggacaaaagaaggagagaagaaaaagcuccggcccagauggcuugaugcucgcaccuauucugacccgcuggcccugaaagaauuuaaggauuucgccgcuggccggaaguccauugcguuugaccucguuacagagaucgggagagugccuagccaccuggcccaucgcacgagaaaugcucuugauaaccuggucaugcuccacaccuccgaacauggaggccgggccuaccgccacgccguggaggagcugcccgaaacaauggagacccugcuccuucugggccugaugauucuccugacagggggagcuaugcuuuuccugaucucuggcaaagggaucggaaagaccagcauuggccucaucugugucguggccuccagcgggaugcuguggauggcggacauuccucugcaguggaucgccucugcuauuguucucgaauuuuucaugauggugcuucugauccccgagccugagaaacaaagaacgccccaggauaaucagcuggccuauguggucauuggaauccucacccuggcugccaucguugcggccaacgaaaugggccuucuggagacaaccaagcgggaccucggcauguccaaagaaccggggguggugagcccuacaucuuaccuggacgucgaucugcaccccgcuagcgccuggacccucuaugcuguggccacgacaguuauuacccccaugcuucgccauacaaucgaaaauuccaccgcuaacgugucucuggccgcgauugccaaucaagcugucgugcugaugggacucgacaagggcuggccuaucagcaagauggaucugggggucccgcuucuggcccucggaugcuacucccaggugaacccccugacccugacagcugccguucuccuucuggugacgcacuacgccauuaucggcccugggcugcaggcgaaagcuaccagagaagcccagaagcggacagcugccggaaucaugaaaaaccccaccgucgacggcauuaugacaaucgaucucgacccugugauuuaugauucuaaguuugagaaacaacugggccagguuaugcuucuggugcucugugccguccagcugcugcucaugagaaccagcugggcuuucugcgaggcccuuacgcuggcgacagggcccaucaccacccugugggaaggauccccuggcaaguuuuggaauacaaccauugccgugagcauggcuaacaucuuccgcgggucuuaccucgccggagcuggccuggccuuuuccaucaugaaguccguggggacaggaaaacggggcacgggcucccagggggagacccuuggagaaaaguggaaaaagaaacugaaucaacucucuagaaaggaguucgaccuguauaaaaagagcggcauuacagaaguugaucgcaccgaggcgaaggaggggcugaaacggggagaaaucacacaucacgccgucuccagaggcucugcuaagcuccagugguucguggagcggaacauggugauuccggaagggcgcgucaucgaccuuggauguggcagaggcggguggagcuacuauugcgccggacugaaaaagguuaccgaggugcggggcuacacgaaagggggacccggccaugaggaaccugugcccauguccaccuauggguggaauauugucaagcugaugagcggaaaggauguguuuuaccucccucccgagaaaugugacacacugcuuugcgauaucggcgaaucuuccccgagcccuaccguugaggaaucucgcacaauuagagugcugaagauggucgagcccuggcucaaaaacaaucaguucuguaucaaggugcugaaccccuacaugccuaccguuaucgagcaccuggaacggcuccagcgcaaacacggcgggaugcuugugagaaauccccugucccggaacagcacacaugagauguauuggauuucuaauggaaccggcaacaucgucagcuccgugaauauggugucucgccugcuccugaacagauuuacgaugacauaccggagaccuaccauugaaaaggacgucgaccuuggggcuggaacccgccacguuaaugccgagccggaaacacccaacauggaugugaucggcgagcggauuagacgcaucaaggaggaacauagcuccacguggcacuaugacgaugagaacccuuacaaaaccugggcuuaucacgggagcuacgaagugaaggccacaggauccgcgucuagcaugaucaauggcgucgugaaacugcucaccaagcccugggacguugugccuacagucacccaaauggccaugacagauaccacgcccuucggccagcagcggguguuuaaagagaagguugacaccagaacaccgaagccuaugcccgggacccgcaaagugauggaaauuacagcugaguggcuguggcggacccugggaagaaacaagcgcccucggcucugcacgagagaggaguucaccaaaaagguccgcaccaaugccgcuaugggcgccguguuuacagaggaaaaccaaugggauuccgcccgggcggcuguugaggacgaagaguucuggaaacugguggauagagagcgcgaacuucauaagcuggggaaauguggaucuugcgucuauaauaugaugggcaagagagagaagaaacucggggaauuuggcaaggccaaaggaagccgggccaucugguacauguggcugggcgcucgcuaccuugaguucgaggcccugggguuucucaacgaagaccacugguucuccagagaaaauucuuauagcggaguggaaggcgaggggcugcauaagcugggauacauucuccgggauaucuccaaaauucccggcggggcuauguaugccgacgacaccgcgggcugggauacgagaaucaccgaagacgaucugcacaacgaggagaagaucacacagcagauggacccugaacaucggcagcuugccaaugcuauuuuuaagcugaccuaccaaaacaaagucgugaagguucagcgccccacaccgaaaggaaccgugauggauaucauuagcagaaaggaccagcggggcucugggcaggucggaacauauggccucaauaccuucacgaacauggaggcccaacugauccgccagauggaaggggagggagugcuuuccaaaacagaucuggaaaauccucaccuccuggagaagagaauuacccaguggcuggagaccaagggcguggaacggcucaaacgcauggcuaucagcggggacgauugcguugugaagcccaucgacgauagauucgccaacgcgcugcuugcccugaaugacaugggcaaaguccggaaggauauuccccaguggcaaccuucuaaaggauggcacgacuggcaacaggugccguuuuguucccaucacuuccaugagcucaucaugaaggacggccgcaagcugguugugcccugcagaccucaggaugaacuuauugggcgggcucgcaucagccaaggagccggcuggucucugaaagagacagcuugucucgggaaggccuacgcucagaugugggcccugauguauuuucacagacgggaccugcgccucgcguccaacgccauuugcagcgcuguccccgugcacugggucccuaccuccagaacaacguggagcauccaugcccaccaucaguggaugaccacagaagauaugcugaccguguggaaccggguuuggauugaggacaaucccuggauggaggauaaaacaccugugaccacgugggaagacguccccuaccuuggaaagagagaggaucaaugguguggcucucugaucgggcucaccagccgcgccacaugggcucagaacauccugaccgccauucaacaggugcggucccuuaucggcaaugaagaguuccuggacuacaugccgucuaugaaaagauuucgcaaggaggaagagagcgaaggagcgauuugguga

SEQ ID NO: 20356 - RNA, 9873 nt, Artificial Sequence
  derived and/or modified CDS sequence (opt5) from DENV-3__JX669489__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguggggggaguucucaacagccugggcaaaaugguccaucagauuuuugggucugccuacaccgcucuguucuccggcgugagcugggugaugaagaucggaauuggcguccuccugaccuggaucgggcuuaauucuaaaaacacaagcauguccuuuucuugcauugccaucggaaucauuacccuguaucucggcgcugugguucaggccgacauggggugugugaucaauuggaagggaaaagagcugaagugcggcagcgggauuuucgucacaaacgaggugcacacguggaccgaacaguacaaguuucaagcggauucccccaaacgccuggccacagcuaucgccggcgcuugggagaauggaguuuguggcauucggagcaccacaagaauggaaaaccuucucuggaagcagaucgccaaugagcugaacuauauccugugggaaaauaacauuaaacucaccguggucgugggggacaucauuggaguucuggagcagggcaagcgcacgcuuaccccucagcccauggagcugaaauacucuuggaagacaugggggaaagccaagaucgugaccgcugaaacacaaaacuccagcuucauuaucgauggaccuaauacccccgagugcccgucugcgucccgggccuggaacgucugggaaguggaggacuauggcuuuggcguguucacaaccaauaucuggcucaagcugagagaagucuacacgcagcugugugaccaucgccuuaugagcgcugccguuaaagaugagcgggccgugcacgcugacaugggguacuggauugagucccagaagaacggaucuuggaaacucgaaaaggccagccugaucgaggugaaaacaugcaccuggccuaagucccacacccuguggucuaauggcguccucgaaagcgauaugauuauccccaagucccuggcggggccuauuagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauccacgaguggugcuguagaagcugcacgcuuccgccucuccgguauaugggagaagauggcuguugguacgggauggagauucgccccaucucugaaaaagaggagaauauggucaagucccuggugagcgccggaucuggcaaaguugacaacuucaccaugggggugcugugccucgccauucuguuugaagaggucaugagaggaaaguucggcaagaaacauaugaucgcuggcgugcuuuucacauuuguucugcuccugagcgggcagauuaccuggcgggauauggcccacacacugaucaugauuggauccaaugcgagcgacagaaugggcaugggggugaccuaucuugcucugaucgccacguucaagauccagcccuuucucgcccugggauucuuucuccgcaaacugacaucucgggaaaaccuucugcucggcgucgggcuggcuauggccaccacacugcaacuuccugaggauauugaacagaucgcuaauggaauugcccugggccucauggcgcugaagcucaucacccaguucgagaccuaccagcuguggacagcccuuauuucccugacguguagcaacaccauguuuacacucaccguggcuuggagaacagccacccugauccuggcuggcgugucccuucugccggucugccaaucuagcuccaugcgcaaaacggacuggcuccccauggccguugccgcuaugggggugccuccccugccucucuucaucuuuucucugaaggauacacuuaagagacggagcuggccccugaaugagggagugauggcggucggccugguguccauucucgccucuagccugcuucgcaacgacguuccuauggcugggccccugguggccggaggccuccugaucgccuguuaugucauuaccgggaccuccgcugaucucacaguggaaaaagccgcggacaucaccugggaggaagaggcugaacagacaggaguuagccauaaccugaugauuacgguggacgaugacggcaccaugagaaucaaggaugacgagacagagaauauccuuaccguccugcugaaaacagcccuccugauugugucuggcgucuucccguacuccaucccugccacccuucugguguggcacacguggcagaagcagacccaacggagcgggguucucugggaugugcccucuccucccgaaacacagaaagcugagcuggaagagggagucuaccgcauuaagcagcagggcaucuuugggaaaacccaagugggaguuggcgugcagaaggagggggucuuccauacaauguggcacgugaccagaggagccgugcucacauauaacggcaagcggcuggaaccgaauugggcguccguuaaaaaggaccuuauuagcuacggcgggggauggcgccugucugcucaguggcaaaaaggcgaggaaguccaggugaucgccguggagccugggaagaaccccaaaaauuuucagacgaugccuggaaccuuccagacaaccaccggcgaaauuggggccaucgcucuggauuucaagcccggaacauccggcagccccaucauuaacagagagggcaaggucguggggcucuauggaaauggcguugugacgaaaaacgggggauacgucuccggcaucgcccaaaccaaugcugagccugacgggccgacacccgaacuggaggaagagauguuuaagaaacggaaccuuaccauuauggaucugcacccuggcagcggaaagacacgcaaauaucuccccgccaucgugagagaagcgauuaagcggagacugcgcacccucauccuggccccuacgcggguuguggcugccgagauggaggaagcucuuaagggccugcccaucagauaccagacaaccgccaccaaaucugagcauacagggcgcgaaauugucgaccugaugugccacgccaccuucacaaugcggcuccugagcccugugagaguuccgaauuauaaccuuaucauuauggaugaggcucauuuuaccgaccccgcguccaucgccgcucgcggauacauuucuacgcgggugggcaugggggaagccgccgcuaucuucaugacagccaccccucccggaacagcggaugcuuuuccucagagcaaugcccccauccaggacgaggagagagacauuccggaacgcuccuggaacucuggcaaugaguggaucaccgauuucgccgggaagacggucugguuugugccuagcauuaaagcuggcaacgacaucgccaacugucugcggaagaauggaaaaaaggugauucaacucuccagaaagaccuucgauacagaauaccagaaaaccaagcugaacgacugggauuuugucguuacaaccgacaucucugagaugggcgcgaauuucaaagccgaucgggugauugacccccgcagaugccugaagcccgugauccucacagaugggccugagcgggucauccuugcuggacccaugccugugaccgccgcuagcgccgcucagcgcagaggccggguugggagaaacccgcagaaagaaaaugaccaauauauuuuuacgggacagccccugaacaaugaugaggaccacgcccauuggacagaagcgaagaugcugcucgacaacaucaauaccccugagggcauuauccccgcccuguucgaaccugagcgcgagaaguccgcugccauugauggggaauaccggcuuaaaggcgagagcagaaagaccuucguggaacugaugcgccggggagaccuccccgucuggcuggcucacaaaguggccucugagggcaucaaguauacagauagaaaauggugcuuugacgggcagcgcaacaaucagauccuggaagagaacauggauguugagauuuggaccaaggaaggagagaaaaagaagcuccggccgagauggcuugacgcccgcacauacuccgauccucuggcucugaaagaauucaaggacuuugcggccggcagaaaaagcaucgcucucgaucuggugacggagauugggcggguccccucucaccuugcccaucgcaccagaaaugcccuggacaaccucgugaugcugcacacauccgaacauggaggccgggcuuaucgccacgccgucgaggagcugccugaaaccauggagacacuccuucugcugggccucaugauccugcuuaccgggggagcgaugcuguuccucauuagcggcaaggggaucggaaaaacguccaucggccugauuugugugaucgccucuagcgggaugcuguggauggcugaaauuccccuccaauggaucgccuccgcuauuguucuugaguuuuucaugauggugcugcugaucccugagcccgaaaagcagagaaccccgcaggauaaucaacucgccuacguggucauuggaauccugacacuugcggccaucauugcugccaacgagaugggccugcucgaaaccacaaagcgggaccugggcaugagcaaagagccugggguugugucucccaccuccuaucuggauguggaccuccaccccgcuagcgccuggacgcuuuacgcugucgccacaaccgugaucacaccuaugcugagacauaccauugaaaauucuaccgcgaacguuagccuggccgcuaucgccaaccaggcugugguccucaugggacuggacaagggcuggccgauuuccaaaauggaucuuggggugccccugcucgcccugggaugcuacucucaggucaauccucugacacucacggccgcggugcuucugcugaucacccacuaugcuaucauuggccccgggcuccaggccaaggcuacacgcgaggcccaaaaacggaccgccgcuggaaucaugaagaacccuacaguugacggcauuaugaccaucgaucuggaccccgugauuuacgauagcaaguuugagaaacagcuuggccaggucaugcugcucgugcugugugccguucagcugcuccuuaugagaacguccugggcgcugugcgaagcccugacacucgcuaccgggccuaucaccacacugugggagggaucuccgggcaaguucuggaauaccacaaucgccgugagcauggcuaacauuuuucgcggguccuaucuugccggagcgggccuggccuucagcaucaugaaaucugucgggacgggaaagcggggcaccggcucccaaggggaaacacucggagagaaauggaagaagaaacugaaucagcugagcagaaaggaauuugaccucuacaaaaaguccggcauuaccgagguggaucggacagaggcuaaagaagggcuuaagcgcggagagaucacccaucacgccgugucuagaggcagcgcuaaacugcagugguucguugaacggaacauggucauucccgaggggcgcgugaucgaccugggauguggcagaggcgggugguccuauuacugcgccggacucaagaaggugacggaaguccggggcuauaccaaagggggaccuggccaugaggagcccguuccuaugucuacauacggguggaauauugugaagcugaugagcggaaaagauguguuuuaccuucccccggaaaagugugacacccugcucugcgauaucggcgaguccagcccuucucccacagucgaagagucccgcaccaucagagugcugaaaaugguugagcccuggcugaagaacaaucaguucuguauuaaggugcucaacccuuauaugcccacagucaucgaacaccuugagcggcugcaacgcaaacacggcgggaugcuggugagaaauccucucagccggaacucuacccaugaaauguacuggauuuccaauggaacgggcaacaucguugcuagcgugaauauggucucuagacugcuucugaaccgcuucacaaugacccaccggagaccgaccauugagaaggacguggaucucggggccggaacacgccaugugaacgcggaacccgagacgccuaauauggacgucaucggcgagcggaucaaaagaauuaaggaagagcacaacagcaccuggcacuaugacgaugaaaaucccuacaaaacaugggccuaucauggguccuacgagguuaaggcuaccggaucugccagcuccaugaucaacggcguggugaagcugcugacaaaaccuugggacgucgugcccaugguuacccagauggcuaugacagauaccacgccguuuggccagcaacgcguguucaaggaaaaagucgacacccggacaccuagaagcaugcccgggacccgccgggugaugggaauuacagccgaguggcucuggagaacccugggccgcaauaagaaaccucggcuuugcacgagagaggaauuuacaaagaagguucgcaccaacgccgcgaugggggcuguguucacagaggaaaaucagugggauuccgccaaagccgcugucgaggacgaagauuuuuggaagcugguggacagagagcgggagcuccacaaacugggaaaguguggcucuugcguuuauaacaugauggggaaacgcgaaaagaaacuuggcgaguucggaaaggccaagggcagcagagcuaucugguacauguggcugggggcccgguaccucgaauuugaggcgcugggauuccugaaugaggaucauugguuuuccagagaaaacucuuauagcggcguggagggggaaggacuccacaaacugggcuacauucuucgggacaucuccaagauccccgggggcgccauguaugcugaugacaccgccggaugggacacgcgcauuaccgaggaugaccugcauaaugaagagaaaaucacacagcagauggauccugagcacagacaacucgcuaacgccauuuucaagcugaccuaccagaauaaagucgugaagguccagcggcccacaccgaccggcacagugauggacaucauuucucgcaaggaucagagagggagcggacaaguuggcaccuaugggcuuaacacguuuacaaauauggaagcgcagcugauccggcagauggagggagaaggcgugcucuccaaagccgaccuggagaacccucaccugcccgaaaagaaaaucacccaguggcucgagaccaagggggucgagcgccugaaaagaauggcuauuagcggcgaugacugcguggugaagcccaucgaugaccgguucgccaacgcucuucuggcccucaaugauaugggaaagguucgcaaagacauuccucaauggcagccgucuaagggcuggcaugauuggcagcaggugcccuuuuguucccaccauuuccacgaacugaucaugaaagacgggagaaagcuugucgugccuugccggccccaagacgagcugauuggacgcgcuagaaucagccagggcgccggguggucucuccgggaaacagcgugucugggaaaagccuacgcucagauguggucccugauguauuuccaccgcagagaucuccggcuggccagcaacgccauuugcucugcuguuccugugcauuggguccccaccuccagaacaacguggagcauccacgcccaucaccaauggaugaccacagaggacaugcuuaccguguggaaucgcgucuggaucgaagauaacccuuggauggaggacaagacacccgugaccacgugggagaauguuccguaccugggcaagcgggaagaucaguggugugggucccucauuggccugaccagcagagcgacaugggcucagaacaucccuaccgccauucagcaagugcgcucucuuaucggaaaugaggaauuucuggacuacaugcccagcaugaaacgguucagaaaggaggaggaauccgagggcgccauuugguga

SEQ ID NO: 20357 - RNA, 9873 nt, Artificial Sequence
  derived and/or modified CDS sequence (opt5) from DENV-3__JX669498__SS-prME
accagccugugccucaugaugauccugcccgccgcucuugccuuccaccugacguccagagacggcgaaccucggaugauuguggggaagaacgaacgcggaaaaucucuccuguuuaagacggcguccggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaaagacggcgcgacaagagaucuguggcccuggcuccucacgucgggaugggacuggauacccggacacagaccuggaugagcgccgaaggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagucuauugagggcaaaguugugcaguaugaaaaucucaaguacacagucaucaucaccgugcacacaggggaccagcaucagguuggaaacgagacgcaaggcgugaccgcugaaauuacaccccaggccuccaccacagaggcuauccugccugaauauggcacccuggggcucgagugcagccccagaacgggacuggacuucaaugagaugauucuucugaccaugaaaaacaaggccuggaugguccaccggcagugguuuuucgaucucccucugcccuggacaucuggcgccaccacagaaaccccgacguggaaucgcaaagagcuucuggugacauuuaagaacgcucaugcgaaaaagcaagaagucgugguucucgggucccaggagggagccaugcacaccgcucugacaggcgccaccgaaauccagaauagcgggggcaccucuauuuucgccggacaccugaaguguagacucaaaauggacaagcuggagcuuaaaggcauguccuacgcuaugugcacaaacacguuugugcugaagaaagaggucagcgaaacccagcaugggacaauccucaucaagguggaguacaagggagaagaugccccuuguaaaauucccuucuccaccgaggacggccaagggaaggcgcacaacggacggcugaucacagcuaauccuguugugaccaaaaaggaggaacccgucaacauugaggccgaacccccuuucggcgagucuaauaucgugauugggacgggcgauaacgcccugaaaaucaauugguauaagaagggaagcuccaucggcaaaauguuugaagcuacagccagaggggcucgccggauggccauucuuggagacaccgcgugggauuucggcagcgucgggggaguucucaacucucugggcaagaugguccaucagaucuuuggguccgccuacaccgcucuguucagcggcgugucuugggugaugaaaauuggaaucggcguccuccugacauggauugggcuuaauagcaagaacaccuccaugucuuuuagcugcaucgccauuggaaucaucacacuguaucucggcgcugugguucaggccgacauggggugugugauuaauuggaaaggaaaggagcugaagugcggcuccgggaucuucgucacgaacgaggugcacaccuggacagaacaguacaaauuucaagcggauagcccgaagagacuggccaccgcuauugccggcgcuugggagaauggaguuuguggcauccgcucuacaacccggauggaaaaccuucucuggaaacagauugccaaugagcugaacuauauccugugggaaaauaacaucaagcucacgguggucgugggggacauuaucggaguucuggagcagggcaaaagaacccuuacaccccagccuauggagcugaaguacuccuggaaaaccugggggaaggccaagauugugacagcugaaacccaaaacagcucuuucaucauugauggacccaauacaccugagugccccuccgcgagccgcgccuggaacgucugggaaguggaggacuauggcuuuggcguguucaccacgaauaucuggcucaaacugcgggaagucuacacacagcugugugaccauagacuuauguccgcugccguuaaggaugagcgcgccgugcacgcugacaugggguacuggaucgagucucagaaaaacggaagcuggaagcucgaaaaagccucccugauugaggugaagaccugcaccuggccgaagucucacacacuguggagcaauggcguccucgaauccgauaugaucauuccuaaaagccuggcggggcccaucucucagcauaaccaccggccuggauaucauacccaaacggcuggccccuggcaccuugggaagcuggagcucgacuuuaauuacugcgagggaacaaccgugguuauuacagaaaacuguggcaccagaggcccuucccugcgcacaaccacggugagcgggaaacugauccacgaguggugcugucggucuugcacccuucccccgcucagauauaugggagaagauggcuguugguacgggauggagauccggccuauuuccgaaaaggaggagaauauggucaaaagccuggugucugccggaagcggcaagguugacaacuucacaaugggggugcugugccucgccauccuguuugaagaggucaugcgcggaaaguucggcaaaaagcauaugauugcuggcguguucuuuaccuucguucuucugcucuccgggcagaucacauggagagauauggcccacacccugauuaugaucggaagcaaugcgucugaccggaugggcaugggggugacguaucuggcucuuauugccacauuuaaaauccagcccuuccuggcccucggauuuuuccugagaaagcucaccucccgcgaaaaccugcuucugggcgucgggcucgcuauggccacaacccugcaacugcccgaggauaucgaacagauggcuaauggaauugcccuuggccugauggcgcucaaacugaucacccaguuugagacauaccagcucuggacggcccugauuagccuuaccuguuccaacacaauguucacccugacaguggcuuggcggaccgccacgcucauccuggcuggcgugucucugcuuccugucugccaaagcuccucuaugagaaagacagacuggcugccgauggccguugccgcuaugggggugcccccucucccccuguuuauuuucagccucaaggauacccugaaacgcagauccuggccucuuaaugagggagugauggcggucggccuggugucuauccuggccagcucccuccugcggaacgacguucccauggcugggccucuuguggccggaggccugcucaucgccuguuaugucauuaccgggacaagcgcugaucugaccguggaaaaggccgcggacaucacaugggaggaagaggcugaacagacgggaguuucucauaaccucaugauuaccguggacgaugacggcacaaugcgcaucaaagaugacgagaccgagaauauucugacaguccuucugaagaccgcccugcucaucguguccggcgucuuucccuacagcaucccggccacgcugcuuguguggcacaccuggcagaaacagacacaaagaucugggguucugugggaugugccuucucccccugaaacccagaaggcugagcucgaagagggagucuaccggauuaaacagcagggcaucuucgggaagacacaagugggaguuggcgugcagaaggagggggucuuucauaccauguggcacgugacacgcggagccgugcugacguauaacggcaaaagacucgaacccaauugggcgagcguuaagaaagaccugauuagcuacggcgggggauggcggcuuuccgcucaguggcaaaagggcgaggaaguccaggugaucgccguggagccggggaaaaacccuaagaauuuccagaccaugcccggaacauuccagaccaccacaggcgaaauuggggccaucgcucuggauuuuaagccuggaacgagcggcucccccauuaucaaccgcgagggcaaagucguggggcuguauggaaauggcguugugaccaagaacgggggauacgucagcggcaucgcccaaacaaaugcugagcccgacgggccuaccccggaacucgaggaagagauguucaaaaagagaaaccugacaauuauggaucuucaccccggcucuggaaaaacccggaaguaucugccugccaucgugcgcgaagcgauuaagagacggcucagaacgcugauccucgcccccacacgcguuguggcugccgagauggaggaagcucugaaaggccuuccuauucgguaccagaccaccgccacaaagagcgagcauaccgggagagaaaucgucgaccugaugugccacgccacauuuaccaugcgccugcucucccccgugcggguuccuaauuauaaccugaucauuauggaugaggcucauuucacggacccggcgucuaucgccgcuagaggauacauuagcacacgcgugggcaugggggaagccgccgcuaucuuuaugaccgccacacccccuggaaccgcggaugcuuucccccaguccaaugccccuauucaggacgaggagcgggacauccccgaaagaucuuggaacagcggcaaugaguggaucacggauuuugccgggaaaaccgucugguucgugccguccauuaaggcuggcaacgacaucgccaacugucuucgcaaaaauggaaagaaggugauucaacugucucggaaaacauuugauaccgaauaccagaagacaaaacucaacgacugggauuucgucguuaccacagacaucagcgagaugggcgcgaauuuuaaggccgauagagugauugacccucggcgcugccugaaacccgugauccugaccgaugggcccgagagagucauucucgcuggaccuaugcccgugacggccgcuuccgccgcucagcggcgcggcagaguugggcggaacccucagaaggaaaaugaccaauauaucuucacaggacagccgcuuaacaaugaugaggaccacgcccauuggaccgaagcgaagaugcugcuggacaacaucaauacccccgagggcauuaucccugcccucuucgaacccgagagagagaaaagcgcugccauugauggggaauaccgccugaagggcgagucucggaaaacauuuguggaacuuaugagacgcggagaccugccugucuggcucgcucacaagguggccuccgagggcaucaaauauaccgaucggaaguggugcuucgacgggcagagaaacaaucagauucuggaagagaacauggauguugagaucuggacaaaagaaggagagaagaagaaacugcgcccccgguggcucgacgccagaacguacagcgauccgcuugcucugaaggaauuuaaagacuucgcggccggccgcaagucuaucgcucuggaucucgugaccgagauugggagagucccuucccaccuggcccaucggacacgcaaugcccuugacaaccuggugaugcuccacaccagcgaacauggaggcagagcuuaucggcacgccgucgaggagcugcccgaaacaauggagacccugcuccuucugggccugaugauccuccugacagggggagcgaugcuuuuucugauuuccggcaaagggaucggaaagaccucuauuggccucaucugugugaucgccagcuccgggaugcuguggauggcugaaauuccucugcaauggaucgccagcgcuauuguucucgaguucuuuaugauggugcuucugauccccgagccugaaaagcagcgcacaccccaggauaaucaacuggccuacguggucauuggaauccucacccuggcggccauuaucgcugccaacgagaugggccuucuggaaacaaccaaaagagaccucggcaugucuaaggagccggggguuguguccccuacgagcuaucuggauguggaccugcaccccgcuucugccuggacacucuacgcugucgccaccacagugaucacccccaugcuucggcauaccauugaaaauagcacagcgaacguuucccuggccgcuaucgccaaccaggcugugguccugaugggacucgacaaaggcuggccuauuucuaagauggaucugggggugccgcuucuggcccucggaugcuacagccaggucaauccccugacgcugaccgccgcggugcuccuucugaucacacacuaugcuauuaucggcccugggcugcaggccaaagcuaccagagaggcccaaaagcgcacagccgcuggaaucaugaagaaccccaccguugacggcauuaugacgaucgaucucgacccugugauuuacgauuccaaauucgagaagcagcugggccaggucaugcuucuggugcucugugccguucagcugcugcucaugcggacaucuugggcgcuuugcgaagcccugacccuggcuaccgggcccaucacaacccucugggagggaagcccuggcaaauuuuggaauacaacgauugccguguccauggcuaacaucuucagagggagcuaucuggccggagcgggccuugccuuuucuaucaugaaguccgucgggaccggaaaacgcggcacaggcagccaaggggaaacccugggagagaaguggaagaaaaagcucaaucagcugucccggaaagaguucgaccuguacaagaaaucuggcauuacagagguggauagaaccgaggcuaaggaagggcucaaacggggagagaucacgcaucacgccgugagccgcggcuccgcuaaacuucagugguuuguugaaagaaacauggucauuccggaggggcgggugaucgaccugggauguggccgcggcggguggucuuauuacugcgccggacugaagaaagugaccgaagucagaggcuauacaaaagggggacccggccaugaggagccuguucccaugagcaccuacggguggaauauugugaaacucauguccggaaaggauguguucuaccugccucccgaaaaaugugacacacuucugugcgauaucggcgagagcucuccguccccuaccgucgaagagagccggacaauucgcgugcucaagaugguugagcccuggcugaagaacaaucaguucuguaucaaagugcugaaccccuauaugccuaccgucaucgaacaccucgagagacuucaacggaagcacggcgggaugcuggugcgcaauccccugucuagaaacuccacgcaugaaauguacuggauuagcaauggaacaggcaacaucguugcuucugugaauauggucagccggcuccugcuuaacagauuuaccaugacccaccgccggccuacaauugagaaagacguggaucugggggccggaacgagacaugugaacgcggaaccggagacccccaauauggacgucaucggcgagcgcauuaagcggaucaaagaagaacacaacuccacauggcacuaugacgaugaaaauccuuacaagaccugggccuaucaugggucuuacgagguuaaggcuacaggaagcgccuccagcaugaucaacggcguggugaaacuccugaccaagcccugggacgucgugccuaugguuacacagauggcuaugaccgauacgacccccuucggccagcaaagaguguuuaaagaaaaggucgacacacgcaccccgcgguccaugccugggacaagacgcgugaugggaauuaccgccgaguggcuguggcggacgcucggcagaaauaaaaagccccgccugugcacacgggaggaguucaccaagaaaguuagaacaaacgccgcgaugggggcuguguuuaccgaggaaaaucagugggauucugccaaggccgcugucgaggacgaagauuucuggaaacuuguggaccgcgagagagagcugcacaagcucggaaaauguggcagcugcguuuauaacaugauggggaagcgggagaagaagcugggcgaguuuggaaaggccaaaggcucccgcgcuaucugguacauguggcuuggggccagauaccuggaguucgaggcgcucggauuucugaaugaggaucauugguucucucgggaaaacagcuauuccggcguggagggggaaggacugcacaagcucggcuacauucugagagacaucucuaaaauuccugggggcgccauguaugcugaugacacggccggaugggacacccggaucacagaggaugaccuucauaaugaagagaagaucacccagcagauggaucccgagcaccgccaacuggcuaacgccauuuuuaaacucacauaccagaauaaggucgugaagguccagagaccuacccccacaggcaccgugauggacaucauuagccggaaagaucagcgcggguccggacaaguuggcacguaugggcugaacacauucaccaauauggaagcgcagcuuaucagacagauggagggagaaggcgugcugagcaaggccgaccucgagaacccgcaucugccugagaagaagauuacccaguggcuggagacaaaaggggucgagcggcucaagcgcauggcuaucucuggcgaugacugcguggugaagcccaucgaugacagauuuggaaacgcccugcuugcucugaaugauaugggcaaaguucggaaggacauuccccaauggcagccuuccaaaggguggcaugauuggcaacaggugccguucuguagccaccauuuccacgaacucaucaugaaggacggacgcaaacuggucgugcccugcagaccucaagacgagcuuauuggccgggcccgcaucucucagggggcuggauggucccugagagaaaccgccugucucggcaaggcguacgcccagauguggagccugauguauuuucaccggcgcgaucugagacucgcuucuaacgccauuugcuccgccguucccgugcauugggucccuacaagccggacgaccugguccauccacgcucaucaccaauggaugacaaccgaggacaugcugacaguguggaauagagucuggauugaagauaaccccuggauggaggacaagaccccugugacgaccugggagaauguucccuaccuugggaaacgcgaagaucagugguguggcagccugaucggacucacaucucgggccaccugggcgcagaacaucccgacagcuauucagcaagugagaagccugaucggcaaugaggaguuccuugacuacaugccuuccaugaagcgcuuucggaaagaggaggaaucugagggggccauuugguga

SEQ ID NO: 20358 - RNA, 9873 nt, Artificial Sequence
  derived and/or modified CDS sequence (opt5) from DENV-3__KF954946__SS-prME
acaagccugugccucaugaugauccugcccgccgcucuugccuuccaccugacgucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccauccuucgcaaacuguguauugagggaaagaucaccaacauuacaaccgauuccagaugcccuacgcagggcgaagcggugcucccggaggaacaggaccagaauuauguguguaaacacacauacgucgaucggggcugggggaacggaugcggccuguucgggaagggaagccuugugaccugcgccaaguuucagugucuggagcccaucgagggcaaaguugugcaguaugaaaaucucaaguacaccgucaucauuacagugcauaccggggaccagcaccagguuggaaacgagacacaaggcaucacggcugaaauuaccccucaggccucuacaaccgaggcuauccugcccgaauauggcacacuggggcucgagugcuccccucgcaccggacuggacuucaaugagaugauucuucugacgaugaaaaacaaggccuggauggugcauagacagugguuuuucgaucucccccugccguggaccagcggcgccacaaccgaaacaccuaccuggaaucggaaagagcuucuggucacguuuaagaacgcucacgcgaaaaagcaagaaguggucgugcucgggucucaggagggagccaugcacacagcucugaccggcgccacagaaauccaaaauuccgggggcaccagcaucuucgccggacaucugaagugucgccucaaaauggacaagcuggagcuuaaaggcaugucuuacgcuaugugcaccaacacauuuguucugaagaaagagguguccgaaacgcagcacgggaccauucucaucaaggucgaguacaagggagaagaugcccccuguaaaauuccuuucagcacagaggacggccaagggaaggcgcauaacggaagacugaucaccgcuaaucccgugguuaccaagaaggaggaacccgugaacauugaggccgaaccuccguucggcgaguccaauaucgucaucgggauuggcgauaacgcccugaaaaucaauugguauaagaagggaucuagcauuggcaaaauguuugaagcuaccgccagaggggcuagacgcauggccauccuuggagacacggcgugggauuucggcuccgucggcggggugcucaacagccuggggaagaugguucaccagauuuuugggucugccuacacagcucuguucuccggcgucagcugggugaugaaaaucggaauuggcgugcuccugaccuggaucgggcuuaauucuaagaacaccagcauguccuuuucuugcaucgccauuggaaucauuacacuguaucucggcgcugucgugcaggccgacaugggguguguuaucaauuggaaaggaaaggagcugaagugcggcagcgggauuuucgugaccaacgagguccauacauggacggaacaguacaaauuucaagcggauucccccaagcggcuggccaccgcuaucgugggcgccugggagaauggaguuuguggcaucagaagcacaacccgcauggaaaaccuucucuggaaacagauugcuaaugagcugaacuauauccugugggaaaauaacauuaagcucacaguggucgugggggacaccaucggaguucuggagcagggcaaacggacgcuuaccccucagcccauggagcugaaguacucuuggaaaacaugggggaaggccaagauugugaccgccgaaacacaaaacuccagcuucaucaucgauggaccuaauacccccgagugcccgucugcuuccagagcguggaacgucugggaaguggaggacuauggcuuuggcguguucacaaccaauauuuggcucaaacugcgcgaagucuacacgcagaugugugaccaccggcugaugagcgccgcuguuaaggaugagagagccgugcacgccgacaugggguacuggaucgagucccagaaaaacggaucuuggaaacuugaaaaagcuagccucauugaggugaagacaugcaccuggccuaagucccauacccuguggucuaauggcguccuggaaagcgauaugaucauucccaaaucccucgccgggccuaucagccagcacaacuaucgccccggauaccauacacaaaccgcgggcccuuggcaccuggggaaacuugagcuggacuuuaauuauugcgagggaacgacagugguuaucaccgaaaacuguggcacacggggccccucucucagaaccacaaccguguccgggaaacugauucacgaguggugcugucgcagcugcacgcugccgccucuucgguacaugggagaagauggcuguugguaugggauggagaucagacccauuucugaaaaggaggagaauauggucaaaucccucgugagcgcuggaucuggcaagguugacaacuucaccaugggggugcugugccuggccauccucuuugaagaggucaugcggggaaaguucggcaaaaagcauaugauugccggcguguucuuuacauucguucugcuucugagcgggcagaucaccuggcgcgauauggcucacacacucauuaugaucggauccaaugccagcgacagaaugggcaugggggugaccuaccuggcgcugaucgcuacguuuaaaauucagcccuuccuugcccugggauuuuuccuccggaagcugacaucuagagaaaaccuccugcuuggcgucgggcuggccauggcuaccacacuccaacugccugaggauaucgaacagauggccaauggaauugcucugggccuuauggcccugaaacucaucacccaguuugagaccuaucagcuguggacagcgcucauuucccugacguguagcaacaccaucuucacacuuaccguggccuggcgcacagcuacccugauccucgccggcgugucccugcugccggucugccaaucuagcuccaugcggaagacggacuggcuucccaugacaguugcugccaugggggugccuccccugccucucuuuauuuucucucugaaggauacccucaaaagacgcagcuggccccugaaugagggagugauggccgucggccuuguguccaugcuggcuucuagccugcucagaaacgacguuccuauggcggggccccugguggccggaggccuucugaucgcuuguuacgucauuaccgggacauccgccgaucucaccguggaaaaggccgcugacguuacaugggaggaagaggccgaacagacgggagugagccauaaccugaugaucaccgucgacgaugacggcacaaugcggauuaaagaugacgagaccgagaauauccucacagugcugcuuaagaccgcgcugcugaucgucucuggcauuuuuccguacuccaucccugcuacgcuccugguguggcacaccuggcagaaacagacacaacgcagcgggguucuuugggaugugcccucuccucccgaaacccagaaggccgagcuggaagagggagucuauagaauuaaacagcagggcauccucgggaagacacaagugggaguuggcgugcagaaggacggggucuuccauaccauguggcacgugacacggggagccgugcugacgcacaacggcaaacgccucgagccgaauugggcuuccguuaagaaagaucugauuagcuacggcgggggauggagacuuucugcccaguggcaaaagggcgaagagguccaggugaucgcgguggaaccugggaaaaaccccaagaauuuucagaccaugccuggaacauuccagaccaccacaggcgagauuggggcuaucgcccuggacuucaagcccggaacguccggcagccccaucauuaaccgggaaggcaaagucguggggcuguauggaaauggcguugugaccaagaacgggggauacgucuccggcaucgcccaaacaaaugcugagccugaugggccgacccccgagcucgaagaggaaauguuuaaaaagcgcaaccugacaauuauggaccuucauccuggcagcggaaaaaccagaaaguaucugcccgccaucgugcgggaggcuauuaagcgcagacuccggacgcugauccucgccccuacaagaguuguggcggccgaaauggaggaggcucugaaaggccuucccauccgcuaccagaccaccgccacaaagucugaacacaccgggcgggagauugucgaucugaugugccaugcuacauucaccaugagacugcucagcccugugcgcguuccgaauuauaaccugaucauuauggacgaagcccacuuuacggaucccgccuccaucgcugcgcggggauacauuucuacaagagugggcaugggggaggccgcugccaucuucaugaccgccacaccucccggaaccgcugacgccuuuccucagagcaaugcgcccauccaggacgaggaacgcgauauuccggagcgguccuggaacucuggcaaugaauggaucacggacuucgcugggaaaaccgucugguuugugccuagcauuaaggccggcaacgauaucgccaacugucuucgcaaaaauggaaagaaggugauucaacuguccagaaaaacauucgacaccgaguaccagaagacaaaacucaacgauugggacuuugucguuaccacagauaucucugaaaugggcgcuaauuucaaggccgaccgggugauugaucccagacggugccugaaacccgugauccugaccgacgggccugagcgcgucauccucgcgggacccaugccugugacggccgcuagcgccgcucagagacggggccgcguugggagaaacccgcagaaggagaaugaucaauauauuuuuacaggacagccccuuaacaaugacgaagaccaugcccacuggaccgaggcuaagaugcugcuggauaacaucaauaccccugaaggcauuauccccgcccucuucgagccugaacgggagaaauccgcggccauugacggggaguacagacugaagggcgaaagccgcaaaacauucguggagcuuaugcggagaggagaucugcccgucuggcucgcucacaagguggccucugaaggcaucaaauauaccgaccgcaaguggugcuuugaugggcagcggaacaaucagauccuggaggaaaacauggacguugagauuuggacaaaagagggagaaaagaagaaacugagaccgcgcuggcucgaugcucggacguacuccgacccucuugcccugaaggaguucaaagauuuugccgcuggcagaaagagcaucgcgcuggaccucgugaccgaaauugggcgcguccccucucaucuggcccacagaacacggaaugcucuugauaaccuggugaugcuccauaccuccgagcacggaggccgcgccuauagacacgccgucgaggaacugccugagacaauggaaacccugcuccuucugggccugaugauccuccugacagggggagcuaugcuuuuccugauuagcggcaaagggaucggaaagaccuccaucggccucauuugugugaucgccucuagcgggaugcuguggauggcggagauuccccugcaauggaucgccuccgcuauuguucucgaauuuuucaugauggugcuucugaucccugagcccgagaagcagcggacaccgcaggacaaucaacuggccuacguggucauuggaauccucaccauggcugccaucauugcggccaacgaaaugggccugcuugagacaaccaaacgcgaucugggcaugagcaaggaaccugggguugugucucccacguccuaucucgacguggaccugcaucccgcuagcgccuggacacuguacgcugucgccaccacagugaucaccccuaugcucagacacaccauugaaaauucuacagcuaacguuagccuugccgcgaucgccaaccaggcugugguccugcugggacucgauaaaggcuggccgauuuccaagauggaccugggggugccccuucuggcccucggaugcuacucucaggucaauccucugacgcugaccgcugccgugcuccuucugguuacacauuaugccaucaucggccccgggcugcaggcgaaagcuacccgggaagcccaaaagagaacagcugccggaauuaugaagaacccuaccguggauggcaucauuacgaucgaccucgaucccgucauuuacgacagcaaauuugagaagcagcugggccaggugaugcuucugguucucugugccgugcagcugcugcucaugcgcacauccugggcucuuugcgaggcccugacccuggcgaccgggccuaucacaacccucugggaaggaucuccgggcaaauucuggaauacaacgaucgccgucagcauggcuaacauuuuucggggguccuaucuggccggagcuggccuugccuucagcaucaugaagucuguggggaccggaaaaagaggcacaggcucccaaggggagacccugggagaaaaguggaagaaaaagcucaaucagcugagccgcaaagaguuugaucuguacaagaaauccggcauuacagaaguggaccggaccgaggcgaaggaggggcucaaaagaggagaaacgacccaccaugccguuucucggggcagcgcuaaacuucagugguucgucgagcgcaacauggugauccccgaagggagagugauugaucugggauguggccggggcgggugguccuauuacugcgccggacugaagaaagucacagagguucgcggcuauaccaaagggggaccuggccacgaggaacccgugccuaugucuacauacggguggaauaucgugaaacucaugagcggaaaggacgucuuuuaccugcccccggagaaaugugauacccuucugugcgacauuggcgaauccagcccuucucccacaguggaggaauccagaaccauccggguucucaagaugguggagcccuggcugaagaacaaucaguucuguaucaaaguccugaacccuuauaugcccgcugugauugagcaccucgaacgccuucaaagaaagcauggcgggaugcugguucggaauccucugagccgcaacucuacgcacgagauguacuggaucuccaauggaacaggcaacauugugagcucugucaauauggugagcagacuccugcuuaaccgguucaccaugacccauagacgcccgacaaucgaaaaagauguggaccugggggccggaacgcggcacgucaacgcugagcccgaaaccccuaauauggacguuauuggcgagagaaucaagcgcaucaaagaggaacacaacuccacauggcauuaugaugacgagaaucccuacaagaccugggccuaucacgggucuuacgaagugaaggcgacaggaagcgccuccagcaugauuaacggcguggucaaacuccugaccaagccuugggaugugguucccauggugacacagauggcuaugaccgacacgaccccguuuggccagcaacgggucuucaaagagaagguggauacaagaaccccucgccccaugccugggacacggaaaguuauggaaaucaccgccgaguggcuguggagaacgcucggacgcaauaagcggcccagacugugcacacgcgaggaauuuaccaagaaagugcggacaaacgcugccaugggcgccgucuucaccgaggaaaaucagugggacuccgcgaaggcugccguggaggaugaagaguuuuggaaacuuguugacagagagcgcgaacugcauaagcucgggaaauguggaucuugcguguauaacaugaugggcaagagagagaaaaagcugggggaguucggcaaggccaaaggaagccgggcuauuugguacauguggcuuggcgcccgcuaccuggaguuugaggcucucggguuccugaaugaagaucacugguuuuccagagagaacucuuauagcggagucgaaggcgaggggcugcauaagcucggauacauccugcgggacauuuccaaaaucccuggcggggccauguaugcggaugacacggccggcugggacaccagaaucacagaagaugaccuucacaaugaggagaagauuacccagcagauggaucccgaacaccggcugcucgcuaacgccaucuucaaacugacauaccaaaauaagguggucaaggugcagcgcccgaccccuacaggaaccguuauggacauuaucucuagaaaagaucagcggggcagcggacaggugggaacguauggccuuaacacauuuaccaauauggaggcucaacugguccgccagauggaaggggagggagugcucuccaagaccgaccuggaaaacccccaucugcccgagaaaaagauuacacaguggcucgagaccaaaggcguggaaagacugaagcggauggccaucagcggggaugacugcguugugaagccuaucgaugaccgcuucgcgaacgcccuucuggcucucaaugauaugggcaaagucagaaaggacauuccgcaguggcaacccucuaaaggauggcacgauuggcaacaggugccuuuuuguucccaucacuuccacgagcugaucaugaaggacggccggaaacuuguugugcccugccgcccucaggacgaacugauugggagagcccggaucagccaaggagcuggcuggucucuccgcgagacagccugucuggggaaggcuuacgcccagauguggucccugauguauuuccauagacgggaucuccgccuggcgagcaacgccauuugcucugcuauccccguccacugggugccuacguccagaaccacauggagcauucaugcccaccaucaguggaugaccacagaagacaugcuuaccgucuggaaucggguguggaucgaggauaaccccuggauggaggacaagacgccgaucaccacaugggaaaauguuccuuaccugggaaaaagagaggaucaaugguguggcucccucauugggcugaccagccgcgccacaugggcucagaacauccccaccgccauucaacaggugcggucucuuaucggcaaugaagaguuucuggacuacaugccuagcaugaagagauuccgcaaagaggaagaguccgaaggagcgauuugguga

SEQ ID NO: 20359 - RNA, 9873 nt, Artificial Sequence
  derived and/or modified CDS sequence (opt5) from DENV-3__KF954947__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcauuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugcccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucggcggggugcucaacagccuggggaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugugggcgccugggagaauggaguuuguggcaucagaagcaccacacgcauggaaaaccuucucuggaaacagaucgcuaaugagcugaacuauauucugugggaaaauaacaucaagcucaccguggucgugggggacacgauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgucugggaaguggaggacuauggcuuuggcguguucaccacgaauaucuggcucaaacugcgcgaagucuacacacagaugugugaccaccggcugaugagcgccgcuguuaaggaugagagagccgugcacgccgacaugggguacuggauugagucccagaaaaacggaucuuggaaacuugaaaaagcuagccucaucgaggugaagaccugcaccuggccuaagucccauacacuguggucuaauggcguccuggaaagcgauaugauuauccccaaaucccucgccgggccuauuagccagcacaacuaucgccccggauaccauacccaaacggcgggcccuuggcaccuggggaaacuugagcuggacuuuaauuauugcgagggaacaaccgugguuaucacagaaaacuguggcacccggggccccucucucagaacaaccacgguguccgggaaacugauccacgaguggugcugucgcagcugcacccugccgccucuucgguacaugggagaagauggcuguugguaugggauggagauuagacccaucucugaaaaggaggagaauauggucaaaucccucgugagcgcuggaucuggcaagguugacaacuucacaaugggggugcugugccuggccauucucuuugaagaggucaugcggggaaaguucggcaaaaagcauaugaucgccggcguguucuuuaccuucguucugcuucugagcgggcagauuacauggcgcgauauggcucacacccucaucaugauuggauccaaugccagcgacagaaugggcaugggggugacguaccuggcgcugaucgcuacauuuaaaauccagcccuuccuugcccugggauuuuuccuccggaagcugaccucuagagaaaaccuccugcuuggcgucgggcuggccauggcuacaacccuccaacugccugaggauauugaacagauggccaauggaaucgcucugggccuuauggcccugaaacucauuacccaguuugagacauaucagcuguggacggcgcucaucucccugaccuguagcaacacaauuuucacccuuacaguggccuggcgcaccgcuacgcugauccucgccggcgugucccugcugccggucugccaaucuagcuccaugcggaagacagacuggcuucccaugaccguugcugccaugggggugccuccccugccucucuuuaucuucucucugaaggauacccucaaaagacgcagcuggccccugaaugagggagugauggccgucggccuuguguccaugcuggcuucuagccugcucagaaacgacguuccuauggcggggccccugguggccggaggccuucugauugcuuguuacgucaucacagggaccuccgccgaucucacaguggaaaaggccgcugacguuacgugggaggaagaggccgaacagaccggagugagccauaaccugaugauuacagucgacgaugacggcaccaugcggaucaaagaugacgagacagagaauauucucaccgugcugcuuaagacggcgcugcugaucgucucuggcaucuuuccguacuccauuccugcuacccuccugguguggcacacauggcagaaacagacccaacgcagcgggguucuuugggaugugcccucuccucccgaaacacagaaggccgagcuggaagagggagucuauagaaucaaacagcagggcauucucgggaagacccaagugggaguuggcgugcagaaggacggggucuuccauacaauguggcacgugacgcggggagccgugcugacccacaacggcaaacgccucgagccgaauugggcuuccguuaagaaagaucugaucagcuacggcgggggauggagacuuucugcccaguggcaaaagggcgaagagguccaggugauugcgguggaaccugggaaaaaccccaagaauuuucagacaaugccuggaaccuuccagaccacaacgggcgagaucggggcuauugcccuggacuucaagcccggaaccuccggcagccccaucaucaaccgggaaggcaaagucguggggcuguauggaaauggcguugugacaaagaacgggggauacgucuccggcauugcccaaaccaaugcugagccugaugggccgacacccgagcucgaagaggaaauguuuaaaaagcgcaaccugaccaucauggaccuucauccuggcagcggaaaaacgagaaaguaucugcccgccauugugcgggaggcuaucaagcgcagacuccggacacugauucucgccccuaccagaguuguggcggccgaaauggaggaggcucugaaaggccuucccauccgcuaccagaccacagccaccaagucugaacacacagggcgggagaucgucgaucugaugugccaugcuaccuucacgaugagacugcucagcccugugcgcguuccgaauuauaaccugauuaucauggacgaagcccacuuuacagaucccgccuccauugcugcgcggggauacaucucuaccagagugggcaugggggaggccgcugccauuuucaugacagccaccccucccggaacggcugacgccuuuccucagagcaaugcgcccauccaggacgaggaacgcgauaucccggagcgguccuggaacucuggcaaugaauggauuaccgacuucgcugggaaaacagucugguuugugccuagcaucaaggccggcaacgauauugccaacugucuucgcaaaaauggaaagaaggugauccaacuguccagaaaaaccuucgacacagaguaccagaagaccaaacucaacgauugggacuuugucguuacaaccgauauuucugaaaugggcgcuaauuucaaggccgaccgggugaucgaucccagacggugccugaaacccgugauucugacggacgggccugagcgcgucauccucgcgggacccaugccugugacagccgcuagcgccgcucagagacggggccgcguugggagaaacccgcagaaggagaaugaucaauauaucuuuaccggacagccccuuaacaaugacgaagaccaugcccacuggaccgaggcuaagaugcugcuggauaacauuaauacaccugaaggcaucauucccgcccucuucgagccugaacgggagaaauccgcggccaucgacggggaguacagacugaagggcgaaagccgcaaaaccuucguggagcuuaugcggagaggagaucugcccgucuggcucgcucacaagguggccucugaaggcauuaaauauacagaccgcaaguggugcuuugaugggcagcggaacaaucagauccuggaggaaaacauggacguugagaucuggacgaaagagggagaaaagaagaaacugagaccgcgcuggcucgaugcucggaccuacuccgacccucuugcccugaaggaguucaaagauuuugccgcuggcagaaagagcauugcgcuggaccucgugacagaaaucgggcgcguccccucucaucuggcccacagaacccggaaugcucuugauaaccuggugaugcuccauacauccgagcacggaggccgcgccuauagacacgccgucgaagaacucccugagaccauggaaacgcugcuccuucugggccugaugauucuccugaccgggggagcuaugcuuuuccugaucagcggcaaagggauuggaaagacauccaucggccucaucugugugauugccucuagcgggaugcuguggauggcggagaucccccugcaauggauugccuccgcuaucguucucgaauuuuucaugauggugcuucugauuccugagcccgagaagcagcggaccccgcaggacaaucaacuggccuacguggucaucggcauucucacaauggcugccaucaucgcggccaacgaaaugggccugcuugagaccacgaaacgcgaucugggcaugagcaaggaaccugggguugugucucccacauccuaucucgacguggaccugcaucccgcuagcgccuggacccuguacgcugucgccacaaccgugauuaccccuaugcucagacacacaaucgaaaauucuacggcuaacguuagccuugccgcgauugccaaccaggcugugguccugaugggacuggauaaaggcuggccgaucuccaagauggaccucggggugccccugcuugcccugggaugcuacucucaggucaauccucucacccugacagcugccgugcugcuccuuguuacccauuaugccauuaucggccccgggcugcaggcgaaagcuacacgggaagcccaaaagagaaccgcugccggaaucaugaagaacccuacgguggauggcauuaucacaauugaccuggaucccgucaucuacgacagcaaauuugagaagcagcucggccaggugaugcugcuuguucugugugccgugcagcuccugcugaugcgcaccuccugggcucucugcgaggcccuuacccuggcgacagggccuauuaccacacugugggaaggaucuccgggcaaauucuggaauacgaccaucgccgucagcauggcuaacaucuuucggggguccuaucucgccggagcuggccuggccuucagcauuaugaagucuguggggacaggaaaaagaggcaccggcucccaaggggagacacuuggagaaaaguggaagaaaaagcugaaucagcucagccgcaaagaguuugaucuguacaagaaauccggcaucaccgaaguggaccggacggaggcgaaggaggggcugaaaagaggagaaaccacacaccaugccguuucucggggcagcgcuaagcuccagugguucgucgagcgcaacauggugauucccgaagggagagugaucgaucuuggauguggccggggcgggugguccuauuacugcgccggacugaagaaagucaccgagguucgcggcuauacaaaagggggaccuggccacgaggagcccgugccuaugucuaccuacggguggaauauugugaaacugaugagcggaaaggacgucuuuuaccugcccccggagaaaugugauacacugcuuugcgacaucggcgaauccagcccuucucccaccguggaggaauccagaacgauucggguucugaagaugguggagcccuggcucaagaacaaucaguucuguaucaaaguccugaacccuuauaugcccgcugugaucgagcaccuggaacgccuccaaagaaagcauggcgggaugcuuguucggaauccucugagccgcaacucuacacacgagauguacuggauuuccaauggaaccggcaacaucgugagcucugucaauauggugagcagacugcuccugaaccgguucaccaugacacauagacgcccgacgauugaaaaagauguggaccuuggggccggaacccggcacgucaacgcugagcccgaaacaccuaauauggacguuaucggcgagagaauuaagcgcaucaaagaggaacacaacuccaccuggcauuaugaugacgagaaucccuacaagacaugggccuaucacgggucuuacgaagugaaggcgaccggaagcgccuccagcaugaucaacggcguggucaaacugcucacaaagccuugggaugugguucccauggugacccagauggcuaugacggacaccacaccguuuggccagcaacgggucuucaaagagaagguggauaccagaacaccucgccccaugccugggacccggaaaguuauggaaauuacggccgaguggcuguggagaacacugggacgcaauaagcggcccagacucugcacccgcgaggaauuuacaaagaaagugcggaccaacgcugccaugggcgccgucuucacggaggaaaaucagugggacuccgcgaaggcugccguggaggaugaagaguuuuggaaacugguugacagagagcgcgaacuucauaagcuggggaaauguggaucuugcguguauaacaugaugggcaagagagagaaaaagcucggggaguucggcaaggccaaaggaagccgggcuaucugguacauguggcugggcgcccgcuaccuugaguuugaggcucugggguuccucaaugaagaucacugguuuuccagagagaacucuuauagcggagucgaaggcgaggggcugcauaagcugggauacauucuccgggacaucuccaaaauuccuggcggggccauguaugcggaugacaccgccggcugggacacaagaaucaccgaagaugaccugcacaaugaggagaagaucacacagcggauggaucccgaacaccgccuucuggcuaacgccauuuucaaacucaccuaccagaauaagguggucaaggugcaaagaccgacaccuaccggaacgguuauggacaucauuucucggaaagaucagcgcggcagcggacaggugggaacauauggccugaacaccuuuaccaauauggaggcucagcuugucagacaaauggaaggggagggagugcuguccaagacagaccucgaaaacccccaucugcccgagaaaaagaucacccaguggcuggagacaaaaggcguggaacggcucaagcgcauggccauuagcggggaugacugcguugugaagccuaucgaugacagauucgcgaacgcccugcuugcucugaaugauaugggcaaaguccggaaggacaucccgcaguggcagcccucuaaaggauggcacgauuggcaacaggugccuuuuuguucccaucacuuccacgagcucauuaugaaggacggccgcaaacugguugugcccugcagaccucaggacgaacuuaucgggcgggcccgcauuagccagggagcuggcuggucucugagagagacggccugucucgggaaggcuuacgcccaaauguggucccugauguauuuccaucggcgcgaucugagacucgcgagcaacgccaucugcucugcuauucccguccacugggugccuaccucccggacaaccuggagcauccaugcccaccaucaguggaugacaaccgaagacaugcugacggucuggaauagaguguggauugaggauaaccccuggauggaggacaagaccccgaucacaaccugggaaaauguuccuuaccuuggaaaacgcgaggaucagugguguggcucccugaucgggcucacaagccgggccaccugggcucaaaacauucccacggccauccaacaggugagaucucugauuggcaaugaagaguuucuugacuacaugccuagcaugaagcgcuuccggaaagaggaagaguccgaaggagcgaucugguga

SEQ ID NO: 20360 - RNA, 9873 nt, Artificial Sequence
  derived and/or modified CDS sequence (opt5) from DENV-3__KF954945__SS-prME
acaagccugugccucaugaugauccugcccgccgcucuugccuuccaccugacgucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccauccuucgcaaacuguguauugagggaaagaucaccaacauuacaaccgauuccagaugcccuacgcagggcgaagcggugcucccggaggaacaggaccagaauuauguguguaaacacacauacgucgaucggggcugggggaacggaugcggccuguucgggaagggaagccuugugaccugcgccaaguuucagugucuggagcccaucgagggcaaaguugugcaguaugaaaaucucaaguacaccgucaucauuacagugcauaccggggaccagcaccagguuggaaacgagacacaaggcaucacggcugaaauuaccccucaggccucuacaaccgaggcuauccugcccgaauauggcacacuggggcucgagugcuccccucgcaccggacuggacuucaaugagaugauucuucugacgaugaaaaacaaggccuggauggugcauagacagugguuuuucgaucucccccugccguggaccagcggcgccacaaccgaaacaccuaccuggaaucggaaagagcuucuggucacguuuaagaacgcucacgcgaaaaagcaagaaguggucgugcucgggucucaggagggagccaugcacacagcucugaccggcgccacagaaauccaaaauuccgggggcaccagcaucuucgccggacaucugaagugucgccucaaaauggacaagcuggagcuuaaaggcaugucuuacgcuaugugcaccaacacauuuguucugaagaaagagguguccgaaacgcagcacgggaccauucucaucaaggucgaguacaagggagaagaugcccccuguaaaauuccuuucagcacagaggacggccaagggaaggcgcauaacggaagacugaucaccgcuaaucccgugguuaccaagaaggaggaacccgugaacauugaggccgaaccuccguucggcgaguccaauaucgucaucgggauuggcgauaacgcccugaaaaucaauugguauaagaagggaucuagcauuggcaaaauguuugaagcuaccgccagaggggcuagacgcauggccauccuuggagacacggcgugggauuucggcuccgucggcggggugcucaacagccuggggaagaugguucaccagauuuuugggucugccuacacagcucuguucuccggcgucagcugggugaugaaaaucggaauuggcgugcuccugaccuggaucgggcuuaauucuaagaacaccagcauguccuuuucuugcaucgccauuggaaucauuacacuguaucucggcgcugucgugcaggccgacaugggguguguuaucaauuggaaaggaaaggagcugaagugcggcagcgggauuuucgugaccaacgagguccauacauggacggaacaguacaaauuucaagcggauucccccaagcggcuggccaccgcuaucgugggcgccugggagaauggaguuuguggcaucagaagcacaacccgcauggaaaaccuucucuggaaacagauugcuaaugagcugaacuauauccugugggaaaauaacauuaagcucacaguggucgugggggacaccaucggaguucuggagcagggcaaacggacgcuuaccccucagcccauggagcugaaguacucuuggaaaacaugggggaaggccaagauugugaccgccgaaacacaaaacuccagcuucaucaucgauggaccuaauacccccgagugcccgucugcuuccagagcguggaacgucugggaaguggaggacuauggcuuuggcguguucacaaccaauauuuggcucaaacugcgcgaagucuacacgcagaugugugaccaccggcugaugagcgccgcuguuaaggaugagagagccgugcacgccgacaugggguacuggaucgagucccagaaaaacggaucuuggaaacuugaaaaagcuagccucauugaggugaagacaugcaccuggccuaagucccauacccuguggucuaauggcguccuggaaagcgauaugaucauucccaaaucccucgccgggccuaucagccagcacaacuaucgccccggauaccauacacaaaccgcgggcccuuggcaccuggggaaacuugagcuggacuuuaauuauugcgagggaacgacagugguuaucaccgaaaacuguggcacacggggccccucucucagaaccacaaccguguccgggaaacugauucacgaguggugcugucgcagcugcacgcugccgccucuucgguacaugggagaagauggcuguugguaugggauggagaucagacccauuucugaaaaggaggagaauauggucaaaucccucgugagcgcuggaucuggcaagguugacaacuucaccaugggggugcugugccuggccauccucuuugaagaggucaugcggggaaaguucggcaaaaagcauaugauugccggcguguucuuuacauucguucugcuucugagcgggcagaucaccuggcgcgauauggcucacacacucauuaugaucggauccaaugccagcgacagaaugggcaugggggugaccuaccuggcgcugaucgcuacguuuaaaauucagcccuuccuugcccugggauuuuuccuccggaagcugacaucuagagaaaaccuccugcuuggcgucgggcuggccauggcuaccacacuccaacugccugaggauaucgaacagauggccaauggaauugcucugggccuuauggcccugaaacucaucacccaguuugagaccuaucagcuguggacagcgcucauuucccugacguguagcaacaccaucuucacacuuaccguggccuggcgcacagcuacccugauccucgccggcgugucccugcugccggucugccaaucuagcuccaugcggaagacggacuggcuucccaugacaguugcugccaugggggugccuccccugccucucuuuauuuucucucugaaggauacccucaaaagacgcagcuggccccugaaugagggagugauggccgucggccuuguguccaugcuggcuucuagccugcucagaaacgacguuccuauggcggggccccugguggccggaggccuucugaucgcuuguuacgucauuaccgggacauccgccgaucucaccguggaaaaggccgcugacguuacaugggaggaagaggccgaacagacgggagugagccauaaccugaugaucaccgucgacgaugacggcacaaugcggauuaaagaugacgagaccgagaauauccucacagugcugcuuaagaccgcgcugcugaucgucucuggcauuuuuccguacuccaucccugcuacgcuccugguguggcacaccuggcagaaacagacacaacgcagcgggguucuuugggaugugcccucuccucccgaaacccagaaggccgagcuggaagagggagucuauagaauuaaacagcagggcauccucgggaagacacaagugggaguuggcgugcagaaggacggggucuuccauaccauguggcacgugacacggggagccgugcugacgcacaacggcaaacgccucgagccgaauugggcuuccguuaagaaagaucugauuagcuacggcgggggauggagacuuucugcccaguggcaaaagggcgaagagguccaggugaucgcgguggaaccugggaaaaaccccaagaauuuucagaccaugccuggaacauuccagaccaccacaggcgagauuggggcuaucgcccuggacuucaagcccggaacguccggcagccccaucauuaaccgggaaggcaaagucguggggcuguauggaaauggcguugugaccaagaacgggggauacgucuccggcaucgcccaaacaaaugcugagccugaugggccgacccccgagcucgaagaggaaauguuuaaaaagcgcaaccugacaauuauggaccuucauccuggcagcggaaaaaccagaaaguaucugcccgccaucgugcgggaggcuauuaagcgcagacuccggacgcugauccucgccccuacaagaguuguggcggccgaaauggaggaggcucugaaaggccuucccauccgcuaccagaccaccgccacaaagucugaacacaccgggcgggagauugucgaucugaugugccaugcuacauucaccaugagacugcucagcccugugcgcguuccgaauuauaaccugaucauuauggacgaagcccacuuuacggaucccgccuccaucgcugcgcggggauacauuucuacaagagugggcaugggggaggccgcugccaucuucaugaccgccacaccucccggaaccgcugacgccuuuccucagagcaaugcgcccauccaggacgaggaacgcgauauuccggagcgguccuggaacucuggcaaugaauggaucacggacuucgcugggaaaaccgucugguuugugccuagcauuaaggccggcaacgauaucgccaacugucuucgcaaaaauggaaagaaggugauucaacuguccagaaaaacauucgacaccgaguaccagaagacaaaacucaacgauugggacuuugucguuaccacagauaucucugaaaugggcgcuaauuucaaggccgaccgggugauugaucccagacggugccugaaacccgugauccugaccgacgggccugagcgcgucauccucgcgggacccaugccugugacggccgcuagcgccgcucagagacggggccgcguugggagaaacccgcagaaggagaaugaucaauauauuuuuacaggacagccccuuaacaaugacgaagaccaugcccacuggaccgaggcuaagaugcugcuggauaacaucaauaccccugaaggcauuauccccgcccucuucgagccugaacgggagaaauccgcggccauugacggggaguacagacugaagggcgaaagccgcaaaacauucguggagcuuaugcggagaggagaucugcccgucuggcucgcucacaagguggccucugaaggcaucaaauauaccgaccgcaaguggugcuuugaugggcagcggaacaaucagauccuggaggaaaacauggacguugagauuuggacaaaagagggagaaaagaagaaacugagaccgcgcuggcucgaugcucggacguacuccgacccucuugcccugaaggaguucaaagauuuugccgcuggcagaaagagcaucgcgcuggaccucgugaccgaaauugggcgcguccccucucaucuggcccacagaacacggaaugcucuugauaaccuggugaugcuccauaccuccgagcacggaggccgcgccuauagacacgccgucgaagaacucccugagacaauggaaacccugcuccuucugggccugaugauccuccugacagggggagcuaugcuuuuccugauuagcggcaaagggaucggaaagaccuccaucggccucauuugugugaucgccucuagcgggaugcuguggauggcggagauuccccugcaauggaucgccuccgcuauuguucucgaauuuuucaugauggugcuucugaucccugagcccgagaagcagcggacaccgcaggacaaucaacuggccuacguggucauuggaauccucaccauggcugccaucauugcggccaacgaaaugggccugcuugagacaaccaaacgcgaucugggcaugagcaaggaaccugggguugugucucccacguccuaucucgacguggaccugcaucccgcuagcgccuggacacuguacgcugucgccaccacagugaucaccccuaugcucagacacaccauugaaaauucuacagcuaacguuagccuugccgcgaucgccaaccaggcugugguccugaugggacuggauaaaggcuggccgauuuccaagauggaccucggggugccccugcuugcccugggaugcuacucucaggucaauccucucacgcugaccgcugccgugcugcuccuuguuacacauuaugccaucaucggccccgggcugcaggcgaaagcuacccgggaagcccaaaagagaacagcugccggaauuaugaagaacccuaccguggauggcaucauuacgaucgaccuggaucccgucauuuacgacagcaaauuugagaagcagcucggccaggugaugcugcuuguucugugugccgugcagcuccugcugaugcgcacauccugggcucucugcgaggcccuuacccuggcgaccgggccuaucacaacccugugggaaggaucuccgggcaaauucuggaauacaacgaucgccgucagcauggcuaacauuuuucggggguccuaucucgccggagcuggccuggccuucagcaucaugaagucuguggggaccggaaaaagaggcacaggcucccaaggggagacccuuggagaaaaguggaagaaaaagcugaaucagcucagccgcaaagaguuugaucuguacaagaaauccggcauuacagaaguggaccggaccgaggcgaaggaggggcugaaaagaggagaaacgacccaccaugccguuucucggggcagcgcuaagcuccagugguucgucgagcgcaacauggugauccccgaagggagagugauugaucuuggauguggccggggcgggugguccuauuacugcgccggacugaagaaagucacagagguucgcggcuauaccaaagggggaccuggccacgaggagcccgugccuaugucuacauacggguggaauaucgugaaacugaugagcggaaaggacgucuuuuaccugcccccggagaaaugugauacccugcuuugcgacauuggcgaauccagcccuucucccacaguggaggaauccagaaccauccggguucugaagaugguggagcccuggcucaagaacaaucaguucuguaucaaaguccugaacccuuauaugcccgcugugauugagcaccuggaacgccuccaaagaaagcauggcgggaugcuuguucggaauccucugagccgcaacucuacgcacgagauguacuggaucuccaauggaacaggcaacauugugagcucugucaauauggugagcagacugcuccugaaccgguucaccaugacccauagacgcccgacaaucgaaaaagauguggaccuuggggccggaacgcggcacgucaacgcugagcccgaaaccccuaauauggacguuauuggcgagagaaucaagcgcaucaaagaggaacacaacuccacauggcauuaugaugacgagaaucccuacaagaccugggccuaucacgggucuuacgaagugaaggcgacaggaagcgccuccagcaugauuaacggcguggucaaacugcucaccaagccuugggaugugguucccauggugacacagauggcuaugaccgacacgaccccguuuggccagcaacgggucuucaaagagaagguggauacaagaaccccucgccccaugccugggacacggaaaguuauggaaaucaccgccgaguggcuguggagaacgcugggacgcaauaagcggcccagacucugcacacgcgaggaauuuaccaagaaagugcggacaaacgcugccaugggcgccgucuucaccgaggaaaaucagugggacuccgcgaaggcugccguggaggaugaagaguuuuggaaacugguugacagagagcgcgaacuucauaagcuggggaaauguggaucuugcguguauaacaugaugggcaagagagagaaaaagcucggggaguucggcaaggccaaaggaagccgggcuauuugguacauguggcugggcgcccgcuaccuugaguuugaggcucugggguuccucaaugaagaucacugguuuuccagagagaacucuuauagcggagucgaaggcgaggggcugcauaagcugggauacauccuccgggacauuuccaaaaucccuggcggggccauguaugcggaugacacggccggcugggacaccagaaucacagaagaugaccugcacaaugaggagaagauuacccagcagauggaucccgaacaccggcuucuggcuaacgccaucuucaaacucacauaccaaaauaagguggucaaggugcagcgcccgaccccuacaggaaccguuauggacauuaucucuagaaaagaucagcggggcagcggacaggugggaacguauggccugaacacauuuaccaauauggaggcucaacuuguccgccagauggaaggggagggagugcuguccaagaccgaccucgaaaacccccaucugcccgagaaaaagauuacacaguggcuggagaccaaaggcguggaaagacucaagcggauggccaucagcggggaugacugcguugugaagccuaucgaugaccgcuucgcgaacgcccugcuugcucugaaugauaugggcaaagucagaaaggacauuccgcaguggcaacccucuaaaggauggcacgauuggcaacaggugccuuuuuguucccaucacuuccacgagcucaucaugaaggacggccggaaacugguugugcccugccgcccucaggacgaacuuauugggagagcccggaucagccaaggagcuggcuggucucugcgcgagacagccugucucgggaaggcuuacgcccagauguggucccugauguauuuccauagacgggaucugcgccucgcgagcaacgccauuugcucugcuauccccguccacugggugccuacguccagaaccacauggagcauucaugcccaccaucaguggaugaccacagaagacaugcugaccgucuggaaucggguguggaucgaggauaaccccuggauggaggacaagacgccgaucaccacaugggaaaauguuccuuaccuuggaaaaagagaggaucaaugguguggcucccugauugggcucaccagccgcgccacaugggcucagaacauccccaccgccauucaacaggugcggucucugaucggcaaugaagaguuucuugacuacaugccuagcaugaagagauuccgcaaagaggaagaguccgaaggagcgauuugguga

SEQ ID NO: 20361 - RNA, 9873 nt, Artificial Sequence
  derived and/or modified CDS sequence (opt5) from DENV-3__JX669495__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcucgccggauggccauccuuggagacacagcgugggauuucggcuccguggggggaguucucaacagccugggcaagaugguccaucagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcacacguggaccgaacaguacaaauuucaagcggauucccccaagagacuggccacagcuaucgccggcgcuugggagaauggaguuuguggcauucgcagcaccacacggauggaaaaccuucucuggaaacagaucgccaaugagcugaacuauauccugugggaaaauaacauuaagcucaccguggucgugggggacaucauuggaguucuggagcagggcaaaagaacgcuuaccccucagcccauggagcugaaguacucuuggaaaacaugggggaaggccaagaucgugaccgcugaaacacaaaacuccagcuucauuaucgauggaccuaauacccccgagugcccgucugcgucccgcgccuggaacgucugggaaguggaggacuauggcuuuggcguguucacaaccaauaucuggcucaaacugcgggaagucuacacgcagcugugugaccauagacuuaugagcgcugccguuaaggaugagcgcgccgugcacgcugacaugggguacuggauugagucccagaaaaacggaucuuggaagcucgaaaaagccagccugaucgaggugaagacaugcaccuggccuaagucccacacccuguggucuaauggcguccucgaaagcgauaugauuauccccaaaucccuggcggggccuauuagccagcauaaccaccggcccggauaucauacacaaaccgcuggcccuuggcaccuugggaagcuggagcucgacuuuaauuacugcgagggaacgacagugguuaucaccgaaaacuguggcacaagaggccccucucugcgcaccacaaccguguccgggaaacugauccacgaguggugcugucggagcugcacgcuuccgccucucagauauaugggagaagauggcuguugguacgggauggagauucggcccaucucugaaaaggaggagaauauggucaaaucccuggugagcgccggaucuggcaagguugacaacuucaccaugggggugcugugccucgccauucuguuugaagaggucaugcgcggaaaguucggcaaaaagcauaugaucgcuggcguguucuuuacauucguucuucugcucagcgggcagauuaccuggagagauauggcccacacacugaucaugauuggauccaaugcgagcgaccggaugggcaugggggugaccuaucuggcucuuaucgccacguuuaaaauccagcccuuccuggcccucggauuuuuccugagaaagcucacaucucgcgaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauguucacacugaccguggcuuggcggacagccacccucauucuggcuggcgugucccugcuuccggucugccaaucuagcuccaugagaaagacggacuggcugcccauggccguugccgcuaugggggugccuccccucccucuguuuaucuucucucucaaggauacacugaaacgcagaagcuggccccuuaaugagggagugauggcggucggccugguguccauccuggccucuagccuccugcggaacgacguuccuauggcugggccccuuguggccggaggccugcucauugccuguuaugucaucaccgggaccuccgcugaucugacaguggaaaaggccgcggacauuaccugggaggaagaggcugaacagacaggaguuagccauaaccucaugaucacgguggacgaugacggcaccaugcgcauuaaagaugacgagacagagaauauccugaccguccuucugaagacagcccugcucaucgugucuggcgucuuuccguacuccauuccugccacccugcuuguguggcacacguggcagaaacagacccaaagaagcgggguucugugggaugugcccucuccucccgaaacacagaaggcugagcucgaagagggagucuaccggaucaaacagcagggcauuuucgggaagacccaagugggaguuggcgugcagaaggagggggucuuucauacaauguggcacgugacccgcggagccgugcugacauauaacggcaaaagacucgaaccgaauugggcguccguuaagaaagaccugaucagcuacggcgggggauggcggcuuucugcucaguggcaaaagggcgaggaaguccaggugauugccguggagccugggaaaaaccccaagaauuuccagacgaugccuggaaccuuccagacaaccaccggcgaaaucggggccauugcucuggauuuuaagcccggaacauccggcagccccaucaucaaccgcgagggcaaagucguggggcuguauggaaauggcguugugacgaagaacgggggauacgucuccggcauugcccaaaccaaugcugagccugacgggccgacacccgaacucgaggaagagauguucaaaaagagaaaccugaccaucauggaucuucacccuggcagcggaaaaacacggaaguaucugcccgccauugugcgcgaagcgaucaagagacggcucagaacccugauucucgccccuacgcgcguuguggcugccgagauggaggaagcucugaaaggccuucccauccgguaccagacaaccgccaccaagucugagcauacagggagagaaaucgucgaccugaugugccacgccaccuuuacaaugcgccugcucagcccugugcggguuccgaauuauaaccugauuaucauggaugaggcucauuucaccgaccccgcguccauugccgcuagaggauacaucucuacgcgcgugggcaugggggaagccgccgcuauuuuuaugacagccaccccucccggaacagcggaugcuuucccucagagcaaugcccccauccaggacgaggagcgggacaucccggaaagauccuggaacucuggcaaugaguggauuaccgauuuugccgggaaaacggucugguucgugccuagcaucaaggcuggcaacgacauugccaacugucuucgcaaaaauggaaagaaggugauccaacugucccggaaaaccuuugauacagaauaccagaagaccaaacucaacgacugggauuucgucguuacaaccgacauuucugagaugggcgcgaauuuuaaggccgauagagugaucgacccccggcgcugccugaaacccgugauucugacagaugggccugagagagucauccucgcuggacccaugccugugaccgccgcuagcgccgcucagcggcgcggcagaguugggcggaacccgcagaaggaaaaugaccaauauaucuucacgggacagccccuuaacaaugaugaggaccacgcccauuggacagaagcgaagaugcugcuggacaacauuaauaccccugagggcaucauucccgcccucuucgaaccugagagagagaaauccgcugccaucgauggggaauaccgccugaagggcgagagccggaaaaccuuuguggaacuuaugagacgcggagaccugcccgucuggcucgcucacaagguggccucugagggcauuaaauauacagaucggaaguggugcuucgacgggcagagaaacaaucagauccuggaagagaacauggauguugagaucuggaccaaagaaggagagaagaagaaacugcgcccgcgguggcucgacgccagaacauacuccgauccucuugcucugaaggaauuuaaagacuucgcggccggccgcaagagcauugcucuggaucucgugacggagaucgggagaguccccucucaccuggcccaucggacccgcaaugcccuugacaaccuggugaugcuccacacauccgaacauggaggcagagcuuaucggcacgccgucgaggagcugccugaaaccauggagacacugcuccuucugggccugaugauucuccugaccgggggagcgaugcuuuuucugaucagcggcaaagggauuggaaagacguccaucggccucaucugugugauugccucuagcgggaugcuguggauggcugaaaucccccugcaauggauugccuccgcuaucguucucgaguucuuuaugauggugcuucugauuccugagcccgaaaagcagcgcaccccgcaggauaaucaacuggccuacguggucaucggaauucucacacuggcggccaucaucgcugccaacgagaugggccuucuggaaaccacaaaaagagaccucggcaugagcaaggagccugggguugugucucccaccuccuaucuggauguggaccugcaccccgcuagcgccuggacgcucuacgcugucgccacaaccgugauuacaccuaugcuucggcauaccaucgaaaauucuaccgcgaacguuagccuggccgcuauugccaaccaggcugugguccugaugggacucgacaaaggcuggccgaucuccaagauggaucugggggugccccuucuggcccucggaugcuacucucaggucaauccucugacacugacggccgcggugcuccuucugauuacccacuaugcuaucaucggccccgggcugcaggccaaagcuacaagagaggcccaaaagcgcaccgccgcuggaauuaugaagaacccuacaguugacggcaucaugaccauugaucucgaccccgugaucuacgauagcaaauucgagaagcagcugggccaggucaugcuucuggugcucugugccguucagcugcugcucaugcggacguccugggcgcuuugcgaagcccugacacuggcuaccgggccuauuaccacacucugggagggaucuccgggcaaauuuuggaauaccacaaucgccgugagcauggcuaacaucuucagaggguccuaucuggccggagcgggccuugccuuuagcauuaugaagucugucgggacgggaaaacgcggcaccggcucccaaggggaaacacugggagagaaguggaagaaaaagcucaaucagcugagccggaaagaauucgaccuguacaagaaauccggcaucaccgagguggauagaacagaggcuaaggaagggcucaaacggggagagauuacccaucacgccgugucucgcggcagcgcuaagcuucagugguuuguugaaagaaacauggucauccccgaggggcgggugauugaccugggauguggccgcggcgggugguccuauuacugcgccggacugaagaaagugacggaagucagaggcuauaccaaggggggaccuggccaugaggagcccguuccuaugucuacauacggguggaauaucgugaaacucaugagcggaaaggauguguucuaccugcccccggaaaaaugugacacccuucugugcgauauuggcgaguccagcccuucucccacagucgaagagucccggaccauccgcgugcucaagaugguugagcccuggcugaagaacaaucaguucuguaucaaagugcugaacccuuauaugcccacagucauugaacaccucgagagacuucaacggaagcacggcgggaugcuggugcgcaauccucugagcagaaacucuacccaugaaauguacuggaucuccaauggaacgggcaacauuguugcuagcgugaauauggucucucggcuccugcuuaacagauuuacaaugacccaccgccggccgaccaucgagaaagacguggaucugggggccggaacaagacaugugaacgcggaacccgagacgccuaauauggacgucauuggcgagcgcaucaagcggaucaaagaagagcacaacagcaccuggcacuaugacgaugaaaaucccuacaagacaugggccuaucauggguccuacgagguuaaggcuaccggaucugccagcuccaugauuaacggcguggugaaacuccugacaaagccuugggacgucgugcccaugguuacccagauggcuaugacagauaccacgccguucggccagcaaagaguguuuaaagaaaaggucgacacccgcacaccucggagcaugcccgggaccagacgcgugaugggaaucacagccgaguggcuguggcggacccucggcagaaauaaaaagccucgccugugcacgcgggaggaauucacaaagaaaguuagaaccaacgccgcgaugggggcuguguuuacagaggaaaaucagugggauuccgccaaggccgcugucgaggacgaagauuucuggaaacuuguggaccgcgagagagagcugcacaagcucggaaaauguggcucuugcguuuauaacaugauggggaagcgggaaaaaaagcugggcgaguuuggaaaggccaaaggcagccgcgcuauuugguacauguggcuuggggccagauaccuggaauucgaggcgcucggauuucugaaugaggaucauugguucucccgggaaaacucuuauagcggcguggagggggaaggacugcacaagcucggcuacauccugagagacauuuccaaaauccccgggggcgccauguaugcugaugacaccgccggaugggacacgcggaucaccgaggaugaccuucauaaugaagagaagauuacacagcagauggauccugagcaccgccaacuggcuaacgccaucuuuaaacucaccuaccagaauaaggucgugaagguccagagacccacaccgaccggcacagugauggacauuaucucucggaaagaucagcgcgggagcggacaaguuggcaccuaugggcugaacacguucacaaauauggaagcgcagcuuauuagacagauggagggagaaggcgugcuguccaaggccgaccucgagaacccucaccugcccgaaaaaaaggucacccaguggcuggagaccaaagggguggagcggcucaagcgcauggcuaucagcggcgaugacugcgugguuaagcccaucgaugacagauuugccaacgcucugcuugcccugaaugauaugggaaaagugcggaaggacauuccucaauggcagccgucuaaaggcuggcaugauuggcagcagguccccuucuguucccaccauuuccacgaacucaucaugaaggacgggcgcaaacuggugguuccuugcagaccccaagacgagcuuauuggacgggcucgcaucagccagggcgccggguggucucugagagaaacagcgugucucggaaaggccuacgcucagauguggucccugauguauuuucaccggcgcgaucugagacucgccagcaacgccauuugcucugcugugccuguccauugggugcccaccucccggacaacguggagcauccacgcccaucaccaauggaugaccacagaggacaugcugaccgucuggaauagaguguggauugaagauaacccuuggauggaggacaagacacccguuaccacgugggagaaugugccguaccuuggcaaacgcgaagaucaguggugugggucccugaucggccucaccagccgggcgacaugggcucagaacaucccuaccgccauucagcaagucagaucucugaucggaaaugaggaauuccuugacuacaugcccagcaugaagcgcuuucggaaagaggaggaauccgagggcgccauuugguga

SEQ ID NO: 20362 - RNA, 9873 nt, Artificial Sequence
  derived and/or modified CDS sequence (opt5) from DENV-3__JX669499__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcucgccggauggccauccuuggagacacagcgugggauuucggcuccguggggggaguucucaacagccugggcaagaugguccaucagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcacacguggaccgaacaguacaaauuucaagcggauucccccaagagacuggccacagcuaucgccggcgcuugggagaauggaguuuguggcauucgcagcaccacacggauggaaaaccuucucuggaaacagaucgccaaugagcugaacuauauccugugggaaaauaacauuaagcucaccguggucgugggggacaucauuggaguucuggagcagggcaaaagaacgcuuaccccucagcccauggagcugaaguacucuuggaaaacaugggggaaggccaagaucgugaccgcugaaacacaaaacuccagcuucauuaucgauggaccuaauacccccgagugcccgucugcgucccgcgccuggaacgucugggaaguggaggacuauggcuuuggcguguucacaaccaauaucuggcucaaacugcgggaagucuacacgcagcugugugaccauagacuuaugagcgcugccguuaaggaugagcgcgccgugcacgcugacaugggguacuggauugagucccagaaaaacggaucuuggaagcucgaaaaagccagccugaucgaggugaagacaugcaccuggccuaagucccacacccuguggucuaauggcguccucgaaagcgauaugauuauccccaaaucccuggcggggccuauuagccagcauaaccaccggcccggauaucauacacaaaccgcuggcccuuggcaccuugggaagcuggagcucgacuuuaauuacugcgagggaacgacagugguuaucaccgaaaacuguggcacaagaggccccucucugcgcaccacaaccguguccgggaaacugauccacgaguggugcugucggagcugcacgcuuccgccucucagauauaugggagaagauggcuguugguacgggauggagauucggcccaucucugaaaaggaggagaauauggucaaaucccuggugagcgccggaucuggcaagguugacaacuucaccaugggggugcugugccucgccauucuguuugaagaggucaugcgcggaaaguucggcaaaaagcauaugaucgcuggcguguucuuuacauucguucuucugcucagcgggcagauuaccuggagagauauggcccacacacugaucaugauuggauccaaugcgagcgaccggaugggcauggggaucaccuaucuggcucuuaucgccacguuuaaaauucagcccuuccuggcccucggauuuuuccugagaaagcucacaucucgcgaaaaccugcuucugggcguggggcucgcuauggccaccacacugcaacugccugaggauaucgaacagauggcuaauggaauugcccuuggccugauggcgcucaaacugaucacccaguuugagaccuaccagcucuggacagcccugauuucccuuacguguagcaacaccauguucacacugaccgucgcuuggcggacagccacccucauccuggcuggcgugucccugcuuccggugugccaaucuagcuccaugagaaagacggacuggcugcccauggccgucgccgcuauggggguuccuccccucccucuguuuaucuucucucucaaggauacacugaaacgcagaagcuggccccuuaaugagggagugauggcggugggccuggucuccauucuggccucuagccuccugcggaacgacgugccuauggcugggccccuuguugccggaggccugcucaucgccuguuaugugauuaccgggaccuccgcugaucugacagucgaaaaggccgcggacaucaccugggaggaagaggcugaacagacaggagugagccauaaccucaugauuacgguugacgaugacggcaccaugcgcaucaaagaugacgagacagagaauauccugaccgugcuucugaagacagcccugcucauugucucuggcguguuuccguacuccaucccugccacccugcuugucuggcacacguggcagaaacagacccaaagaagcggggugcugugggauguucccucuccucccgaaacacagaaggcugagcucgaagagggaguguaccggauuaaacagcagggcaucuucgggaagacccaagucggagugggcguucagaaggaggggguguuucauacaauguggcacgucacccgcggagccgugcugacauauaacggcaaaagacucgaaccgaauugggcguccgugaagaaagaccugauuagcuacggcgggggauggcggcuuucugcucaguggcaaaagggcgaggaaguucaggucaucgccguggagccugggaaaaaccccaagaauuuccagacgaugccuggaaccuuccagacaaccaccggcgaaauuggggccaucgcucuggauuuuaagcccggaacauccggcagccccaucauuaaccgcgagggcaaaguggucgggcuguauggaaauggcgugguuacgaagaacgggggauacguguccggcaucgcccaaaccaaugcugagccugacgggccgacacccgaacucgaggaagagauguucaaaaagagaaaccugaccauuauggaucuucacccuggcagcggaaaaacacggaaguaucugcccgccaucguccgcgaagcgauuaagagacggcucagaacccugauccucgccccuacgcgcgugguugcugccgagauggaggaagcucugaaaggccuucccauccgguaccagacaaccgccaccaagucugagcauacagggagagaaauuguggaccugaugugccacgccaccuuuacaaugcgccugcucagcccuguccgggugccgaauuauaaccugaucauuauggaugaggcucauuucaccgaccccgcguccaucgccgcuagaggauacauuucuacgcgcguuggcaugggggaagccgccgcuaucuuuaugacagccaccccucccggaacagcggaugcuuucccucagagcaaugcccccauccaggacgaggagcgggacauuccggaaagauccuggaacucuggcaaugaguggaucaccgauuuugccgggaaaacggugugguucgucccuagcauuaaggcuggcaacgacaucgccaacugucuucgcaaaaauggaaagaaggugauucaacugucccggaaaaccuuugauacagaauaccagaagaccaaacucaacgacugggauuucguggucacaaccgacaucucugagaugggcgcgaauuuuaaggccgauagaguuauugacccccggcgcugccugaaacccgugauccugacagaugggccugagagagugauccucgcuggacccaugccugucaccgccgcuagcgccgcucagcggcgcggcagaguggggcggaacccgcagaaggaaaaugaccaauauauuuucacgggacagccccuuaacaaugaugaggaccacgcccauuggacagaagcgaagaugcugcuggacaacaucaauaccccugagggcauuauccccgcccucuucgaaccugagagagagaaauccgcugccauugauggggaauaccgccugaagggcgagagccggaaaaccuuuguugaacuuaugagacgcggagaccugcccguguggcucgcucacaaggucgccucugagggcaucaaauauacagaucggaaguggugcuucgacgggcagagaaacaaucagauccuggaagagaacauggauguggagauuuggaccaaagaaggagagaagaagaaacugcgcccgcgguggcucgacgccagaacauacuccgauccucuugcucugaaggaauuuaaagacuucgcggccggccgcaagagcaucgcucuggaucucguuacggagauugggagagugcccucucaccuggcccaucggacccgcaaugcccuugacaaccuggucaugcuccacacauccgaacauggaggcagagcuuaucggcacgccguggaggagcugccugaaaccauggagacacugcuccuucugggccugaugauccuccugaccgggggagcgaugcuuuuucugauuagcggcaaagggaucggaaagacguccaucggccucauuugugucaucgccucuagcgggaugcuguggauggcugaaauuccccugcaauggaucgccuccgcuauugugcucgaguucuuuaugaugguucuucugaucccugagcccgaaaagcagcgcaccccgcaggauaaucaacuggccuacguggugauuggaauccucacacuggcggccaucauugcugccaacgagaugggccuucuggaaaccacaaaaagagaccucggcaugagcaaggagccuggggucguuucucccaccuccuaucuggauguggaccugcaccccgcuagcgccuggacgcucuacgcuguggccacaaccgucaucacaccuaugcuucggcauaccauugaaaauucuaccgcgaacgugagccuggccgcuaucgccaaccaggcuguugugcugaugggacucgacaaaggcuggccgauuuccaagauggaucugggggucccccuucuggcccucggaugcuacucucaggugaauccucugacacugacggccgcgguccuccuucugaucacccacuaugcuaucauuggccccgggcugcaggccaaagcuacaagagaggcccaaaagcgcaccgccgcuggaaucaugaagaacccuacaguggacggcauuaugaccaucgaucucgaccccguuauuuacgauagcaaauucgagaagcagcugggccaggugaugcuucugguccucugugccgugcagcugcugcucaugcggacguccugggcgcuuugcgaagcccugacacuggcuaccgggccuaucaccacacucugggagggaucuccgggcaaauuuuggaauaccacaaucgccguuagcauggcuaacauuuucagaggguccuaucuggccggagcgggccuugccuuuagcaucaugaagucuguggggacgggaaaacgcggcaccggcucccaaggggaaacacugggagagaaguggaagaaaaagcucaaucagcugagccggaaagaauucgaccuguacaagaaauccggcauuaccgaggucgauagaacagaggcuaaggaagggcucaaacggggagagaucacccaucacgccgugucucgcggcagcgcuaagcuucagugguuuguggaaagaaacaugguuauucccgaggggcgggucaucgaccugggauguggccgcggcgggugguccuauuacugcgccggacugaagaaagugacggaagugagaggcuauaccaaggggggaccuggccaugaggagcccgucccuaugucuacauacggguggaauauuguuaaacucaugagcggaaaggauguguucuaccugcccccggaaaaaugugacacccuucugugcgauaucggcgaguccagcccuucucccacaguggaagagucccggaccauccgcguccucaagaugguggagcccuggcugaagaacaaucaguucuguauuaaaguucugaacccuuauaugcccacagugaucgaacaccucgagagacuucaacggaagcacggcgggaugcugguccgcaauccucugagcagaaacucuacccaugaaauguacuggauuuccaauggaacgggcaacaucguggcuagcguuaauauggugucucggcuccugcuuaacagauuuacaaugacccaccgccggccgaccauugagaaagacgucgaucugggggccggaacaagacaugugaacgcggaacccgagacgccuaauauggacgugaucggcgagcgcaucaagcggauuaaagaagagcacaacagcaccuggcacuaugacgaugaaaaucccuacaagacaugggccuaucauggguccuacgaggucaaggcuaccggaucugccagcuccaugaucaacggcguugugaaacuccugacaaagccuugggacgugguccccauggugacccagauggcuaugacagauaccacgccguucggccagcaaagaguuuuuaaagaaaagguggacacccgcacaccucggagcaugcccgggaccagacgcgucaugggaauuacagccgaguggcuguggcggacccucggcagaaauaaaaagccucgccugugcacgcgggaggaauucacaaagaaagugagaaccaacgccgcgaugggggcuguuuuuacagaggaaaaucagugggauuccgccaaggccgcuguggaggacgaagauuucuggaaacuugucgaccgcgagagagagcugcacaagcucggaaaauguggcucuugcguguauaacaugauggggaagcgggaaaaaaagcugggcgaguuuggaaaggccaaaggcagccgcgcuaucugguacauguggcuuggggccagauaccuggaauucgaggcgcucggauuucugaaugaggaucauugguucucccgggaaaacucuuauagcggcguugagggggaaggacugcacaagcucggcuacauucugagagacaucuccaaaauccccgggggcgccauguaugcugaugacaccgccggaugggacacgcggauuaccgaggaugaccuucauaaugaagagaagaucacacagcagauggauccugagcaccgccaacuggcuaacgccauuuuuaaacucaccuaccagaauaagguggucaaggugcagagacccacaccgaccggcacagucauggacaucauuucucggaaagaucagcgcgggagcggacaagugggcaccuaugggcugaacacguucacaaauauggaagcgcagcuuaucagacagauggagggagaaggcguucuguccaaggccgaccucgagaacccucaccugcccgaaaaaaagaucacccaguggcuggagaccaaagggguggagcggcucaagcgcauggcuauuagcggcgaugacugcgucgugaagcccaucgaugacagauuugccaacgcucugcuugcccugaaugauaugggaaaagugcggaaggacauuccucaauggcagccgucuaaaggcuggcaugauuggcagcagguucccuucuguucccaccauuuccacgaacucaucaugaaggacgggcgcaaacugguggucccuugcagaccccaagacgagcuuauuggacgggcucgcaucagccagggcgccggguggucucugagagaaacagcgugucucggaaaggccuacgcucagauguggucccugauguauuuucaccggcgcgaucugagacucgccagcaacgccauuugcucugcugugccuguucauugggugcccaccucccggacaacguggagcauccacgcccaucaccaauggaugaccacagaggacaugcugaccgucuggaauagaguguggaucgaagauaacccuuggauggaggacaagacacccgucaccacgugggagaaugugccguaccuuggcaaacgcgaagaucaguggugugggucccugauuggccucaccagccgggcgacaugggcucagaacaucccuaccgccauucagcaaguuagaucucugaucggaaaugaggaauuccuugacuacaugcccagcaugaagcgcuuucggaaagaggaggaauccgagggcgccauuugguga

SEQ ID NO: 20363 - RNA, 9873 nt, Artificial Sequence
  derived and/or modified CDS sequence (opt5) from DENV-3__JX669492__SS-prME
accagcuucugccugaugaugauccuccccgccgcucuggccuuucaccuuacauccagagacggcgagccucggaugauuguggggaagaacgaacgcggaaaaucucugcucuucaagacggcgagcggcaucaauauguguacccugauugcuauggaucuuggggagaugugcgacgauacagucaccuacaaauguccgcauaucacagaaguugagcccgaagacauugauugcugguguaaccugaccuccacaugggugaccuauggaacgugcaaucaggccggcgagagacggcgcgacaagagaucuguggcccucgcuccucacgucgggaugggacuggauacccggacacaaaccuggaugagcgccgagggcgcuuggcgccagguggaaaaaguugagacaugggcccugagacaucccggcuuuaccauccucgcgcuguuccuugcccacuacaucgggacgucccugacacagaagguggucauuuuuauccuccugaugcuugugaccccuucuaugacaaugcgguguguuggagugggcaaccgcgacuucgucgaagggcugagcggagcuaccuggguggaugugguccucgagcauggcgggugcguuaccacaauggccaagaauaaacccacgcuggacauugagcugcagaagaccgaagcuacacaacucgccacccugagaaaacuuuguaucgagggaaagauuacaaacaucaccacggauucccggugcccuacacagggcgaagcggugcugccggaggaacaggaccagaauuauguguguaaacacaccuacgucgaucgcggcugggggaacggaugcggccucuuugggaagggaagccuggugaccugcgccaaguuccaaugucuugagcccauugagggcaaaguugugcaguaugaaaaucugaaguacacagucaucaucaccgugcacacaggggaccagcaucagguuggaaacgagacgcaaggcgugaccgcugaaauuacaccucaggccucuaccacagaggcuauccuccccgaauauggcacccuggggcuggagugcuccccuagaacgggacucgacuuuaaugagaugauucugcuuaccaugaaaaacaaggccuggaugguccaccggcagugguucuuugaucugccccucccguggacaagcggcgccaccacagaaaccccuacguggaaucgcaaagagcugcuugugacauucaagaacgcucaugcgaaaaagcaagaagucgugguucuggggucucaggagggagccaugcacaccgcucucacaggcgccaccgaaauccagaauuccgggggcaccagcauuuuugccggacaccugaaguguagacugaaaauggacaagcucgagcugaaaggcaugucuuacgcuaugugcacaaacacguucgugcuuaagaaagaggucuccgaaacccagcaugggacaauccugaucaagguggaguacaagggagaagaugcccccuguaaaauuccuuucagcaccgaggacggccaagggaaggcgcacaacggacggcucaucacagcuaaucccguugugaccaaaaaggaggaacccgucaacauugaggccgaaccuccguuuggcgaguccaauaucgugauugggaucggcgauaacgcccugaaaaucaauugguauaagaagggaucuagcauuggcaaaauguucgaagcuacggccagaggggcucgccggauggccauccugggagacacagcgugggauuuuggcuccguggggggaguucuuaacagccucggcaagaugguccaucagauuuucgggucugccuacaccgcucuguuuuccggcgugagcugggugaugaaaaucggaauuggcguccugcucaccuggaucgggcugaauucuaagaacacaagcauguccuucucuugcauugccaucggaaucauuacccuuuaucugggcgcugugguucaggccgacauggggugugugaucaauuggaaaggaaaggagcucaagugcggcagcgggauuuuugucacaaacgaggugcacacguggaccgaacaguacaaauuccaagcggauucccccaagagacuggccacagcuaucgccggcgcuugggagaauggaguuuguggcauucgcagcaccacacggauggaaaaccugcuuuggaaacagaucgccaaugagcucaacuauauccugugggaaaauaacauuaagcugaccguggucgugggggacaucauuggaguucucgagcagggcaaaagaacgcugaccccucagcccauggagcuuaaguacucuuggaaaacaugggggaaggccaagaucgugaccgcugaaacacaaaacuccagcuuuauuaucgauggaccuaauacccccgagugcccgucugcgucccgcgccuggaacgucugggaaguggaggacuauggcuucggcguguuuacaaccaauaucuggcugaaacuccgggaagucuacacgcagcugugugaccauagacugaugagcgcugccguuaaggaugagcgcgccgugcacgcugacaugggguacuggauugagucccagaaaaacggaucuuggaagcuugaaaaagccagccucaucgaggugaagacaugcaccuggccuaagucccacacccuguggucuaauggcguccuggaaagcgauaugauuauccccaaaucccucgcggggccuauuagccagcauaaccaccggcccggauaucauacacaaaccgcuggcccuuggcaccuggggaagcuugagcuggacuucaauuacugcgagggaacgacagugguuaucaccgaaaacuguggcacaagaggccccucucuccgcaccacaaccguguccgggaaacugauccacgaguggugcugucggagcugcacgcugccgccucuuagauauaugggagaagauggcuguugguacgggauggagauucggcccaucucugaaaaggaggagaauauggucaaaucccucgugagcgccggaucuggcaagguugacaacuuuaccaugggggugcugugccuggccauucucuucgaagaggucaugcgcggaaaguucggcaaaaagcauaugaucgcuggcguguuuuucacauuuguucugcuucugagcgggcagauuaccuggagagauauggcccacacacucaucaugauuggauccaaugcgagcgaccggaugggcaugggggugaccuaucuggcucugaucgccacguucaaaauccagcccuuucuugcccugggauucuuucucagaaagcugacaucucgcgaaaaccuccugcuuggcgucgggcuggcuauggccaccacacuccaacugccugaggauauugaacagauggcuaauggaaucgcccugggccuuauggcgcugaaacucauuacccaguucgagaccuaccagcuguggacagcccucaucucccugacguguagcaacaccauguuuacacuuaccguggcuuggcggacagccacccugauucucgcuggcgugucccugcugccggucugccaaucuagcuccaugagaaagacggacuggcuucccauggccguugccgcuaugggggugccuccccugccucucuucaucuuuucucugaaggauacacucaaacgcagaagcuggccccugaaugagggagugauggcggucggccuuguguccauccuggccucuagccugcuccggaacgacguuccuauggcugggccccugguggccggaggccuucugauugccuguuaugucaucaccgggaccuccgcugaucucacaguggaaaaggccgcggacauuaccugggaggaagaggcugaacagacaggaguuagccauaaccugaugaucacgguggacgaugacggcaccaugcgcauuaaagaugacgagacagagaauauccucaccguccugcuuaagacagcccugcugaucgugucuggcgucuucccguacuccauuccugccacccuccugguguggcacacguggcagaaacagacccaaagaagcgggguucuuugggaugugcccucuccucccgaaacacagaaggcugagcuggaagagggagucuaccggaucaaacagcagggcauuuuugggaagacccaagugggaguuggcgugcagaaggagggggucuuccauacaauguggcacgugacccgcggagccgugcucacauauaacggcaaaagacuggaaccgaauugggcguccguuaagaaagaccucaucagcuacggcgggggauggcggcugucugcucaguggcaaaagggcgaggaaguccaggugauugccguggagccugggaaaaaccccaagaauuuccagacgaugccuggaaccuuucagacaaccaccggcgaaaucggggccauugcucuugauuucaagcccggaacauccggcagccccaucaucaaccgcgagggcaaagucguggggcuguauggaaauggcguugugacgaagaacgggggauacgucuccggcauugcccaaaccaaugcugagccugacgggccgacacccgaacuggaggaagagauguuuaaaaagagaaaccucaccaucauggaucugcacccuggcagcggaaaaacacggaaguaucuucccgccauugugcgcgaagcgaucaagagacggcugagaacccucauucuggccccuacgcgcguuguggcugccgagauggaggaagcucucaaaggccugcccauccgguaccagacaaccgccaccaagucugagcauacagggagagaaaucgucgaccuuaugugccacgccaccuucacaaugcgccugcugagcccugugcggguuccgaauuauaaccucauuaucauggaugaggcucauuuuaccgaccccgcguccauugccgcuagaggauacaucucuacgcgcgugggcaugggggaagccgccgcuauuuucaugacagccaccccucccggaacagcggaugcuuuuccucagagcaaugcccccauccaggacgaggagcgggacaucccggaaagauccuggaacucuggcaaugaguggauuaccgauuucgccgggaaaacggucugguuugugccuagcaucaaggcuggcaacgacauugccaacugucugcgcaaaaauggaaagaaggugauccaacuuucccggaaaaccuucgauacagaauaccagaagaccaaacugaacgacugggauuuugucguuacaaccgacauuucugagaugggcgcgaauuucaaggccgauagagugaucgacccccggcgcugccucaaacccgugauucugacagaugggccugagagagucauccuggcuggacccaugccugugaccgccgcuagcgccgcucagcggcgcggcagaguugggcggaacccgcagaaggaaaaugaccaauauaucuucacgggacagccccucaacaaugaugaggaccacgcccauuggacagaagcgaagaugcuucuggacaacauuaauaccccugagggcaucauucccgcccuguuugaaccugagagagagaaauccgcugccaucgauggggaauaccgccucaagggcgagagccggaaaaccuucguggaacugaugagacgcggagaccuucccgucuggcuggcucacaagguggccucugagggcauuaaauauacagaucggaaguggugcuuugacgggcagagaaacaaucagauccucgaagagaacauggauguugagaucuggaccaaagaaggagagaagaagaaacugcgcccgcgguggcuggacgccagaacauacuccgauccucucgcucuuaaggaauucaaagacuuugcggccggccgcaagagcauugcucuggaucuggugacggagaucgggagaguccccucucaccucgcccaucggacccgcaaugcccuggacaaccuugugaugcugcacacauccgaacauggaggcagagcuuaucggcacgccgucgaggagcucccugaaaccauggagacacugcugcuccuuggccugaugauucugcucaccgggggagcgaugcuguuccuuaucagcggcaaagggauuggaaagacguccaucggccugaucugugugauugccucuagcgggaugcucuggauggcugaaaucccccugcaauggauugccuccgcuaucguucuggaguuuuucaugauggugcuccuuauuccugagcccgaaaagcagcgcaccccgcaggauaaucaacuggccuacguggucaucggaauucugacacucgcggccaucaucgcugccaacgagaugggccugcuugaaaccacaaaaagagaccugggcaugagcaaggagccugggguugugucucccaccuccuaucucgauguggaccugcaccccgcuagcgccuggacgcuguacgcugucgccacaaccgugauuacaccuaugcuccggcauaccaucgaaaauucuaccgcgaacguuagccuugccgcuauugccaaccaggcugugguccugaugggacuggacaaaggcuggccgaucuccaagauggaucucggggugccccugcuugcccugggaugcuacucucaggucaauccucucacacugacggccgcggugcugcuccuuauuacccacuaugcuaucaucggccccgggcugcaggccaaagcuacaagagaggcccaaaagcgcaccgccgcuggaauuaugaagaacccuacaguugacggcaucaugaccauugaucuggaccccgugaucuacgauagcaaauuugagaagcagcucggccaggucaugcugcuugugcugugugccguucagcuccugcugaugcggacguccugggcgcucugcgaagcccuuacacuggcuaccgggccuauuaccacacugugggagggaucuccgggcaaauucuggaauaccacaaucgccgugagcauggcuaacaucuuuagaggguccuaucucgccggagcgggccuggccuucagcauuaugaagucugucgggacgggaaaacgcggcaccggcucccaaggggaaacacuuggagagaaguggaagaaaaagcugaaucagcucagccggaaagaauuugaccuguacaagaaauccggcaucaccgagguggauagaacagaggcuaaggaagggcugaaacggggagagauuacccaucacgccgugucucgcggcagcgcuaagcuccagugguucguugaaagaaacauggucauccccgaggggcgggugauugaccuuggauguggccgcggcgggugguccuauuacugcgccggacugaagaaagugacggaagucagaggcuauaccaaggggggaccuggccaugaggagcccguuccuaugucuacauacggguggaauaucgugaaacugaugagcggaaaggauguguucuaccuccccccggaaaaaugugacacccugcuuugcgauauuggcgaguccagcccuucucccacagucgaagagucccggaccauccgcgugcugaagaugguugagcccuggcucaagaacaaucaguuuuguaucaaagugcugaacccuuauaugcccacagucauugaacaccuggagagacuccaacggaagcacggcgggaugcuugugcgcaauccucugagcagaaacucuacccaugaaauguacuggaucuccaauggaacgggcaacauuguugcuagcgugaauauggucucucggcugcuccugaacagauucacaaugacccaccgccggccgaccaucgagaaagacguggaucuuggggccggaacaagacaugugaacgcggaacccgagacgccuaauauggacgucauuggcgagcgcaucaagcggaucaaagaagagcacaacagcaccuggcacuaugacgaugaaaaucccuacaagacaugggccuaucauggguccuacgagguuaaggcuaccggaucugccagcuccaugauuaacggcguggugaaacugcucacaaagccuugggacgucgugcccaugguuacccagauggcuaugacagauaccacgccguuuggccagcaaagaguguucaaagaaaaggucgacacccgcacaccucggagcaugcccgggaccagacgcgugaugggaaucacagccgaguggcuguggcggacccugggcagaaauaaaaagccucgccucugcacgcgggaggaauuuacaaagaaaguuagaaccaacgccgcgaugggggcuguguucacagaggaaaaucagugggauuccgccaaggccgcugucgaggacgaagauuuuuggaaacugguggaccgcgagagagagcuucacaagcugggaaaauguggcucuugcguuuauaacaugauggggaagcgggaaaaaaagcucggcgaguucggaaaggccaaaggcagccgcgcuauuugguacauguggcugggggccagauaccuugaauuugaggcgcugggauuccucaaugaggaucauugguuuucccgggaaaacucuuauagcggcguggagggggaaggacugcacaagcugggcuacauccucagagacauuuccaaaauccccgggggcgccauguaugcugaugacaccgccggaugggacacgcggaucaccgaggaugaccugcauaaugaagagaagauuacacagcagauggauccugagcaccgccaacuugcuaacgccaucuucaaacugaccuaccagaauaaggucgugaagguccagagacccacaccgaccggcacagugauggacauuaucucucggaaagaucagcgcgggagcggacaaguuggcaccuaugggcucaacacguuuacaaauauggaagcgcagcugauuagacagauggagggagaaggcgugcuuuccaaggccgaccuggagaacccucaccuccccgaaaaaaagaucacccaguggcuggagaccaaaggggucgagcggcugaagcgcauggcuaucagcggcgaugacugcguggugaagcccauugaugacagauucgccaacgcucuccuggcccuuaaugauaugggaaaaguucggaaggacaucccucaauggcagccgucuaaaggcuggcaugauuggcagcaggugcccuucuguucccaccauuuucacgaacugauuaugaaggacgggcgcaaacucgucgugccuugcagaccccaagacgagcugaucggacgggcucgcauuagccagggcgccggguggucucuuagagaaacagcgugucugggaaaggccuacgcucagauguggucccucauguauuuccaccggcgcgaucugagacuggccagcaacgccaucugcucugcuguuccugugcauuggguccccaccucccggacaacguggagcauucacgcccaucaccaauggaugaccacagaggacaugcucaccguguggaauagagucuggaucgaagauaacccuuggauggaggacaagacacccgugaccacgugggagaauguuccguaccugggcaaacgcgaagaucaguggugugggucccuuaucggccugaccagccgggcgacaugggcucagaacauuccuaccgccauccagcaagugagaucucucauuggaaaugaggaauuucuggacuacaugcccagcaugaagcgcuuccggaaagaggaggaauccgagggcgccaucugguga

SEQ ID NO: 20364 - RNA, 9873 nt, Artificial Sequence
  derived and/or modified CDS sequence (opt5) from DENV-3__JX669500__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcucgccggauggccauccuuggagacacagcgugggauuucggcuccguggggggaguucucaacagccugggcaagaugguccaucagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcacacguggaccgaacaguacaaauuucaagcggauucccccaagagacuggccacagcuaucgccggcgcuugggagaauggaguuuguggcauucgcagcaccacacggauggaaaaccuucucuggaaacagaucgccaaugagcugaacuauauccugugggaaaauaacauuaagcucaccguggucgugggggacaucauuggaguucuggagcagggcaaaagaacgcuuaccccucagcccauggagcugaaguacucuuggaaaacaugggggaaggccaagaucgugaccgcugaaacacaaaacuccagcuucauuaucgauggaccuaauacccccgagugcccgucugcgucccgcgccuggaacgucugggaaguggaggacuauggcuuuggcguguucacaaccaauaucuggcucaaacugcgggaagucuacacgcagcugugugaccauagacuuaugagcgcugccguuaaggaugagcgcgccgugcacgcugacaugggguacuggauugagucccagaaaaacggaucuuggaagcucgaaaaagccagccugaucgaggugaagacaugcaccuggccuaagucccacacccuguggucuaauggcguccucgaaagcgauaugauuauccccaaaucccuggcggggccuauuagccagcauaaccaccggcccggauaucauacacaaaccgcuggcccuuggcaccuugggaagcuggagcucgacuuuaauuacugcgagggaacgacagugguuaucaccgaaaacuguggcacaagaggccccucucugcgcaccacaaccguguccgggaaacugauccacgaguggugcugucggagcugcacgcuuccgccucucagauauaugggagaagauggcuguugguacgggauggagauucggcccaucucugaaaaggaggagaauauggucaaaucccuggugagcgccggaucuggcaagguugacaacuucaccaugggggugcugugccucgccauucuguuugaagaggucaugcgcggaaaguucggcaaaaagcauaugaucgcuggcguguucuuuacauucguucuucugcucagcgggcagauuaccuggagagauauggcccacacacugaucaugauuggauccaaugcgagcgaccggaugggcaugggggugaccuaucuggcucuuaucgccacguuuaaaauccagcccuuccuggcccucggauuuuuccugagaaagcucacaucucgcgaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauguucacacugaccguggcuuggcggacagccacccucauucuggcuggcgugucccugcuuccggucugccaaucuagcuccaugagaaagacggacuggcugcccauggccguugccgcuaugggggugccuccccucccucuguuuaucuucucucucaaggauacacugaaacgcagaagcuggccccuuaaugagggagugauggcggucggccugguguccauccuggccucuagccuccugcggaacgacguuccuauggcugggccccuuguggccggaggccugcucauugccuguuaugucaucaccgggaccuccgcugaucugacaguggaaaaggccgcggacauuaccugggaggaagaggcugaacagacaggaguuagccauaaccucaugaucacgguggacgaugacggcaccaugcgcauuaaagaugacgagacagagaauauccugaccguccuucugaagacagcccugcucaucgugucuggcgucuuuccguacuccauuccugccacccugcuuguguggcacacguggcagaaacagacccaaagaagcgggguucugugggaugugcccucuccucccgaaacacagaaggcugagcucgaagagggagucuaccggaucaaacagcagggcauuuucgggaagacccaagugggaguuggcgugcagaaggagggggucuuucauacaauguggcacgugacccgcggagccgugcugacauauaacggcaaaagacucgaaccgaauugggcguccguuaagaaagaccugaucagcuacggcgggggauggcggcuuucugcucaguggcaaaagggcgaggaaguccaggugauugccguggagccugggaaaaaccccaagaauuuccagacgaugccuggaaccuuccagacaaccaccggcgaaaucggggccauugcucuggauuuuaagcccggaacauccggcagccccaucaucaaccgcgagggcaaagucguggggcuguauggaaauggcguugugacgaagaacgggggauacgucuccggcauugcccaaaccaaugcugagccugacgggccgacacccgaacucgaggaagagauguucaaaaagagaaaccugaccaucauggaucuucacccuggcagcggaaaaacacggaaguaucugcccgccauugugcgcgaagcgaucaagagacggcucagaacccugauucucgccccuacgcgcguuguggcugccgagauggaggaagcucugaaaggccuucccauccgguaccagacaaccgccaccaagucugagcauacagggagagaaaucgucgaccugaugugccacgccaccuuuacaaugcgccugcucagcccugugcggguuccgaauuauaaccugauuaucauggaugaggcucauuucaccgaccccgcguccauugccgcuagaggauacaucucuacgcgcgugggcaugggggaagccgccgcuauuuuuaugacagccaccccucccggaacagcggaugcuuucccucagagcaaugcccccauccaggacgaggagcgggacaucccggaaagauccuggaacucuggcaaugaguggauuaccgauuuugccgggaaaacggucugguucgugccuagcaucaaggcuggcaacgacauugccaacugucuucgcaaaaauggaaagaaggugauccaacugucccggaaaaccuuugauacagaauaccagaagaccaaacucaacgacugggauuucgucguuacaaccgacauuucugagaugggcgcgaauuuuaaggccgauagagugaucgacccccggcgcugccugaaacccgugauucugacagaugggccugagagagucauccucgcuggacccaugccugugaccgccgcuagcgccgcucagcggcgcggcagaguugggcggaacccgcagaaggaaaaugaccaauauaucuucacgggacagccccuuaacaaugaugaggaccacgcccauuggacagaagcgaagaugcugcuggacaacauuaauaccccugagggcaucauucccgcccucuucgaaccugagagagagaaauccgcugccaucgauggggaauaccgccugaagggcgagagccggaaaaccuuuguggaacuuaugagacgcggagaccugcccgucuggcucgcucacaagguggccucugagggcauuaaauauacagaucggaaguggugcuucgacgggcagagaaacaaucagauccuggaagagaacauggauguugagaucuggaccaaagaaggagagaagaagaaacugcgcccgcgguggcucgacgccagaacauacuccgauccucuugcucugaaggaauuuaaagacuucgcggccggccgcaagagcauugcucuggaucucgugacggagaucgggagaguccccucucaccuggcccaucggacccgcaaugcccuugacaaccuggugaugcuccacacauccgaacauggaggcagagcuuaucggcacgccgucgaggagcugccugaaaccauggagacacugcuccuucugggccugaugauucuccugaccgggggagcgaugcuuuuucugaucagcggcaaagggauuggaaagacguccaucggccucaucugugugauugccucuagcgggaugcuguggauggcugaaaucccccugcaauggauugccuccgcuaucguucucgaguucuuuaugauggugcuucugauuccugagcccgaaaagcagcgcaccccgcaggauaaucaacuggccuacguggucaucggaauucucacacuggcggccaucaucgcugccaacgagaugggccuucuggaaaccacaaaaagagaccucggcaugagcaaggagccugggguugugucucccaccuccuaucuggauguggaccugcaccccgcuagcgccuggacgcucuacgcugucgccacaaccgugauuacaccuaugcuucggcauaccaucgaaaauucuaccgcgaacguuagccuggccgcuauugccaaccaggcugugguccugaugggacucgacaaaggcuggccgaucuccaagauggaucugggggugccccuucuggcccucggaugcuacucucaggucaauccucugacacugacggccgcggugcuccuucugauuacccacuaugcuaucaucggccccgggcugcaggccaaagcuacaagagaggcccaaaagcgcaccgccgcuggaauuaugaagaacccuacaguugacggcaucaugaccauugaucucgaccccgugaucuacgauagcaaauucgagaagcagcugggccaggucaugcuucuggugcucugugccguucagcugcugcucaugcggacguccugggcgcuuugcgaagcccugacacuggcuaccgggccuauuaccacacucugggagggaucuccgggcaaauuuuggaauaccacaaucgccgugagcauggcuaacaucuucagaggguccuaucuggccggagcgggccuugccuuuagcauuaugaagucugucgggacgggaaaacgcggcaccggcucccaaggggaaacacugggagagaaguggaagaaaaagcucaaucagcugagccggaaagaauucgaccuguacaagaaauccggcaucaccgagguggauagaacagaggcuaaggaagggcucaaacggggagagauuacccaucacgccgugucucgcggcagcgcuaagcuucagugguuuguugaaagaaacauggucauccccgaggggcgggugauugaccugggauguggccgcggcgggugguccuauuacugcgccggacugaagaaagugacggaagucagaggcuauaccaaggggggaccuggccaugaggagcccguuccuaugucuacauacggguggaauaucgugaaacucaugagcggaaaggauguguucuaccugcccccggaaaaaugugacacccuucugugcgauauuggcgaguccagcccuucucccacagucgaagagucccggaccauccgcgugcucaagaugguugagcccuggcugaagaacaaucaguucuguaucaaagugcugaacccuuauaugcccacagucauugaacaccucgagagacuucaacggaagcacggcgggaugcuggugcgcaauccucugagcagaaacucuacccaugaaauguacuggaucuccaauggaacgggcaacauuguugcuagcgugaauauggucucucggcuccugcuuaacagauuuacaaugacccaccgccggccgaccaucgagaaagacguggaucugggggccggaacaagacaugugaacgcggaacccgagacgccuaauauggacgucauuggcgagcgcaucaagcggaucaaagaagagcacaacagcaccuggcacuaugacgaugaaaaucccuacaagacaugggccuaucauggguccuacgagguuaaggcuaccggaucugccagcuccaugauuaacggcguggugaaacuccugacaaagccuugggacgucgugcccaugguuacccagauggcuaugacagauaccacgccguucggccagcaaagaguguuuaaagaaaaggucgacacccgcacaccucggcccaugccugggaccagacgcgugaugggaaucacagccgaguggcuguggcggacccucggcagaaauaaaaagccccgccugugcacgcgggaggaauucacaaagaaaguuagaaccaacgccgcgaugggggcuguguuuacagaggaaaaucagugggauagcgccaaggccgcugucgaggacgaagauuucuggaaacuuguggaccgcgagagagagcugcacaagcucggaaaauguggcuccugcguuuauaacaugauggggaagcgggaaaaaaagcugggcgaguuuggaaaggccaaaggcucucgcgcuauuugguacauguggcuuggggccagauaccuggaauucgaggcgcucggauuucugaaugaggaucauugguucagccgggaaaacuccuauucuggcguggagggggaaggacugcacaagcucggcuacauccugagagacauuagcaaaaucccugggggcgccauguaugcugaugacaccgccggaugggacacgcggaucaccgaggaugaccuucauaaugaagagaagauuacacagcagauggaucccgagcaccgccaacuggcuaacgccaucuuuaaacucaccuaccagaauaaggucgugaagguccagagaccgacaccuaccggcacagugauggacauuaucucccggaaagaucagcgcgggucuggacaaguuggcaccuaugggcugaacacguucacaaauauggaagcgcagcuuauuagacagauggagggagaaggcgugcugagcaaggccgaccucgagaacccccaccugcccgaaaaaaagaucacccaguggcuggagaccaaaggggucgagcggcucaagcgcauggcuaucuccggcgaugacugcguggugaagccuauugaugacagauuugccaacgcucugcuugcccugaaugauaugggaaaaguucggaaggacaucccgcaauggcagcccagcaaaggcuggcaugauuggcagcaggugccuuucuguucucaccauuuccacgaacucauuaugaaggacgggcgcaaacuggucgugcccugcagaccucaagacgagcuuaucggacgggcucgcauuucccagggcgccggguggagccugagagaaacagcgugucucggaaaggccuacgcucagauguggucucugauguauuuucaccggcgcgaucugagacucgccuccaacgccaucugcagcgcuguucccgugcauugggucccuaccucucggacaacgugguccauucacgcccaucaccaauggaugaccacagaggacaugcugaccguguggaauagagucuggaucgaagauaaccccuggauggaggacaagacaccggugaccacgugggagaauguuccuuaccuuggcaaacgcgaagaucaguggugugggagccugaucggccucaccucccgggcgacaugggcucagaacauucccaccgccauccagcaagugagaagccugauuggaaaugaggaauuccuugacuacaugccuucuaugaagcgcuuucggaaagaggaggaaagcgagggcgccaucugguga

SEQ ID NO: 20365 - RNA, 9873 nt, Artificial Sequence
  derived and/or modified CDS sequence (opt5) from DENV-3__JX669497__SS-prME
accagccugugccucaugaugauccugcccgccgcucuugccuuccaccugacauccagagacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaaagacggcgcgacaagagaucuguggcccuggcuccucacgucgggaugggacuggauacccggacacagaccuggaugagcgccgaaggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacagcuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccaaaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggaucggcgauaacgccucuaaaaucaauugguauaagaagggaagcuccauuggcaaaauguuugaagcuacggccagaggggcucgccggauggccauccugggagacacagcgugggauuucggcagcgucgggggaguucuuaacucucucggcaagaugguccaucagauuuuuggguccgccuacaccgcucuguucagcggcgugucuugggugaugaaaaucggaauuggcguccugcucaccuggaucgggcugaauagcaagaacacauccaugucuuuuagcugcauugccaucggaaucauuacccuuuaucugggcgcugugguucaggccgacauggggugugugaucaauuggaaaggaaaggagcucaagugcggcuccgggauuuucgucacaaacgaggugcacacguggaccgaacaguacaaauuucaagcggauagccccaagagacuggccacagcuaucgccggcgcuugggagaauggaguuuguggcauucgcucuaccacacggauggaaaaccugcuuuggaaacagaucgccaaugagcucaacuauauccugugggaaaauaacauuaagcugaccguggucgugggggacaucauuggaguucucgagcagggcaaaagaacgcugaccccucagcccauggagcuuaaguacuccuggaaaacaugggggaaggccaagaucgugaccgcugaaacacaaaacagcucuuucauuaucgauggaccuaauacccccgagugcccguccgcgagccgcgccuggaacgucugggaaguggaggacuauggcuuuggcguguucacaaccaauaucuggcugaaacuccgggaagucuacacgcagcugugugaccauagacugauguccgcugccguuaaggaugagcgcgccgugcacgcugacaugggguacuggauugagucucagaaaaacggaagcuggaaacuugaaaaagccucccucaucgaggugaagacaugcaccuggccuaagucucacacccuguggagcaauggcguccuggaauccgauaugauuauccccaaaagccucgcggggccuauuucucagcauaaccaccggcccggauaucauacacaaaccgcuggcccuuggcaccuggggaaacuugagcuggacuuuaauuacugcgagggaacgacagugguuaucaccgaaaacuguggcacaagaggccccucccuccgcaccacaaccgugagcgggaaacugauccacgaguggugcugucggucuugcacgcugccgccucuuagauauaugggagaagauggcuguugguacgggauggagauucggcccaucuccgaaaaggaggagaauauggucaaaagccucgugucugccggaagcggcaagguugacaacuucaccaugggggugcugugccuggccauucucuuugaagaggucaugcgcggaaaguucggcaaaaagcauaugaucgcuggcguguucuuuacauucguucugcuucuguccgggcagauuaccuggagagauauggcccacacacucaucaugauuggaagcaaugcgucugaccggaugggcaugggggugaccuaucuggcucugaucgccacguuuaaaauccagcccuuccuugcccugggauuuuuccucagaaagcugacaucccgcgaaaaccuccugcuuggcgucgggcuggcuauggccaccacacuccaacugccugaggauauugaacagauggcuaauggaaucgcccugggccuuauggcgcugaaacucauuacccaguuugagaccuaccagcuguggacagcccucaucagccugacguguuccaacaccauguucacacuuaccguggcuuggcggacagccacccugauucucgcuggcgugucucugcugccggucugccaaagcuccucuaugagaaagacggacuggcuucccauggccguugccgcuaugggggugccuccccugccucucuuuaucuucagccugaaggauacacucaaacgcagauccuggccccugaaugagggagugauggcggucggccuugugucuauccuggccagcucccugcuccggaacgacguuccuauggcugggccccugguggccggaggccuucugauugccuguuaugucaucaccgggaccagcgcugaucucacaguggaaaaggccgcggacauuaccugggaggaagaggcugaacagacaggaguuucucauaaccugaugaucacgguggacgaugacggcaccaugcgcauuaaagaugacgagacagagaauauccucaccguccugcuuaagacagcccugcugaucguguccggcgucuuuccguacagcauuccugccacccuccugguguggcacacguggcagaaacagacccaaagaucugggguucuuugggaugugcccuccccucccgaaacacagaaggcugagcuggaagagggagucuaccggaucaaacagcagggcauuuucgggaagacccaagugggaguuggcgugcagaaggagggggucuuucauacaauguggcacgugacccgcggagccgugcucacauauaacggcaaaagacuggaaccgaauugggcgagcguuaagaaagaccucaucucuuacggcgggggauggcggcuguccgcucaguggcaaaagggcgaggaaguccaggugauugccguggagccugggaaaaaccccaagaauuuccagacgaugccuggaaccuuccagacaaccaccggcgaaaucggggccauugcucuugauuuuaagcccggaacaagcggcucccccaucaucaaccgcgagggcaaagucguggggcuguauggaaauggcguugugacgaagaacgggggauacgucagcggcauugcccaaaccaaugcugagccugacgggccgacacccgaacuggaggaagagauguucaaaaagagaaaccucaccaucauggaucugcacccuggcucuggaaaaacacggaaguaucuucccgccauugugcgcgaagcgaucaagagacggcugagaacccucauucuggccccuacgcgcguuguggcugccgagauggaggaagcucucaaaggccugcccauccgguaccagacaaccgccaccaagagcgagcauacagggagagaaaucgucgaccuuaugugccacgccaccuuuacaaugcgccugcuguccccugugcggguuccgaauuauaaccucauuaucauggaugaggcucauuucaccgaccccgcgucuauugccgcuagaggauacaucagcacgcgcgugggcaugggggaagccgccgcuauuuuuaugacagccaccccucccggaacagcggaugcuuucccucaguccaaugcccccauccaggacgaggagcgggacaucccggaaagaucuuggaacagcggcaaugaguggauuaccgauuuugccgggaaaacggucugguucgugccuuccaucaaggcuggcaacgacauugccaacugucugcgcaaaaauggaaagaaggugauccaacuuucucggaaaaccuuugauacagaauaccagaagaccaaacugaacgacugggauuucgucguuacaaccgacauuagcgagaugggcgcgaauuuuaaggccgauagagugaucgacccccggcgcugccucaaacccgugauucugacagaugggccugagagagucauccuggcuggacccaugccugugaccgccgcuuccgccgcucagcggcgcggcagaguugggcggaacccgcagaaggaaaaugaccaauauaucuucacgggacagccccucaacaaugaugaggaccacgcccauuggacagaagcgaagaugcuucuggacaacauuaauaccccugagggcaucauucccgcccuguucgaaccugagagagagaaaagcgcugccaucgauggggaauaccgccucaagggcgagucucggaaaaccuuuguggaacugaugagacgcggagaccuucccgucuggcuggcucacaagguggccuccgagggcauuaaauauacagaucggaaguggugcuucgacgggcagagaaacaaucagauccucgaagagaacauggauguugagaucuggaccaaagaaggagagaagaagaaacugcgcccgcgguggcuggacgccagaacauacagcgauccucucgcucuuaaggaauuuaaagacuucgcggccggccgcaagucuauugcucuggaucuggugacggagaucgggagaguccccucccaccucgcccaucggacccgcaaugcccuggacaaccuugugaugcugcacacaagcgaacauggaggcagagcuuaucggcacgccgucgaggagcucccugaaaccauggagacacugcugcuccuuggccugaugauucugcucaccgggggagcgaugcuguuucuuaucuccggcaaagggauuggaaagacgucuaucggccugaucugugugauugccagcuccgggaugcucuggauggcugaaaucccccugcaauggauugccagcgcuaucguucuggaguucuuuaugauggugcuccuuauuccugagcccgaaaagcagcgcaccccgcaggauaaucaacuggccuacguggucaucggcauucucacacucgcggccaucaucgcugccaacgagaugggacugcuugaaaccacaaaaagagaccugggcaugucuaaggagccugggguugugucccccaccagcuaucucgauguggaccugcaccccgcuucugccuggacgcuguacgcugucgccacaaccgugauuacaccuaugcuccggcauaccaucgaaaauagcaccgcgaacguuucccuugccgcuauugccaaccaggcugugguccugaugggacuggacaaaggcuggccgaucucuaagauggaucucggggugccccugcuugcccugggaugcuacagccaggucaauccucucacacugacggccgcggugcugcuccuuauuacccacuaugcuaucaucggccccgggcugcaggccaaagcuacaagagaggcccaaaagcgcaccgccgcuggaauuaugaagaacccuacaguugacggcaucaugaccauugaucuggaccccgugaucuacgauuccaaauucgagaagcagcucggccaggucaugcugcuugugcugugugccguucagcuccugcugaugcggacgucuugggcgcucugcgaagcccuuacacuggcuaccgggccuauuaccacacugugggagggaagcccgggcaaauuuuggaauaccacaaucgccguguccauggcuaacaucuucagagggagcuaucucgccggagcgggccuggccuuuucuauuaugaaguccgucgggacgggaaaacgcggcaccggcagccaaggggaaacacuuggagagaaguggaagaaaaagcugaaucagcucucccggaaagaguucgaccuguacaagaaaucuggcaucaccgagguggauagaacagaggcuaaggaagggcugaaacggggagagauuacccaucacgccgugagccgcggcuccgcuaagcuccagugguuuguugaaagaaacauggucauccccgaggggcgggugauugaccuuggauguggccgcggcggguggucuuauuacugcgccggacugaagaaagugacggaagucagaggcuauaccaaagggggaccuggccaugaggagcccguuccuaugagcacauacggguggaauaucgugaaacugauguccggaaaggauguguucuaccugcccccggaaaaaugugacacccugcuuugcgauauuggcgagagcucuccuucccccacagucgaagagagccggaccauccgcgugcugaagaugguugagcccuggcucaagaacaaucaguucuguaucaaagugcugaacccuuauaugcccacagucauugaacaccuggagagacuccaacggaagcacggcgggaugcuugugcgcaauccucugucuagaaacuccacccaugaaauguacuggaucagcaauggaacgggcaacauuguugcuucugugaauauggucagccggcugcuccugaacagauuuacaaugacccaccgccggccgaccaucgagaaagacguggaucuuggggccggaacaagacaugugaacgcggaacccgagacgccuaauauggacgucauuggcgagcgcaucaagcggaucaaagaagaacacaacuccaccuggcacuaugacgaugaaaaucccuacaagacaugggccuaucaugggucuuacgagguuaaggcuaccggaagcgccuccagcaugauuaacggcguggugaaacugcucacaaagccuugggacgucgugcccaugguuacccagauggcuaugacagauaccacgccguucggccagcaaagaguguuuaaagaaaaggucgacacccgcacaccucgguccaugcccgggaccagacgcgugaugggaaucacagccgaguggcuguggcggacccugggcagaaauaaaaagccucgccucugcacgcgggaggaguucacaaagaaaguuagaaccaacgccgcgaugggggcuguguuuacagaggaaaaucagugggauucugccaaggccgcugucgaggacgaagauuucuggaaacugguggaccgcgagagagagcuucacaagcugggaaaauguggcagcugcguuuauaacaugauggggaagcgggagaagaagcucggcgaguuuggaaaggccaaaggcucccgcgcuauuugguacauguggcugggggccagauaccuugaguucgaggcgcugggauuucucaaugaggaucauugguucucucgggaaaacagcuauuccggcguggagggggaaggacugcacaagcugggcuacauccucagagacauuucuaaaauccccgggggcgccauguaugcugaugacaccgccggaugggacacgcggaucaccgaggaugaccugcauaaugaagagaagauuacacagcagauggauccugagcaccgccaacuugcuaacgccaucuuuaaacugaccuaccagaauaaggucgugaagguccagagacccacaccgaccggcacagugauggacauuaucagccggaaagaucagcgcggguccggacaaguuggcaccuaugggcucaacacguucacaaauauggaagcgcagcugauuagacagauggagggagaaggcgugcuuagcaaggccgaccuggagaacccucaccuccccgagaagaagaucacccaguggcuggagaccaaaggggucgagcggcugaagcgcauggcuaucucuggcgaugacugcguggugaagcccauugaugacagauuugccaacgcucuccuggcccuuaaugauaugggaaaaguucggaaggacaucccucaauggcagccguccaaaggcuggcaugauuggcaacaggugcccuucuguagccaccauuuccacgaacugauuaugaaggacgggcgcaaacucgucgugccuugcagaccccaagacgagcugaucggacgggcucgcauuucucagggcgccggguggucccuuagagaaacagcgugucugggaaaggccuacgcucagauguggagccucauguauuuucaccggcgcgaucugagacuggccucuaacgccaucugcuccgcuguuccugugcauuggguccccaccagccggacaacgugguccauucacgcccaucaccaauggaugaccacagaggacaugcucaccguguggaauagagucuggaucgaagauaacccuuggauggaggacaagacacccgugaccacgugggagaauguuccguaccugggcaaacgcgaagaucaguggugugggagccuuaucggccugaccucucgggcgacaugggcucagaacauuccuaccgccauccagcaagugagaagccucauuggaaaugaggaguuccuggacuacaugcccuccaugaagcgcuuucggaaagaggaggaaucugagggcgccaucugguga

SEQ ID NO: 20366 - RNA, 9873 nt, Artificial Sequence
  derived and/or modified CDS sequence (opt5) from DENV-3__JX669501__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguggggggaguucucaacagccugggcaaaaugguccaucagauuuuugggucugccuacaccgcucuguucuccggcgugagcugggugaugaagaucggaauuggcguccuccugaccuggaucgggcuuaauucuaaaaacacaagcauguccuuuucuugcauugccaucggaaucauuacccuguaucucggcgcugugguucaggccgacaugggguguguggucaauuggaagggaaaagagcugaagugcggcagcgggaucuucgugacaaacgagguucacacguggaccgaacaguacaaguuucaagcggauucccccaaacgccuggccacagcuauugccggcgcuugggagaauggaguguguggcauccggagcaccacaagaauggaaaaccuucucuggaagcagauugccaaugagcugaacuauauccugugggaaaauaacaucaaacucaccgucgugguuggggacauuaucggagugcuggagcagggcaagcgcacgcuuaccccucagcccauggagcugaaauacucuuggaagacaugggggaaagccaagauugucaccgcugaaacacaaaacuccagcuucaucauugauggaccuaauacccccgagugcccgucugcgucccgggccuggaacgugugggaaguggaggacuauggcuuuggcgucuucacaaccaauaucuggcucaagcugagagaaguuuacacgcagcugugugaccaucgccuuaugagcgcugccgugaaagaugagcgggccgugcacgcugacaugggguacuggaucgagucccagaagaacggaucuuggaaacucgaaaaggccagccugauugaggucaaaacaugcaccuggccuaagucccacacccuguggucuaauggcgugcucgaaagcgauaugaucauucccaagucccuggcggggccuaucagccagcauaaccacagacccggauaucauacacaaaccgcuggcccuuggcaccuugggaaacuggagcucgacuuuaauuacugcgagggaacgacaguugugauuaccgaaaacuguggcacacgcggccccucucugcggaccacaaccgucuccgggaagcugauccacgaguggugcuguagaagcugcacgcuuccgccucuccgguauaugggagaagauggcuguugguacgggauggagauccgccccauuucugaaaaagaggagaauauggugaagucccugguuagcgccggaucuggcaaaguggacaacuucaccauggggguccugugccucgccauccuguuugaagaggugaugagaggaaaguucggcaagaaacauaugauugcuggcguuuucuuuacauucgugcuucugcucagcgggcagaucaccuggcgggauauggcccacacacugaccaugauuggauccaaugcgagcgacagaaugggcaugggggucacguaucuggcucuuaucgccacauuuaagauucagcccuuccuggcccucggauuuuuccugcgcaaacucaccucucgggaaaaccugcuucugggcguggggcucgcuauggccacaacccugcaacugccugaggauaucgaacagauggcuaauggaaucgcccuuggccugauggcgcucaagcugauuacccaguuugagacauaccagcucuggacggcccugaucucccuuaccuguagcaacacaauguucacccugacaguggcuuggagaaccgccacgcucauucuggcuggcgucucccugcuuccgguuugccaaucuagcuccaugcgcaaaacagacuggcugcccauggccguggccgcuaugggggugccuccccucccucuguuuaucuucucucucaaggauacccugaagagacggagcuggccccuuaaugagggagucauggcggugggccugguuuccauucuggccucuagccuccugcgcaacgacgugccuauggcugggccccuugucgccggaggccugcucaucgccuguuaugugaucaccgggacauccgcugaucugaccguugaaaaagccgcggacauuacaugggaggaagaggcugaacagacgggagugagccauaaccucaugaucaccgucgacgaugacggcacaaugagaauuaaggaugacgagaccgagaauauccugacagugcuucugaaaaccgcccugcucauugucucuggcguguuuccguacuccaucccugccacgcugcuuguuuggcacaccuggcagaagcagacacaacggagcggggugcugugggauguccccucuccucccgaaacccagaaagcugagcucgaagagggaguguaccgcaucaagcagcagggcauuuucgggaaaacacaaguuggagugggcguccagaaggaggggguguuucauaccauguggcacgugacaagaggagccguucugacguauaacggcaagcggcucgaaccgaauugggcguccgucaaaaaggaccugaucagcuacggcgggggauggcgccuuucugcucaguggcaaaaaggcgaggaagugcaggugauugccgucgagccugggaagaaccccaaaaauuuccagaccaugccuggaacauuccagaccaccacaggcgaaaucggggccauugcucuggauuuuaagcccggaacguccggcagccccaucauuaacagagagggcaaggugguugggcuguauggaaauggcguggucaccaaaaacgggggauacguguccggcaucgcccaaacaaaugcugagccugacgggccgacccccgaacucgaggaagagauguucaagaaacggaaccugacaaucauggaucuucacccuggcagcggaaagacccgcaaauaucugcccgccauuguuagagaagcgaucaagcggagacuccgcacgcugauucucgccccuacacggguggucgcugccgagauggaggaagcucugaagggccuucccaucagauaccagaccaccgccacaaaaucugagcauaccgggcgcgaaauuguggaccugaugugccacgccacauuuaccaugcggcugcucagcccuguuagagugccgaauuauaaccugaucaucauggaugaggcucauuucacggaccccgcguccauugccgcucgcggauacaucucuacacgggucggcaugggggaagccgccgcuauuuuuaugaccgccacaccucccggaaccgcggaugcuuucccucagagcaaugcccccauccaggacgaggagagagacauuccggaacgcuccuggaacucuggcaaugaguggaucacggauuuugccgggaagaccgugugguucgugccuagcaucaaagcuggcaacgacauugccaacugucuucggaagaauggaaaaaaggucauccaacuguccagaaagacauuugauaccgaauaccagaaaacaaagcucaacgacugggauuucguugugaccacagacauuucugagaugggcgcgaauuuuaaagccgaucgggugaucgacccccgcagaugccugaagcccgucauucugaccgaugggccugagcgggugauccucgcuggacccaugccuguuacggccgcuagcgccgcucagcgcagaggccggguggggagaaacccgcagaaagaaaaugaccaauauauuuucacaggacagccccuuaacaaugaugaggaccacgcccauuggaccgaagcgaagaugcugcuggacaacaucaauaccccugagggcaucauucccgcccucuucgaaccugagcgcgagaaguccgcugccaucgauggggaauaccggcugaaaggcgagagcagaaagacauuugucgaacuuaugcgccggggagaccugcccguguggcucgcucacaaaguugccucugagggcauuaaguauaccgauagaaaauggugcuucgacgggcagcgcaacaaucagauccuggaagagaacauggauguggagauuuggacaaaggaaggagagaaaaagaagcugcggccgagauggcucgacgcccgcacguacuccgauccucuugcucugaaagaauuuaaggacuucgcggccggcagaaaaagcaucgcucuggaucucgucaccgagaucgggcgggugcccucucaccuggcccaucgcacaagaaaugcccuugacaaccuggucaugcuccacaccuccgaacauggaggccgggcuuaucgccacgccauggaggagcugccugaaacaauggagacccugcuccuucugggccugaugauucuccugacggggggagcgaugcuuuuucugaucagcggcaaggggauuggaaaaaccuccaucggccucauuugugugaucgccucuagcgggaugcuguggauggcugaaaucccccugcaauggauugccuccgcuaucguucucgaguucuuuaugauggugcuucugauuccugagcccgaaaagcagagaacaccgcaggauaaucaacuggccuacguggucaucggaauucucacccuggcggccaucauugcugccaacgagaugggccuucuggaaacaaccaagcgggaccucggcaugagcaaagagccugggguugugucucccacguccuaucuggauguggaccugcaccccgcuagcgccuggacacucuacgcugucgccaccacagugaucaccccuaugcuuagacauaccaucgaaaauucuacagcgaacguuagccuggccgcuauugccaaccaggcugugguccugaugggacucgacaagggcuggccgaucuccaaaauggaucugggggugccccuucuggcccucggaugcuacucucaggucaauccucugacgcugaccgccgcggugcuccuucugauuacacacuaugcuaucauuggccccgggcugcaggccaaggcuacccgcgaggcccaaaaacggacagccgcuggaaucaugaagaacccuaccguugacggcaucaugacgauugaucucgaccccgugauguacgauagcaaguucgagaaacagcugggccaggucaugcuucuggugcucugugccguucagcugcugcucaugagaacauccugggcgcuuugcgaagcccugacccuggcuaccgggccuaucacaacccucugggagggaucuccgggcaaguuuuggaauacaacgauugccgugagcauggcuaacaucuuccgcggguccuaucuggccggagcgggccuugccuuuagcauuaugaaaucugucgggaccggaaagcggggcacaggcucccaaggggaaacccugggagagaaauggaagaagaaacucaaucagcugagcagaaaggaauucgaccuguacaaaaaguccggcaucacagagguggaucggaccgaggcuaaagaagggcucaagcgcggagagaucacgcaucacgccgugucuagaggcagcgcuaaacuucagugguuuguugaacggaacauggucauucccgaggggcgcgugaucgaccugggauguggcagaggcgggugguccuauuacugcgccggacugaagaaggugaccgaaguccggggcuauacaaaagggggaccuggccaugaggagcccguuccuaugucuaccuacggguggaauauugugaagcucaugagcggaaaagauguguucuaccugcccccggaaaagugugacacacuucugugcgauaucggcgaguccagcccuucucccaccgucgaagagucccgcacaauuagagugcucaaaaugguugagcccuggcugaagaacaaucaguucuguaucaaggugcugaacccuuauaugcccaccgucauugaacaccucgagcggcuucaacgcaaacacggcgggaugcuggugagaaauccucugagccggaacucuacgcaugaaauguacuggaucuccaauggaacaggcaacaucguugcuagcgugaauauggucucuagacuccugcuuaaccgcuuuaccaugacccaccggagaccgacaauugagaaggacguggaucugggggccggaacgcgccaugugaacgcggaacccgagaccccuaauauggacgucaucggcgagcggauuaaaagaaucaaggaagagcacaacagcacauggcacuaugacgaugaaaaucccuacaaaaccugggccuaucauggguccuacgagguuaaggcuacaggaucugccagcuccaugauuaacggcguggugaagcuccugaccaaaccuugggacgucgugcccaugguuacacagauggcuaugaccgauacgaccccguucggccagcaacgcguguuuaaggaaaaagucgacacacggaccccuagaagcaugcccgggacacgccgggugaugggaaucaccgccgaguggcuguggagaacgcucggccgcaauaagaaaccucggcugugcacaagagaggaauucaccaagaagguucgcacaaacgccgcgaugggggcuguguuuaccgaggaaaaucagugggauuccgccaaagccgcugucgaggacgaagauuucuggaagcuuguggacagagagcgggagcugcacaaacucggaaaguguggcucuugcguuuauaacaugauggggaaacgcgaaaagaaacugggcgaguuuggaaaggccaagggcagcagagcuaucugguacauguggcuuggggcccgguaccuggaauucgaggcgcucggauuucugaaugaggaucauugguucuccagagaaaacucuuauagcggcguggagggggaaggacugcacaaacucggcuacauucugcgggacaucuccaagauucccgggggcgccauguaugcugaugacacggccggaugggacacccgcaucacagaggaugaccuucauaaugaagagaaaauuacccagcagauggauccugagcacagacaacuggcuaacgccaucuuuaagcucacauaccagaauaaagucgugaagguccagcggcccaccccgacaggcaccgugauggacaucauuucucgcaaggaucagagagggagcggacaaguuggcacguaugggcugaacacauucaccaauauggaagcgcagcuuauccggcagauggagggagaaggcgugcuguccaaagccgaccucgagaacccucaccugcccgaaaagaaaauuacccaguggcuggagacaaagggggucgagcgccucaaaagaauggcuaucagcggcgaugacugcguggugaagcccauugaugaccgguuugccaacgcucugcuugcccugaaugauaugggaaagguucgcaaagacaucccucaauggcagccgucuaagggcuggcaugauuggcagcaggugcccuucuguucccaccauuuccacgaacucaucaugaaagacgggagaaagcuggucgugccuugccggccccaagacgagcuuauuggacgcgcuagaaucagccagggcgccggguggucucugcgggaaaccgcgugucucggaaaagccuacgcucagauguggucccugauguauuuucaccgcagagaucugcggcucgccagcaacgccauuugcucugcuguuccugugcauuggguccccacauccagaacgaccuggagcauccacgcccaucaccaauggaugacaaccgaggacaugcugacaguguggaaucgcgucuggauugaagauaacccuuggauggaggacaagacccccgugacgaccugggagaauguuccguaccuuggcaagcgggaagaucaguggugugggucccugaucggccucacaagcagagcgaccugggcucagaacauuccuacagccauccagcaagugcgcucucugaucggaaaugaggaauuccuugacuacaugcccagcaugaaacgguuuagaaaggaggaggaauccgagggcgccauuugguga

SEQ ID NO: 20367 - RNA, 9873 nt, Artificial Sequence
  derived and/or modified CDS sequence (opt5) from DENV-3__JX669494__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaccaauauguguacacuuaucgcuauggaucugggggagaugugcgacgauaccgucacauacaaauguccgcauauuaccgaaguugagcccgaagacaucgauugcugguguaaccucacauccaccugggugacguauggaaccugcaaucaggccggcgagagacggcgcgacaagagaucuguggcccuggcuccucacgucgggaugggacuggauacacggacccaaacauggaugagcgccgagggcgcuuggcgccagguggaaaaaguugagaccugggcccucagacaucccggcuucacgauucuggcgcuuuuucuggcccacuacaucgggacaucccucacccagaagguggucaucuucauucugcuuaugcuggugacaccuucuaugaccaugcgguguguuggagugggcaaccgcgacuuugucgaagggcucagcggagcuaccuggguggaugugguccuggagcauggcgggugcguuacaacgauggccaagaauaaacccacccuggacaucgagcuccagaagacagaagcuacccaacuggccacacuuagaaaacuguguauugagggaaagaucaccaacauuacgacagauucccggugcccuacccagggcgaagcggugcucccggaggaacaggaccagaauuauguguguaaacacaccuacgucgaucgcggcugggggaacggaugcggccuguucgggaagggaagccuugugacaugcgccaaguuucaaugucuggagcccaucgagggcaaaguugugcaguaugaaaaucucaaguacaccgucauuaucacagugcacacgggggaccagcaucagguuggaaacgagacccaaggcgugacagcugaaaucaccccucaggccucuacaaccgaggcuauucugcccgaauauggcacgcuggggcucgagugcuccccuagaaccggacuggacuucaaugagaugauccuucugacaaugaaaaacaaggccuggaugguccaccggcagugguuuuucgaucucccccugccguggaccagcggcgccacaaccgaaacgccuacauggaaucgcaaagagcuucuggugaccuuuaagaacgcucaugcgaaaaagcaagaagucgugguucucgggucucaggagggagccaugcacacagcucugaccggcgccaccgaaauucagaauuccgggggcacaagcaucuucgccggacaccugaaguguagacucaaaauggacaagcuggagcuuaaaggcaugucuuacgcuaugugcacgaacaccuuugugcugaagaaagaggucuccgaaacacagcaugggaccauucucaucaagguggaguaccggggagaagaugcccccuguaagaucccuuucagcacagaggacggccaagggaaagcgcacaacggaagacugauuaccgcuaaucccguugugacgaagaaagaggaacccgucaacaucgaggccgaaccuccguucggcgaguccaauauugugaucgggauuggcgauaacgcccugaagaucaauugguauaaaaagggaucuagcaucggcaagauguuugaagcuacagcccgcggggcucggagaauggccauucuuggagacaccgcgugggauuucggcuccguggggggaguucucaacagccugggcaaaaugguccaucagaucuuugggucugccuacaccgcucuguucuccggcgugagcugggugaugaagauuggaaucggcguccuccugacauggauugggcuuaauucuaaaaacaccagcauguccuuuucuugcaucgccauuggaaucaucacacuguaucucggcgcugugguucaggccgacauggggugugugauuaauuggaagggaaaagagcugaagugcggcagcgggaucuucgucacgaacgaggugcacaccuggacagaacaguacaaguuucaagcggauucccccaaacgccuggccaccgcuauugccggcgcuugggagaauggaguuuguggcauccggagcacaaccagaauggaaaaccuucucuggaagcagauugccaaugagcugaacuauauccugugggaaaauaacaucaaacucacgguggucgugggggacauuaucggaguucuggagcagggcaagcgcacccuuacaccucagcccauggagcugaaauacucuuggaagaccugggggaaagccaagauugugacagcugaaacccaaaacuccagcuucaucauugauggaccuaauacacccgagugcccgucugcgucccgggccuggaacgucugggaaguggaggacuauggcuuuggcguguucaccacgaauaucuggcucaagcugagagaagucuacacacagcugugugaccaucgccuuaugagcgcugccguuaaagaugagcgggccgugcacgcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccacagacccggauaucauacccaaacggcuggcccuuggcaccuugggaaacuggagcucgacuuuaauuacugcgagggaacaaccgugguuauuacagaaaacuguggcacccgcggccccucucugcggacaaccacgguguccgggaagcugauccacgaguggugcuguagaagcugcacccuuccgccucuccgguauaugggagaagauggcuguugguacgggauggagauccgccccauuucugaaaaagaggagaauauggucaagucccuggugagcgccggaucuggcaaaguugacaacuucacaaugggggugcugugccucgccauccuguuugaagaggucaugagaggaaaguucggcaagaaacauaugauugcuggcgugcuuuucaccuuuguucugcuccugagcgggcagaucacauggcgggauauggcccacacccugauuaugaucggauccaaugcgagcgacagaaugggcaugggggugacguaucuugcucugauugccacauucaagauccagcccuuucucgcccugggauucuuucuccgcaaacugaccucucgggaaaaccuucugcucggcgucgggcuggcuauggccacaacccugcaacuuccugaggauaucgaacagauggcuaauggaauugcccugggccucauggcgcugaagcucaucacccaguucgagacauaccagcuguggacggcccuuauuucccugaccuguagcaacacaauguuuacccucacaguggcuuggagaaccgccacgcugauccuggcuggcgugucccuucugccggucugccaaucuagcuccaugcgcaaaacagacuggcuccccauggccguugccgcuaugggggugccuccccugccucucuucauuuuuucucugaaggauacccuuaagagacggagcuggccccugaaugagggagugauggcggucggccugguguccauccucgccucuagccugcuucgcaacgacguuccuauggcugggccccugguggccggaggccuccugaucgccuguuaugucauuaccgggacauccgcugaucucaccguggaaaaagccgcggacaucacaugggaggaagaggcugaacagacgggaguuagccauaaccugaugauuaccguggacgaugacggcacaaugagaaucaaggaugacgagaccgagaauauucuuacaguccugcugaaaaccgcccuccugaucgugucuggcgucuucccguacuccaucccugccacgcuucugguguggcacaccuggcagaagcagacacaacggagcgggguucucugggaugugcccucuccucccgaaacccagaaagcugagcuggaagagggagucuaccgcauuaagcagcagggcaucuuugggaaaacacaagugggaguuggcgugcagaaggagggggucuuccauaccauguggcacgugacaagaggagccgugcucacguauaacggcaagcggcuggaaccgaauugggcguccguuaaaaaggaccuuauuagcuacggcgggggauggcgccugucugcucaguggcaaaaaggcgaggaaguccaggugaucgccguggagccugggaagaaccccaaaaauuuucagaccaugccuggaacauuccagaccaccacaggcgaaauuggggccaucgcucuggauuucaagcccggaacguccggcagccccauuaucaacagagagggcaaggucguggggcucuauggaaauggcguugugaccaaaaacgggggauacgucuccggcaucgcccaaacaaaugcugagccugacgggccgacccccgaacuggaggaagagauguuuaagaaacggaaccuuacaauuauggaucugcacccuggcagcggaaagacccgcaaauaucuccccgccaucgugagagaagcgauuaagcggagacugcgcacgcucauccuggccccuacacggguuguggcugccgagauggaggaagcucuuaagggccugcccauuagauaccagaccaccgccacaaaaucugagcauaccgggcgcgaaaucgucgaccugaugugccacgccacauucaccaugcggcuccugagcccugugagaguuccgaauuauaaccuuaucauuauggaugaggcucauuuuacggaccccgcguccaucgccgcucgcggauacauuucuacacgggugggcaugggggaagccgccgcuaucuucaugaccgccacaccucccggaaccgcggaugcuuuuccucagagcaaugcccccauucaggacgaggagagagacaucccggaacgcuccuggaacucuggcaaugaguggaucacggauuucgccgggaagaccgucugguuugugccuagcauuaaagcuggcaacgacaucgccaacugucugcggaagaauggaaaaaaggugauucaacucuccagaaagacauucgauaccgaauaccagaaaacaaagcugaacgacugggauuuugucguuaccacagacaucucugagaugggcgcgaauuucaaagccgaucgggugauugacccccgcagaugccugaagcccgugauccucaccgaugggccugagcgggucauucuugcuggacccaugccugugacggccgcuagcgccgcucagcgcagaggccggguugggagaaacccgcagaaagaaaaugaccaauauaucuuuacaggacagccccugaacaaugaugaggaccacgcccauuggaccgaagcgaagaugcugcucgacaacaucaauaccccugagggcauuauccccgcccuguucgaaccugagcgcgagaaguccgcugccauugauggggaauaccggcuuaaaggcgagagcagaaagacauucguggaacugaugcgccggggagaccuccccgucuggcuggcucacaaaguggccucugagggcaucaaguauaccgauagaaaauggugcuuugacgggcagcgcaacaaucagauucuggaagagaacauggauguugagaucuggacaaaggaaggagagaaaaagaagcuccggccgagauggcuugacgcccgcacguacuccgauccucuggcucugaaagaauucaaggacuuugcggccggcagaaaaagcaucgcucucgaucuggugaccgagauugggcggguccccucucaccuugcccaucgcacaagaaaugcccuggacaaccucgugaugcugcacaccuccgaacauggaggccgggcuuaucgccacgccgucgaggagcugccugaaacaauggagacccuccuucugcugggccucaugauccugcuuacggggggagcgaugcuguuccucauuagcggcaaggggaucggaaaaaccuccauuggccugaucugugugaucgccucuagcgggaugcuguggauggcugaaauuccccuccaauggaucgccuccgcuauuguucuugaguuuuucaugauggugcugcugaucccugagcccgaaaagcagagaacaccgcaggauaaucaacucgccuacguggucauuggaauccugacccuugcggccauuaucgcugccaacgagaugggccugcucgaaacaaccaagcgggaccugggcaugagcaaagagccugggguugugucucccacguccuaucuggauguggaccuccaccccgcuagcgccuggacacuuuacgcugucgccaccacagugaucaccccuaugcugagacauaccauugaaaauucuacagcgaacguuagccuggccgcuaucgccaaccaggcugugguccucaugggacuggacaagggcuggccgauuuccaaaauggaucuuggggugccccugcucgcccugggaugcuacucucaggucaauccucugacgcucaccgccgcggugcuucugcugaucacacacuaugcuauuaucggccccgggcuccaggccaaggcuacccgcgaggcccaaaaacggacagccgcuggaaucaugaagaacccuaccguugacggcauuaugacgaucgaucuggaccccgugauuuacgauagcaaguuugagaaacagcuuggccaggucaugcugcucgugcugugugccguucagcugcuccuuaugagaacauccugggcgcugugcgaagcccugacccucgcuaccgggccuaucacaacccugugggagggaucuccgggcaaguucuggaauacaacgauugccgugagcauggcuaacaucuuucgcggguccuaucuugccggagcgggccuggccuucagcaucaugaaaucugucgggaccggaaagcggggcacaggcucccaaggggaaacccucggagagaaauggaagaagaaacugaaucagcugagcagaaaggaauuugaccucuacaaaaaguccggcauuacagagguggaucggaccgaggcuaaagaagggcuuaagcgcggagagaucacgcaucacgccgugucuagaggcagcgcuaaacugcagugguucguugaacggaacauggucauucccgaggggcgcgugaucgaccugggauguggcagaggcgggugguccuauuacugcgccggacucaagaaggugaccgaaguccggggcuauacaaaagggggaccuggccaugaggagcccguuccuaugucuaccuacggguggaauauugugaagcugaugagcggaaaagauguguuuuaccuucccccggaaaagugugacacacugcucugcgauaucggcgaguccagcccuucucccaccgucgaagagucccgcacaauuagagugcugaaaaugguugagcccuggcugaagaacaaucaguucuguaucaaggugcucaacccuuauaugcccaccgucaucgaacaccuugagcggcugcaacgcaaacacggcgggaugcuggugagaaauccucucagccggaacucuacgcaugaaauguacuggauuuccaauggaacaggcaacaucguugcuagcgugaauaccgucucuagacugcuucugaaccgcuucaccaugacacaccggagaccgacgaccgagaaggacguggaucucggggccggaacacgccaugugaacgcggaacccgagaccccuaauauggacgucauuggcgagcggaucaaaagaauuaaggaagagcacaacagcacauggcacuaugacgaugaaaaucccuacaaaaccugggccuaucauggguccuacgagguuaaggcuacaggaucugccagcuccaugaucaacggcguggugaagcugcugaccaaaccuugggacgucgugcccaugguuacgcagauggcuaugaccgauacaaccccguuuggccagcaacgcguguucaaggaaaaagucgacacacggaccccuagaagcaugcccgggacgcgccgggugaugggaaucacagccgaguggcucuggagaacccugggccgcaauaagaaaccucggcuuugcacaagagaggaauuuaccaagaagguucgcacgaacgccgcgaugggggcuguguucaccgaggaaaaucagugggauuccgccaaagccgcugucgaggacgaagauuuuuggaagcugguggacagagagcgggagcuccacaaacugggaaaguguggcucuugcguuuauaacaugauggggaaacgcgaaaagaaacuuggcgaguucggaaaggccaagggcagcagagcuauuugguacauguggcugggggcccgguaccucgaauuugaggcgcugggauuccugaaugaggaucauugguuuuccagagaaaacucuuauagcggcguggagggggaaggacuccacaaacugggcuacauccuucgggacauuuccaagauccccgggggcgccauguaugcugaugacacagccggaugggacacccgcauuacagaggaugaccugcauaaugaagagaaaaucacccagcagauggauccugagcacagacaacucgcuaacgccaucuucaagcugacauaccagaauaaagucgugaagguccagcggcccaccccgacgggcacagugauggacauuaucucucgcaaggaucagagagggagcggacaaguuggcaccuaugggcuuaacaccuuuacaaauauggaagcgcagcugauucggcagauggagggagaaggcgugcucuccaaagccgaccuggagaacccucaccugcccgaaaagaaaaucacccaguggcucgagacaaagggggucgagcgccugaaaagaauggcuauuagcggcgaugacugcguggugaagcccaucgaugaccgguucgccaacgcucuucuggcccucaaugauaugggaaagguucgcaaagacaucccucaauggcagccgucuaagggcuggcaugauuggcagcaggugcccuuuuguucccaccauuuccacgaacugauuaugaaagacgggagaaagcuugucgugccuugccggccccaagacgagcugaucggacgcgcuagaauuagccagggcgccggguggucucuccgggaaacggcgugucugggaaaagccuacgcucagauguggucccugauguauuuccaccgcagagaucuccggcuggccagcaacgccaucugcucugcuguuccugugcauuggguccccaccuccagaacaaccuggagcauucacgcccaucaccaauggaugacaaccgaggacaugcuuacgguguggaaucgcgucuggaucgaagauaacccuuggauggaggacaagacccccgugacaaccugggagaauguuccguaccugggcaagcgggaagaucaguggugugggucccucauuggccugacaagcagagcgaccugggcucagaacaucccuacggccauccagcaagugcgcucucuuauuggaaaugaggaauuucuggacuacaugcccagcaugaaacgguucagaaaggaggaggaauccgagggcgccaucugguga

SEQ ID NO: 20368 - RNA, 9873 nt, Artificial Sequence
  derived and/or modified CDS sequence (opt5) from DENV-3__JX669503__SS-prME
accagcuucugccugaugaugauccuccccgccgcucuggccuuucaccuuacauccagagacggcgagccucggaugauuguggggaagaacgaacgcggaaaaucucugcucuucaagacggcgagcggcaucaauauguguacccugauugcuauggaucuuggggagaugugcgacgauacagucaccuacaaauguccgcauaucacagaaguugagcccgaagacauugauugcugguguaaccugaccuccacaugggugaccuauggaacgugcaaucaggccggcgagagacggcgcgacaagagaucuguggcccucgcuccucacgucgggaugggacuggauacccggacacaaaccuggaugagcgccgagggcgcuuggcgccagguggaaaaaguugagacaugggcccugagacaucccggcuuuaccauccucgcgcuguuccuugcccacuacaucgggacgucccugacacagaagguggucauuuuuauccuccugaugcuugugaccccuucuaugacaaugcgguguguuggagugggcaaccgcgacuucgucgaagggcugagcggagcuaccuggguggaugugguccucgagcauggcgggugcguuaccacaauggccaagaauaaacccacgcuggacauugagcugcagaagaccgaagcuacacaacucgccacccugagaaaacuuuguaucgagggaaagauuacaaacaucaccacggauucccggugcccuacacagggcgaagcggugcugccggaggaacaggaccagaauuauguguguaaacacaccuacgucgaucgcggcugggggaacggaugcggccucuuugggaagggaagccuggugaccugcgccaaguuccaaugucuugagcccauugagggcaaaguugugcaguaugaaaaucugaaguacacagucaucaucaccgugcacacaggggaccagcaucagguuggaaacgagacgcaaggcgugaccgcugaaauuacaccucaggccucuaccacagaggcuauccuccccgaauauggcacccuggggcuggagugcuccccuagaacgggacucgacuuuaaugagaugauucugcuuaccaugaaaaacaaggccuggaugguccaccggcagugguucuuugaucugccccucccguggacaagcggcgccaccacagaaaccccuacguggaaucgcaaagagcugcuugugacauucaagaacgcucaugcgaaaaagcaagaagucgugguucuggggucucaggagggagccaugcacaccgcucucacaggcgccaccgaaauccagaauuccgggggcaccagcauuuuugccggacaccugaaguguagacugaaaauggacaagcucgagcugaaaggcaugucuuacgcuaugugcacaaacacguucgugcuuaagaaagaggucuccgaaacccagcaugggacaauccugaucaagguggaguacaagggagaagaugcccccuguaaaauuccuuucagcaccgaggacggccaagggaaggcgcacaacggacggcucaucacagcuaaucccguugugaccaaaaaggaggaacccgucaacauugaggccgaaccuccguuuggcgaguccaauaucgugauugggaucggcgauaacgcccugaaaaucaauugguauaagaagggaucuagcauuggcaaaauguucgaagcuacggccagaggggcucgccggauggccauccugggagacacagcgugggauuuuggcuccguggggggaguucuuaacagccucggcaagaugguccaucagauuuucgggucugccuacaccgcucuguuuuccggcgugagcugggugaugaaaaucggaauuggcguccugcucaccuggaucgggcugaauucuaagaacacaagcauguccuucucuugcauugccaucggaaucauuacccuuuaucugggcgcugugguucaggccgacauggggugugugaucaauuggaaaggaaaggagcucaagugcggcagcgggauuuuugucacaaacgaggugcacacguggaccgaacaguacaaauuccaagcggauucccccaagagacuggccacagcuaucgccggcgcuugggagaauggaguuuguggcauucgcagcaccacacggauggaaaaccugcuuuggaaacagaucgccaaugagcucaacuauauccugugggaaaauaacauuaagcugaccguggucgugggggacaucauuggaguucucgagcagggcaaaagaacgcugaccccucagcccauggagcuuaaguacucuuggaaaacaugggggaaggccaagaucgugaccgcugaaacacaaaacuccagcuuuauuaucgauggaccuaauacccccgagugcccgucugcgucccgcgccuggaacgucugggaaguggaggacuauggcuucggcguguuuacaaccaauaucuggcugaaacuccgggaagucuacacgcagcugugugaccauagacugaugagcgcugccguuaaggaugagcgcgccgugcacgcugacaugggguacuggauugagucccagaaaaacggaucuuggaagcuugaaaaagccagccucaucgaggugaagacaugcaccuggccuaagucccacacccuguggucuaauggcguccuggaaagcgauaugauuauccccaaaucccucgcggggccuauuagccagcauaaccaccggcccggauaucauacacaaaccgcuggcccuuggcaccuggggaagcuugagcuggacuucaauuacugcgagggaacgacagugguuaucaccgaaaacuguggcacaagaggccccucucuccgcaccacaaccguguccgggaaacugauccacgaguggugcugucggagcugcacgcugccgccucuuagauauaugggagaagauggcuguugguacgggauggagauucggcccaucucugaaaaggaggagaauauggucaaaucccucgugagcgccggaucuggcaagguugacaacuuuaccaugggggugcugugccuggccauucucuucgaagaggucaugcgcggaaaguucggcaaaaagcauaugaucgcuggcguguuuuucacauuuguucugcuucugagcgggcagauuaccuggagagauauggcccacacacucaucaugauuggauccaaugcgagcgaccggaugggcaugggggugaccuaucuggcucugaucgccacguucaaaauccagcccuuucuugcccugggauucuuucucagaaagcugacaucucgcgaaaaccuccugcuuggcgucgggcuggcuauggccaccacacuccaacugccugaggauauugaacagauggcuaauggaaucgcccugggccuuauggcgcugaaacucauuacccaguucgagaccuaccagcuguggacagcccucaucucccugacguguagcaacaccauguuuacacuuaccguggcuuggcggacagccacccugauucucgcuggcgugucccugcugccggucugccaaucuagcuccaugagaaagacggacuggcuucccauggccguugccgcuaugggggugccuccccugccucucuucaucuuuucucugaaggauacacucaaacgcagaagcuggccccugaaugagggagugauggcggucggccuuguguccauccuggccucuagccugcuccggaacgacguuccuauggcugggccccugguggccggaggccuucugauugccuguuaugucaucaccgggaccuccgcugaucucacaguggaaaaggccgcggacauuaccugggaggaagaggcugaacagacaggaguuagccauaaccugaugaucacgguggacgaugacggcaccaugcgcauuaaagaugacgagacagagaauauccucaccguccugcuuaagacagcccugcugaucgugucuggcgucuucccguacuccauuccugccacccuccugguguggcacacguggcagaaacagacccaaagaagcgggguucuuugggaugugcccucuccucccgaaacacagaaggcugagcuggaagagggagucuaccggaucaaacagcagggcauuuuugggaagacccaagugggaguuggcgugcagaaggagggggucuuccauacaauguggcacgugacccgcggagccgugcucacauauaacggcaaaagacuggaaccgaauugggcguccguuaagaaagaccucaucagcuacggcgggggauggcggcugucugcucaguggcaaaagggcgaggaaguccaggugauugccguggagccugggaaaaaccccaagaauuuccagacgaugccuggaaccuuucagacaaccaccggcgaaaucggggccauugcucuugauuucaagcccggaacauccggcagccccaucaucaaccgcgagggcaaagucguggggcuguauggaaauggcguugugacgaagaacgggggauacgucuccggcauugcccaaaccaaugcugagccugacgggccgacacccgaacuggaggaagagauguuuaaaaagagaaaccucaccaucauggaucugcacccuggcagcggaaaaacacggaaguaucuucccgccauugugcgcgaagcgaucaagagacggcugagaacccucauucuggccccuacgcgcguuguggcugccgagauggaggaagcucucaaaggccugcccauccgguaccagacaaccgccaccaagucugagcauacagggagagaaaucgucgaccuuaugugccacgccaccuucacaaugcgccugcugagcccugugcggguuccgaauuauaaccucauuaucauggaugaggcucauuuuaccgaccccgcguccauugccgcuagaggauacaucucuacgcgcgugggcaugggggaagccgccgcuauuuucaugacagccaccccucccggaacagcggaugcuuuuccucagagcaaugcccccauccaggacgaggagcgggacaucccggaaagauccuggaacucuggcaaugaguggauuaccgauuucgccgggaaaacggucugguuugugccuagcaucaaggcuggcaacgacauugccaacugucugcgcaaaaauggaaagaaggugauccaacuuucccggaaaaccuucgauacagaauaccagaagaccaaacugaacgacugggauuuugucguuacaaccgacauuucugagaugggcgcgaauuucaaggccgauagagugaucgacccccggcgcugccucaaacccgugauucugacagaugggccugagagagucgugcuggcuggacccaugccuguuaccgccgcuagcgccgcucagcggcgcggcagaguggggcggaacccgcagaaggaaaaugaccaauauaucuucacgggacagccccucaacaaugaugaggaccacgcccauuggacagaagcgaagaugcuucuggacaacaucaauaccccugagggcauuauccccgcccuguuugaaccugagagagagaaauccgcugccauugauggggaauaccgccucaagggcgagagccggaaaaccuucgucgaacugaugagacgcggagaccuucccguguggcuggcucacaagguugccucugagggcaucaaauauacagaucggaaguggugcuuugacgggcagagaaacaaucagauucucgaagagaacauggauguggagaucuggaccaaagaaggagagaagaagaaacugcgcccgcgguggcuggacgccagaacauacuccgauccucucgcucuuaaggaauucaaagacuuugcggccggccgcaagagcaucgcucuggaucuggucacggagauugggagagugcccucucaccucgcccaucggacccgcaaugcccuggacaaccuugucaugcugcacacauccgaacauggaggcagagcuuaucggcacgccguggaggagcucccugaaaccauggagacacugcugcuccuuggccugaugauccugcucaccgggggagcgaugcuguuccuuauuagcggcaaagggaucggaaagacguccauuggccugaucuguguuaucgccucuagcgggaugcucuggauggcugaaauuccccugcaauggaucgccuccgcuauugugcuggaguuuuucaugauggugcuccuuaucccugagcccgaaaagcagcgcaccccgcaggauaaucaacuggccuacgucguuauuggaauccugacacucgcggccauuaucgcugccaacgagaugggccugcuugaaaccacaaaaagagaccugggcaugagcaaggagccugggguggugucucccaccuccuaucucgaugucgaccugcaccccgcuagcgccuggacgcuguacgcuguggccacaaccguuaucacaccuaugcuccggcauaccauugaaaauucuaccgcgaacgugagccuugccgcuaucgccaaccaggcugucgugcugaugggacuggacaaaggcuggccgauuuccaagauggaucucggggucccccugcuugcccugggaugcuacucucaggugaauccucucacacugacggccgcgguucugcuccuuaucacccacuaugcuauuaucggccccgggcugcaggccaaagcuacaagagaggcccaaaagcgcaccgccgcuggaaucaugaagaacccuacaguggacggcauuaugaccaucgaucuggaccccgucauuuacgauagcaaauuugagaagcagcucggccaggugaugcugcuuguucugugugccgugcagcuccugcugaugcggacguccugggcgcucugcgaagcccuuacacuggcuaccgggccuaucaccacacugugggagggaucuccgggcaaauucuggaauaccacaauugccgucagcauggcuaacaucuuuagaggguccuaucucgccggagcgggccuggccuucagcaucaugaagucuguggggacgggaaaacgcggcaccggcucccaaggggaaacacuuggagagaaguggaagaaaaagcugaaucagcucagccggaaagaauuugaccuguacaagaaauccggcauuaccgagguggauagaacagaggcuaaggaagggcugaaacggggagagaucacccaucacgccguuucucgcggcagcgcuaagcuccagugguucgucgaaagaaacauggugauucccgaggggcgggugaucgaccuuggauguggccgcggcgggugguccuauuacugcgccggacugaagaaagucacggaaguuagaggcuauaccaaggggggaccuggccaugaggagcccgugccuaugucuacauacggguggaauauugugaaacugaugagcggaaaggaugucuucuaccuccccccggaaaaaugugacacccugcuuugcgauaucggcgaguccagcccuucucccacaguggaagagucccggaccauucgcguucugaagaugguggagcccuggcucaagaacaaucaguuuuguaucaaaguccugaacccuuauaugcccacagugaucgaacaccuggagagacuccaacggaagcacggcgggaugcuuguucgcaauccucugagcagaaacucuacccaugaaauguacuggauuuccaauggaacgggcaacaucguggcuagcgucaauauggugucucggcugcuccugaacagauucacaaugacccaccgccggccgaccauugagaaagacguggaucuuggggccggaacaagacaugucaacgcggaacccgagacgccuaauauggacguuaucggcgagcgcauuaagcggaucaaagaagagcacaacagcaccuggcacuaugacgaugaaaaucccuacaagacaugggccuaucauggguccuacgaggugaaggcuaccggaucugccagcuccaugaucaacggcguggucaaacugcucacaaagccuugggacgugguucccauggugacccagauggcuaugacagauaccacgccguuuggccagcaaagagucuucaaagaaaagguggacacccgcacaccucggagcaugcccgggaccagacgcguuaugggaauuacagccgaguggcuguggcggacccugggcagaaauaaaaagccucgccucugcacgcgggaggaauuuacaaagaaagugagaaccaacgccgcgaugggggcugucuucacagaggaaaaucagugggauuccgccaaggccgcuguggaggacgaagauuuuuggaaacugguugaccgcgagagagagcuucacaagcugggaaaauguggcucuugcguguauaacaugauggggaagcgggaaaaaaagcucggcgaguucggaaaggccaaaggcagccgcgcuaucugguacauguggcugggggccagauaccuugaauuugaggcgcugggauuccucaaugaggaucauugguuuucccgggaaaacucuuauagcggcgucgagggggaaggacugcacaagcugggcuacauucucagagacaucuccaaaauucccgggggcgccauguaugcugaugacaccgccggaugggacacgcggaucaccgaggaugaccugcauaaugaagagaagaucacacagcagauggauccugagcaccgccaacuugcuaacgccauuuucaaacugaccuaccagaauaagguggucaaggugcagagacccacaccgaccggcacaguuauggacaucauuucucggaaagaucagcgcgggagcggacaagugggcaccuaugggcucaacacguuuacaaauauggaagcgcagcugaucagacagauggagggagaaggcguccuuuccaaggccgaccuggagaacccucaccuccccgaaaaaaagauuacccaguggcuggagaccaaagggguggagcggcugaagcgcauggcuaucagcggcgaugacugcgugguuaagcccaucgaugacagauucgccaacgcucuccuggcccuuaaugauaugggaaaagugcggaaggacauuccucaauggcagccgucuaaaggcuggcaugauuggcagcagguccccuucuguucccaccauuuucacgaacugaucaugaaggacgggcgcaaacucgugguuccuugcagaccccaagacgagcugauuggacgggcucgcaucagccagggcgccggguggucucuuagagaaacagcgugucugggaaaggccuacgcucagauguggucccucauguauuuccaccggcgcgaucugagacuggccagcaacgccauuugcucugcugugccuguccauugggugcccaccucccggacaacguggagcauccacgcccaucaccaauggaugaccacagaggacaugcucaccgucuggaauagaguguggauugaagauaacccuuggauggaggacaagacacccguuaccacgugggagaaugugccguaccugggcaaacgcgaagaucaguggugugggucccuuaucggccugaccagccgggcgacaugggcucagaacaucccuaccgccauucagcaagucagaucucucaucggaaaugaggaauuucuggacuacaugcccagcaugaagcgcuuccggaaagaggaggaauccgagggcgccauuugguga

SEQ ID NO: 20369 - RNA, 9873 nt, Artificial Sequence
  derived and/or modified CDS sequence (opt5) from DENV-3__JX669493__SS-prME
accagcuucugccugaugaugauccuccccgccgcucuggccuuucaccuuacauccagagacggcgagccucggaugauuguggggaagaacgaacgcggaaaaucucugcucuucaagacggcgagcggcaucaauauguguacccugauugcuauggaucuuggggagaugugcgacgauacagucaccuacaaauguccgcauaucacagaaguugagcccgaagacauugauugcugguguaaccugaccuccacaugggugaccuauggaacgugcaaucaggccggcgagagacggcgcgacaagagaucuguggcccucgcuccucacgucgggaugggacuggauacccggacacaaaccuggaugagcgccgagggcgcuuggcgccagguggaaaaaguugagacaugggcccugagacaucccggcuuuaccauccucgcgcuguuccuugcccacuacaucgggacgucccugacacagaagguggucauuuuuauccuccugaugcuugugaccccuucuaugacaaugcgguguguuggagugggcaaccgcgacuucgucgaagggcugagcggagcuaccuggguggaugugguccucgagcauggcgggugcguuaccacaauggccaagaauaaacccacgcuggacauugagcugcagaagaccgaagcuacacaacucgccacccugagaaaacuuuguaucgagggaaagauuacaaacaucaccacggauucccggugcccuacacagggcgaagcggugcugccggaggaacaggaccagaauuauguguguaaacacaccuacgucgaucgcggcugggggaacggaugcggccucuuugggaagggaagccuggugaccugcgccaaguuccaaugucuugagcccauugagggcaaaguugugcaguaugaaaaucugaaguacacagucaucaucaccgugcacacaggggaccagcaucagguuggaaacgagacgcaaggcgugaccgcugaaauuacaccucaggccucuaccacagaggcuauccuccccgaauauggcacccuggggcuggagugcuccccuagaacgggacucgacuuuaaugagaugauucugcuuaccaugaaaaacaaggccuggaugguccaccggcagugguucuuugaucugccccucccguggacaagcggcgccaccacagaaaccccuacguggaaucgcaaagagcugcuugugacauucaagaacgcucaugcgaaaaagcaagaagucgugguucuggggucucaggagggagccaugcacaccgcucucacaggcgccaccgaaauccagaauuccgggggcaccagcauuuuugccggacaccugaaguguagacugaaaauggacaagcucgagcugaaaggcaugucuuacgcuaugugcacaaacacguucgugcuuaagaaagaggucuccgaaacccagcaugggacaauccugaucaagguggaguacaagggagaagaugcccccuguaaaauuccuuucagcaccgaggacggccaagggaaggcgcacaacggacggcucaucacagcuaaucccguugugaccaaaaaggaggaacccgucaacauugaggccgaaccuccguuuggcgaguccaauaucgugauugggaucggcgauaacgcccugaaaaucaauugguauaagaagggaucuagcauuggcaaaauguucgaagcuacggccagaggggcucgccggauggccauccugggagacacagcgugggauuuuggcuccguggggggaguucuuaacagccucggcaagaugguccaucagauuuucgggucugccuacaccgcucuguuuuccggcgugagcugggugaugaaaaucggaauuggcguccugcucaccuggaucgggcugaauucuaagaacacaagcauguccuucucuugcauugccaucggaaucauuacccuuuaucugggcgcugugguucaggccgacauggggugugugaucaauuggaaaggaaaggagcucaagugcggcagcgggauuuuugucacaaacgaggugcacacguggaccgaacaguacaaauuccaagcggauucccccaagagacuggccacagcuaucgccggcgcuugggagaauggaguuuguggcauucgcagcaccacacggauggaaaaccugcuuuggaaacagaucgccaaugagcucaacuauauccugugggaaaauaacauuaagcugaccguggucgugggggacaucauuggaguucucgagcagggcaaaagaacgcugaccccucagcccauggagcuuaaguacucuuggaaaacaugggggaaggccaagaucgugaccgcugaaacacaaaacuccagcuuuauuaucgauggaccuaauacccccgagugcccgucugcgucccgcgccuggaacgucugggaaguggaggacuauggcuucggcguguuuacaaccaauaucuggcugaaacuccgggaagucuacacgcagcugugugaccauagacugaugagcgcugccguuaaggaugagcgcgccgugcacgcugacaugggguacuggauugagucccagaaaaacggaucuuggaagcuugaaaaagccagccucaucgaggugaagacaugcaccuggccuaagucccacacccuguggucuaauggcguccuggaaagcgauaugauuauccccaaaucccucgcggggccuauuagccagcauaaccaccggcccggauaucauacacaaaccgcuggcccuuggcaccuggggaagcuugagcuggacuucaauuacugcgagggaacgacagugguuaucaccgaaaacuguggcacaagaggccccucucuccgcaccacaaccguguccgggaaacugauccacgaguggugcugucggagcugcacgcugccgccucuuagauauauuggagaagauggcuguugguacgggauggagauccggcccauuucugaaaaggaggagaauauggucaaaucccucgugagcgccggaucuggcaagguugacaacuuuaccaugggggugcugugccuggccauccucuucgaagaggucaugcgcggaaaguucggcaaaaagcauaugauugcuggcguguuuuucacauuuguucugcuucugagcgggcagaucaccuggagagauauggcccacacacucauuaugaucggauccaaugcgagcgaccggaugggcaugggggugaccuaucuggcucugaucgccacguucaaaauucagcccuuucuugcccugggauucuuucucagaaagcugacaucucgcgaaaaccuccugcuuggcgucgggcuggcuauggccaccacacuccaacugccugaggauaucgaacagauggcuaauggaauugcccugggccuuauggcgcugaaacucaucacccaguucgagaccuaccagcuguggacagcccucauuucccugacguguagcaacaccauguuuacacuuaccguggcuuggcggacagccacccugauccucgcuggcgugucccugcugccggucugccaaucuagcuccaugagaaagacggacuggcuucccauggccguugccgcuaugggggugccuccccugccucucuucaucuuuucucugaaggauacacucaaacgcagaagcuggccccugaaugagggagugauggcggucggccuuguguccauucuggccucuagccugcuccggaacgacguuccuauggcugggccccugguggccggaggccuucugaucgccuguuaugucauuaccgggaccuccgcugaucucacaguggaaaaggccgcggacaucaccugggaggaagaggcugaacagacaggaguuagccauaaccugaugauuacgguggacgaugacggcaccaugcgcaucaaagaugacgagacagagaauauccucaccguccugcuuaagacagcccugcugauugugucuggcgucuucccguacuccaucccugccacccuccugguguggcacacguggcagaaacagacccaaagaagcgggguucuuugggaugugcccucuccucccgaaacacagaaggcugagcuggaagagggagucuaccggauuaaacagcagggcaucuuugggaagacccaagugggaguuggcgugcagaaggagggggucuuccauacaauguggcacgugacccgcggagccgugcucacauauaacggcaaaagacuggaaccgaauugggcguccguuaagaaagaccucauuagcuacggcgggggauggcggcugucugcucaguggcaaaagggcgaggaaguccaggugaucgccguggagccugggaaaaaccccaagaauuuccagacgaugccuggaaccuuucagacaaccaccggcgaaauuggggccaucgcucuugauuucaagcccggaacauccggcagccccaucauuaaccgcgagggcaaagucguggggcuguauggaaauggcguugugacgaagaacgggggauacgucuccggcaucgcccaaaccaaugcugagccugacgggccgacacccgaacuggaggaagagauguuuaaaaagagaaaccucaccauuauggaucugcacccuggcagcggaaaaacacggaaguaucuucccgccaucgugcgcgaagcgauuaagagacggcugagaacccucauccuggccccuacgcgcguuguggcugccgagauggaggaagcucucaaaggccugcccauccgguaccagacaaccgccaccaagucugagcauacagggagagaaauugucgaccuuaugugccacgccaccuucacaaugcgccugcugagcccugugcggguuccgaauuauaaccucaucauuauggaugaggcucauuuuaccgaccccgcguccaucgccgcuagaggauacauuucuacgcgcgugggcaugggggaagccgccgcuaucuucaugacagccaccccucccggaacagcggaugcuuuuccucagagcaaugcccccauccaggacgaggagcgggacauuccggaaagauccuggaacucuggcaaugaguggaucaccgauuucgccgggaaaacggucugguuugugccuagcauuaaggcuggcaacgacaucgccaacugucugcgcaaaaauggaaagaaggugauucaacuuucccggaaaaccuucgauacagaauaccagaagaccaaacugaacgacugggauuuugucguuacaaccgacaucucugagaugggcgcgaauuucaaggccgauagagugauugacccccggcgcugccucaaacccgugauccugacagaugggccugagagagucauccuggcuggacccaugccugugaccgccgcuagcgccgcucagcggcgcggcagaguugggcggaacccgcagaaggaaaaugaccaauauauuuucacgggacagccccucaacaaugaugaggaccacgcccauuggacagaagcgaagaugcuucuggacaacaucaauaccccugagggcauuauccccgcccuguuugaaccugagagagagaaauccgcugccauugauggggaauaccgccucaagggcgagagccggaaaaccuucguggaacugaugagacgcggagaccuucccgucuggcuggcucacaagguggccucugagggcaucaaauauacagaucggaaguggugcuuugacgggcagagaaacaaucagauccucgaagagaacauggauguugagauuuggaccaaagaaggagagaagaagaaacugcgcccgcgguggcuggacgccagaacauacuccgauccucucgcucuuaaggaauucaaagacuuugcggccggccgcaagagcaucgcucuggaucuggugacggagauugggagaguccccucucaccucgcccaucggacccgcaaugcccuggacaaccuugugaugcugcacacauccgaacauggaggcagagcuuaucggcacgccgucgaggagcucccugaaaccauggagacacugcugcuccuuggccugaugauccugcucaccgggggagcgaugcuguuccuuauuagcggcaaagggaucggaaagacguccaucggccugauuugugugaucgccucuagcgggaugcucuggauggcugaaauuccccugcaauggaucgccuccgcuauuguucuggaguuuuucaugauggugcuccuuaucccugagcccgaaaagcagcgcaccccgcaggauaaucaacuggccuacguggucauuggaauccugacacucgcggccaucauugcugccaacgagaugggccugcuugaaaccacaaaaagagaccugggcaugagcaaggagccugggguugugucucccaccuccuaucucgauguggaccugcaccccgcuagcgccuggacgcuguacgcugucgccacaaccgugaucacaccuaugcuccggcauaccauugaaaauucuaccgcgaacguuagccuugccgcuaucgccaaccaggcugugguccugaugggacuggacaaaggcuggccgauuuccaagauggaucucggggugccccugcuugcccugggaugcuacucucaggucaauccucucacacugacggccgcggugcugcuccuuaucacccacuaugcuaucauuggccccgggcugcaggccaaagcuacaagagaggcccaaaagcgcaccgccgcuggaaucaugaagaacccuacaguugacggcauuaugaccaucgaucuggaccccgugauuuacgauagcaaauuugagaagcagcucggccaggucaugcugcuugugcugugugccguucagcuccugcugaugcggacguccugggcgcucugcgaagcccuuacacuggcuaccgggccuaucaccacacugugggagggaucuccgggcaaauucuggaauaccacaaucgccgugagcauggcuaacauuuuuagaggguccuaucucgccggagcgggccuggccuucagcaucaugaagucugucgggacgggaaaacgcggcaccggcucccaaggggaaacacuuggagagaaguggaagaaaaagcugaaucagcucagccggaaagaauuugaccuguacaagaaauccggcauuaccgagguggauagaacagaggcuaaggaagggcugaaacggggagagaucacccaucacgccgugucucgcggcagcgcuaagcuccagugguucguugaaagaaacauggucauucccgaggggcgggugaucgaccuuggauguggccgcggcgggugguccuauuacugcgccggacugaagaaagugacggaagucagaggcuauaccaaggggggaccuggccaugaggagcccguuccuaugucuacauacggguggaauauugugaaacugaugagcggaaaggauguguucuaccuccccccggaaaaaugugacacccugcuuugcgauaucggcgaguccagcccuucucccacagucgaagagucccggaccauccgcgugcugaagaugguugagcccuggcucaagaacaaucaguuuuguauuaaagugcugaacccuuauaugcccacagucaucgaacaccuggagagacuccaacggaagcacggcgggaugcuugugcgcaauccucugagcagaaacucuacccaugaaauguacuggauuuccaauggaacgggcaacaucguugcuagcgugaauauggucucucggcugcuccugaacagauucacaaugacccaccgccggccgaccauugagaaagacguggaucuuggggccggaacaagacaugugaacgcggaacccgagacgccuaauauggacgucaucggcgagcgcaucaagcggauuaaagaagagcacaacagcaccuggcacuaugacgaugaaaaucccuacaagacaugggccuaucauggguccuacgagguuaaggcuaccggaucugccagcuccaugaucaacggcguggugaaacugcucacaaagccuugggacgucgugcccaugguuacccagauggcuaugacagauaccacgccguuuggccagcaaagaguguucaaagaaaaggucgacacccgcacaccucggagcaugcccgggaccagacgcgugaugggaauuacagccgaguggcuguggcggacccugggcagaaauaaaaagccucgccucugcacgcgggaggaauuuacaaagaaaguuagaaccaacgccgcgaugggggcuguguucacagaggaaaaucagugggauuccgccaaggccgcugucgaggacgaagauuuuuggaaacugguggaccgcgagagagagcuucacaagcugggaaaauguggcucuugcguuuauaacaugauggggaagcgggaaaaaaagcucggcgaguucggaaaggccaaaggcagccgcgcuaucugguacauguggcugggggccagauaccuugaauuugaggcgcugggauuccucaaugaggaucauugguuuucccgggaaaacucuuauagcggcguggagggggaaggacugcacaagcugggcuacauucucagagacaucuccaaaauccccgggggcgccauguaugcugaugacaccgccggaugggacacgcggauuaccgaggaugaccugcauaaugaagagaagaucacacagcagauggauccugagcaccgccaacuugcuaacgccauuuucaaacugaccuaccagaauaaggucgugaagguccagagacccacaccgaccggcacagugauggacaucauuucucggaaagaucagcgcgggagcggacaaguuggcaccuaugggcucaacacguuuacaaauauggaagcgcagcugaucagacagauggagggagaaggcgugcuuuccaaggccgaccuggagaacccucaccuccccgaaaaaaagaucacccaguggcuggagaccaaaggggucgagcggcugaagcgcauggcuauuagcggcgaugacugcguggugaagcccaucgaugacagauucgccaacgcucuccuggcccuuaaugauaugggaaaaguucggaaggacauuccucaauggcagccgucuaaaggcuggcaugauuggcagcaggugcccuucuguucccaccauuuucacgaacugaucaugaaggacgggcgcaaacucgucgugccuugcagaccccaagacgagcugauuggacgggcucgcaucagccagggcgccggguggucucuuagagaaacagcgugucugggaaaggccuacgcucagauguggucccucauguauuuccaccggcgcgaucugagacuggccagcaacgccauuugcucugcuguuccugugcauuggguccccaccucccggacaacguggagcauccacgcccaucaccaauggaugaccacagaggacaugcucaccguguggaauagagucuggaucgaagauaacccuuggauggaggacaagacacccgugaccacgugggagaauguuccguaccugggcaaacgcgaagaucaguggugugggucccuuauuggccugaccagccgggcgacaugggcucagaacaucccuaccgccauucagcaagugagaucucucaucggaaaugaggaauuucuggacuacaugcccagcaugaagcgcuuccggaaagaggaggaauccgagggcgccauuugguga

SEQ ID NO: 20370 - RNA, 9873 nt, Artificial Sequence
  derived and/or modified CDS sequence (opt5) from DENV-3__JX669504__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaccaauauguguacacuuaucgcuauggaucugggggagaugugcgacgauaccgucacauacaaauguccgcauauuaccgaaguugagcccgaagacaucgauugcugguguaaccucacauccaccugggugacguauggaaccugcaaucaggccggcgagagacggcgcgacaagagaucuguggcccuggcuccucacgucgggaugggacuggauacacggacccaaacauggaugagcgccgagggcgcuuggcgccagguggaaaaaguugagaccugggcccucagacaucccggcuucacgauucuggcgcuuuuucuggcccacuacaucgggacaucccucacccagaagguggucaucuucauucugcuuaugcuggugacaccuucuaugaccaugcgguguguuggagugggcaaccgcgacuuugucgaagggcucagcggagcuaccuggguggaugugguccuggagcauggcgggugcguuacaacgauggccaagaauaaacccacccuggacaucgagcuccagaagacagaagcuacccaacuggccacacuuagaaaacuguguauugagggaaagaucaccaacauuacgacagauucccggugcccuacccagggcgaagcggugcucccggaggaacaggaccagaauuauguguguaaacacaccuacgucgaucgcggcugggggaacggaugcggccuguucgggaagggaagccuugugacaugcgccaaguuucaaugucuggagcccaucgagggcaaaguugugcaguaugaaaaucucaaguacaccgucauuaucacagugcacacgggggaccagcaucagguuggaaacgagacccaaggcgugacagcugaaaucaccccucaggccucuacaaccgaggcuauucugcccgaauauggcacgcuggggcucgagugcuccccuagaaccggacuggacuucaaugagaugauccuucugacaaugaaaaacaaggccuggaugguccaccggcagugguuuuucgaucucccccugccguggaccagcggcgccacaaccgaaacgccuacauggaaucgcaaagagcuucuggugaccuuuaagaacgcucaugcgaaaaagcaagaagucgugguucucgggucucaggagggagccaugcacacagcucugaccggcgccaccgaaauucagaauuccgggggcacaagcaucuucgccggacaccugaaguguagacucaaaauggacaagcuggagcuuaaaggcaugucuuacgcuaugugcacgaacaccuuugugcugaagaaagaggucuccgaaacacagcaugggaccauucucaucaagguggaguaccggggagaagaugcccccuguaagaucccuuucagcacagaggacggccaagggaaagcgcacaacggaagacugauuaccgcuaaucccguugugacgaagaaagaggaacccgucaacaucgaggccgaaccuccguucggcgaguccaauauugugaucgggauuggcgauaacgcccugaagaucaauugguauaaaaagggaucuagcaucggcaagauguuugaagcuacagcccgcggggcucggagaauggccauucuuggagacaccgcgugggauuucggcuccguggggggaguucucaacagccugggcaaaaugguccaucagaucuuugggucugccuacaccgcucuguucuccggcgugagcugggugaugaagauuggaaucggcguccuccugacauggauugggcuuaauucuaaaaacaccagcauguccuuuucuugcaucgccauuggaaucaucacacuguaucucggcgcugugguucaggccgacauggggugugugauuaauuggaagggaaaagagcugaagugcggcagcgggaucuucgucacgaacgaggugcacaccuggacagaacaguacaaguuucaagcggauucccccaaacgccuggccaccgcuauugccggcgcuugggagaauggaguuuguggcauccggagcacaaccagaauggaaaaccuucucuggaagcagauugccaaugagcugaacuauauccugugggaaaauaacaucaaacucacgguggucgugggggacauuaucggaguucuggagcagggcaagcgcacccuuacaccucagcccauggagcugaaauacucuuggaagaccugggggaaagccaagauugugacagcugaaacccaaaacuccagcuucaucauugauggaccuaauacacccgagugcccgucugcgucccgggccuggaacgucugggaaguggaggacuauggcuuuggcguguucaccacgaauaucuggcucaagcugagagaagucuacacacagcugugugaccaucgccuuaugagcgcugccguuaaagaugagcgggccgugcacgcugacaugggguacuggaucgagucccagaagaacggaucuuggaaacucgaaaaggccagccugauugaggugaaaaccugcaccuggccuaagucccacacacuguggucuaauggcguccucgaaagcgauaugaucauucccaagucccuggcggggccuaucagccagcauaaccacagacccggauaucauacccaaacggcuggcccuuggcaccuugggaaacuggagcucgacuuuaauuacugcgagggaacaaccgugguuauuacagaaaacuguggcacccgcggccccucucugcggacaaccacgguguccgggaagcugauccacgaguggugcuguagaagcugcacccuuccgccucuccgguauaugggagaagauggcuguugguacgggauggagauccgccccauuucugaaaaagaggagaauauggucaagucccuggugagcgccggaucuggcaaaguugacaacuucacaaugggggugcugugccucgccauccuguuugaagaggucaugagaggaaaguucggcaagaaacauaugauugcuggcguguucuuuacccuuguucugcuccugagcgggcagaucacauggcgggauauggcccacacccugauuaugaucggauccaaugcgagcgacagaaugggcaugggggugacguaucuugcucugauugccacauucaagauccagcccuuucucgcccugggauucuuucuccgcaaacugaccucucgggaaaaccuucugcucggcgucgggcuggcuauggccacaacccugcaacuuccugaggauaucgaacagauggcuaauggaauugcccugggccucauggcgcugaagcucaucacccaguucgagacauaccagcuguggacggcccuuauuucccugaccuguagcaacacaauguuuacccucacaguggcuuggagaaccgccacgcugauccuggcuggcgugucccuucugccggucugccaaucuagcuccaugcgcaaaacagacuggcuccccauggccguugccgcuaugggggugccuccccugccucucuucauuuuuucucugaaggauacccuuaagagacggagcuggccccugaaugagggagugauggcggucggccugguguccauccucgccucuagccugcuucgcaacgacguuccuauggcugggccccugguggccggaggccuccugaucgccuguuaugucauuaccgggacauccgcugaucucaccguggaaaaagccgcggacaucacaugggaggaagaggcugaacagacgggaguuagccauaaccugaugauuaccguggacgaugacggcacaaugagaaucaaggaugacgagaccgagaauauucuuacaguccugcugaaaaccgcccuccugaucgugucuggcgucuucccguacuccaucccugccacgcuucugguguggcacaccuggcagaagcagacacaacggagcgggguucucugggaugugcccucuccucccgaaacccagaaagcugagcuggaagagggagucuaccgcauuaagcagcagggcaucuuugggaaaacacaagugggaguuggcgugcagaaggagggggucuuccauaccauguggcacgugacaagaggagccgugcucacguauaacggcaagcggcuggaaccgaauugggcguccguuaaaaaggaccuuauuagcuacggcgggggauggcgccugucugcucaguggcaaaaaggcgaggaaguccaggugaucgccguggagccugggaagaaccccaaaaauuuucagaccaugccuggaacauuccagaccaccacaggcgaaauuggggccaucgcucuggauuucaagcccggaacguccggcagccccauuaucaacagagagggcaaggucguggggcucuauggaaauggcguugugaccaaaaacgggggauacgucuccggcaucgcccaaacaaaugcugagccugacgggccgacccccgaacuggaggaagagauguuuaagaaacggaaccuuacaauuauggaucugcacccuggcagcggaaagacccgcaaauaucuccccgccaucgugagagaagcgauuaagcggagacugcgcacgcucauccuggccccuacacggguuguggcugccgagauggaggaagcucuuaagggccugcccauuagauaccagaccaccgccacaaaaucugagcauaccgggcgcgaaaucgucgaccugaugugccacgccacauucaccaugcggcuccugagcccugugagaguuccgaauuauaaccuuaucauuauggaugaggcucauuuuacggaccccgcguccaucgccgcucgcggauacauuucuacacgggugggcaugggggaagccgccgcuaucuucaugaccgccacaccucccggaaccgcggaugcuuuuccucagagcaaugcccccauucaggacgaggagagagacaucccggaacgcuccuggaacucuggcaaugaguggaucacggauuucgccgggaagaccgucugguuugugccuagcauuaaagcuggcaacgacaucgccaacugucugcggaagaauggaaaaaaggugauucaacucuccagaaagacauucgauaccgaauaccagaaaacaaagcugaacgacugggauuuugucguuaccacagacaucucugagaugggcgcgaauuucaaagccgaucgggugauugacccccgcagaugccugaagcccgugauccucaccgaugggccugagcgggucauucuugcuggacccaugccugugacggccgcuagcgccgcucagcgcagaggccggguugggagaaacccgcagaaagaaaaugaccaauauaucuuuacaggacagccccugaacaaugaugaggaccacgcccauuggaccgaagcgaagaugcugcucgacaacaucaauaccccugagggcauuauccccgcccuguucgaaccugagcgcgagaaguccgcugccauugauggggaauaccggcuuaaaggcgagagcagaaagacauucguggaacugaugcgccggggagaccuccccgucuggcuggcucacaaaguggccucugagggcaucaaguauaccgauagaaaauggugcuuugacgggcagcgcaacaaucagauucuggaagagaacauggauguugagaucuggacaaaggaaggagagaaaaagaagcuccggccgagauggcuugacgcccgcacguacuccgauccucuggcucugaaagaauucaaggacuuugcggccggcagaaaaagcaucgcucucgaucuggugaccgagauugggcggguccccucucaccuugcccaucgcacaagaaaugcccuggacaaccucgugaugcugcacaccuccgaacauggaggccgggcuuaucgccacgccgucgaggagcugccugaaacaauggagacccuccuucugcugggccucaugauccugcuuacggggggagcgaugcuguuccucauuagcggcaaggggaucggaaaaaccuccauuggccugaucugugugaucgccucuagcgggaugcuguggauggcugaaauuccccuccaauggaucgccuccgcuauuguucuugaguuuuucaugauggugcugcugaucccugagcccgaaaagcagagaacaccgcaggauaaucaacucgccuacguggucauuggaauccugacccuugcggccauuaucgcugccaacgagaugggccugcucgaaacaaccaagcgggaccugggcaugagcaaagagccugggguugugucucccacguccuaucuggauguggaccuccaccccgcuagcgccuggacacuuuacgcugucgccaccacagugaucaccccuaugcugagacauaccauugaaaauucuacagcgaacguuagccuggccgcuaucgccaaccaggcugugguccucaugggacuggacaagggcuggccgauuuccaaaauggaucuuggggugccccugcucgcccugggaugcuacucucaggucaauccucugacgcucaccgccgcggugcuucugcugaucacacacuaugcuauuaucggccccgggcuccaggccaaggcuacccgcgaggcccaaaaacggacagccgcuggaaucaugaagaacccuaccguugacggcauuaugacgaucgaucuggaccccgugauuuacgauagcaaguuugagaaacagcuuggccaggucaugcugcucgugcugugugccguucagcugcuccuuaugagaacauccugggcgcugugcgaagcccugacccucgcuaccgggccuaucacaacccugugggagggaucuccgggcaaguucuggaauacaacgauugccgugagcauggcuaacaucuuucgcggguccuaucuugccggagcgggccuggccuucagcaucaugaaaucugucgggaccggaaagcggggcacaggcucccaaggggaaacccucggagagaaauggaagaagaaacugaaucagcugagcagaaaggaauuugaccucuacaaaaaguccggcauuacagagguggaucggaccgaggcuaaagaagggcuuaagcgcggagagaucacgcaucacgccgugucuagaggcagcgcuaaacugcagugguucguugaacggaacauggucauucccgaggggcgcgugaucgaccugggauguggcagaggcgggugguccuauuacugcgccggacucaagaaggugaccgaaguccggggcuauacaaaagggggaccuggccaugaggagcccguuccuaugucuaccuacggguggaauauugugaagcugaugagcggaaaagauguguuuuaccuucccccggaaaagugugacacacugcucugcgauaucggcgaguccagcccuucucccaccgucgaagagucccgcacaauuagagugcugaaaaugguugagcccuggcugaagaacaaucaguucuguaucaaggugcucaacccuuauaugcccaccgucaucgaacaccuugagcggcugcaacgcaaacacggcgggaugcuggugagaaauccucucagccggaacucuacgcaugaaauguacuggauuuccaauggaacaggcaacaucguugcuagcgugaauaccgucucuagacugcuucugaaccgcuucaccaugacacaccggagaccgacgaccgagaaggacguggaucucggggccggaacacgccaugugaacgcggaacccgagaccccuaauauggacgucauuggcgagcggaucaaaagaauuaaggaagagcacaacagcacauggcacuaugacgaugaaaaucccuacaaaaccugggccuaucauggguccuacgagguuaaggcuacaggaucugccagcuccaugaucaacggcguggugaagcugcugaccaaaccuugggacgucgugcccaugguuacgcagauggcuaugaccgauacaaccccguuuggccagcaacgcguguucaaggaaaaagucgacacacggaccccuagaagcaugcccgggacgcgccgggugaugggaaucacagccgaguggcucuggagaacccugggccgcaauaagaaaccucggcuuugcacaagagaggaauuuaccaagaagguucgcacgaacgccgcgaugggggcuguguucaccgaggaaaaucagugggauuccgccaaagccgcugucgaggacgaagauuuuuggaagcugguggacagagagcgggagcuccacaaacugggaaaguguggcucuugcguuuauaacaugauggggaaacgcgaaaagaaacuuggcgaguucggaaaggccaagggcagcagagcuauuugguacauguggcugggggcccgguaccucgaauuugaggcgcugggauuccugaaugaggaucauugguuuuccagagaaaacucuuauagcggcguggagggggaaggacuccacaaacugggcuacauccuucgggacauuuccaagauccccgggggcgccauguaugcugaugacacagccggaugggacacccgcauuacagaggaugaccugcauaaugaagagaaaaucacccagcagauggauccugagcacagacaacucgcuaacgccaucuucaagcugacauaccagaauaaagucgugaagguccagcggcccaccccgacgggcacagugauggacauuaucucucgcaaggaucagagagggagcggacaaguuggcaccuaugggcuuaacaccuuuacaaauauggaagcgcagcugauucggcagauggagggagaaggcgugcucuccaaagccgaccuggagaacccucaccugcccgaaaagaaaaucacccaguggcucgagacaaagggggucgagcgccugaaaagaauggcuauuagcggcgaugacugcguggugaagcccaucgaugaccgguucgccaacgcucuucuggcccucaaugauaugggaaagguucgcaaagacaucccucaauggcagccgucuaagggcuggcaugauuggcagcaggugcccuuuuguucccaccauuuccacgaacugauuaugaaagacgggagaaagcuugucgugccuugccggccccaagacgagcugaucggacgcgcuagaauuagccagggcgccggguggucucuccgggaaacggcgugucugggaaaagccuacgcucagauguggucccugauguauuuccaccgcagagaucuccggcuggccagcaacgccaucugcucugcuguuccugugcauuggguccccaccuccagaacaaccuggagcauucacgcccaucaccaauggaugacaaccgaggacaugcuuacgguguggaaucgcgucuggaucgaagauaacccuuggauggaggacaagacccccgugacaaccugggagaauguuccguaccugggcaagcgggaagaucaguggugugggucccucauuggccugacaagcagagcgaccugggcucagaacaucccuacggccauccagcaagugcgcucucuuauuggaaaugaggaauuucuggacuacaugcccagcaugaaacgguucagaaaggaggaggaauccgagggcgccaucugguga

SEQ ID NO: 20371 - RNA, 9873 nt, Artificial Sequence
  derived and/or modified CDS sequence (opt5) from DENV-3__JX669506__SS-prME
accagcuucugccugaugaugauccuccccgccgcucuggccuuucaccuuacauccagagacggcgagccucggaugauuguggggaagaacgaacgcggaaaaucucugcucuucaagacggcgagcggcaucaauauguguacccugauugcuauggaucuuggggagaugugcgacgauacagucaccuacaaauguccgcauaucacagaaguugagcccgaagacauugauugcugguguaaccugaccuccacaugggugaccuauggaacgugcaaucaggccggcgagagacggcgcgacaagagaucuguggcccucgcuccucacgucgggaugggacuggauacccggacacaaaccuggaugagcgccgagggcgcuuggcgccagguggaaaaaguugagacaugggcccugagacaucccggcuuuaccauccucgcgcuguuccuugcccacuacaucgggacgucccugacacagaagguggucauuuuuauccuccugaugcuugugaccccuucuaugacaaugcgguguguuggagugggcaaccgcgacuucgucgaagggcugagcggagcuaccuggguggaugugguccucgagcauggcgggugcguuaccacaauggccaagaauaaacccacgcuggacauugagcugcagaagaccgaagcuacacaacucgccacccugagaaaacuuuguaucgagggaaagauuacaaacaucaccacggauucccggugcccuacacagggcgaagcggugcugccggaggaacaggaccagaauuauguguguaaacacaccuacgucgaucgcggcugggggaacggaugcggccucuuugggaagggaagccuggugaccugcgccaaguuccaaugucuugagcccauugagggcaaaguugugcaguaugaaaaucugaaguacacagucaucaucaccgugcacacaggggaccagcaucagguuggaaacgagacgcaaggcgugaccgcugaaauuacaccucaggccucuaccacagaggcuauccuccccgaauauggcacccuggggcuggagugcuccccuagaacgggacucgacuuuaaugagaugauucugcuuaccaugaaaaacaaggccuggaugguccaccggcagugguucuuugaucugccccucccguggacaagcggcgccaccacagaaaccccuacguggaaucgcaaagagcugcuugugacauucaagaacgcucaugcgaaaaagcaagaagucgugguucuggggucucaggagggagccaugcacaccgcucucacaggcgccaccgaaauccagaauuccgggggcaccagcauuuuugccggacaccugaaguguagacugaaaauggacaagcucgagcugaaaggcaugucuuacgcuaugugcacaaacacguucgugcuuaagaaagaggucuccgaaacccagcaugggacaauccugaucaagguggaguacaagggagaagaugcccccuguaaaauuccuuucagcaccgaggacggccaagggaaggcguauaacggacggcucaucacagcuaaucccguugugaccaaaaaggaggaacccgucaacauugaggccgaaccuccguuuggcgaguccaauaucgugauugggaucggcgauaacgcccugaaaaucaauugguacaagaagggaucuagcauuggcaaaauguucgaagcuacggccagaggggcucgccggauggccauccugggagacacagcgugggauuuuggcuccguggggggaguucuuaacagccucggcaagaugguccaccagauuuucgggucugccuauaccgcucuguuuuccggcgugagcugggugaugaaaaucggaauuggcguccugcucaccuggaucgggcugaauucuaagaacacaagcauguccuucucuugcauugccaucggaaucauuacccuuuaccugggcgcugugguucaggccgacauggggugugugaucaauuggaaaggaaaggagcucaagugcggcagcgggauuuuugucacaaacgaggugcauacguggaccgaacaguauaaauuccaagcggauucccccaagagacuggccacagcuaucgccggcgcuugggagaauggaguuuguggcauucgcagcaccacacggauggaaaaccugcuuuggaaacagaucgccaaugagcucaacuacauccugugggaaaauaacauuaagcugaccguggucgugggggacaucauuggaguucucgagcagggcaaaagaacgcugaccccucagcccauggagcuuaaguauucuuggaaaacaugggggaaggccaagaucgugaccgcugaaacacaaaacuccagcuuuauuaucgauggaccuaauacccccgagugcccgucugcgucccgcgccuggaacgucugggaaguggaggacuacggcuucggcguguuuacaaccaauaucuggcugaaacuccgggaagucuacacgcagcugugugaccacagacugaugagcgcugccguuaaggaugagcgcgccgugcaugcugacaugggguauuggauugagucccagaaaaacggaucuuggaagcuugaaaaagccagccucaucgaggugaagacaugcaccuggccuaagucccacacccuguggucuaauggcguccuggaaagcgauaugauuauccccaaaucccucgcggggccuauuagccagcacaaccaucggcccggauaccacacacaaaccgcuggcccuuggcaucuggggaagcuugagcuggacuucaauuauugcgagggaacgacagugguuaucaccgaaaacuguggcacaagaggccccucucuccgcaccacaaccguguccgggaaacugauccacgaguggugcugucggagcugcacgcugccgccucuuagauacaugggagaagauggcuguugguaugggauggagauucggcccaucucugaaaaggaggagaauauggucaaaucccucgugagcgccggaucuggcaagguugacaacuuuaccaugggggugcugugccuggccauucucuucgaagaggucaugcgcggaaaguucggcaaaaagcacaugaucgcuggcguguuuuucacauuuguucugcuucugagcgggcagauuaccuggagagauauggcccauacacucaucaugauuggauccaaugcgagcgaccggaugggcaugggggugaccuaccuggcucugaucgccacguucaaaauccagcccuuucuugcccugggauucuuucucagaaagcugacaucucgcgaaaaccuccugcuuggcgucgggcuggcuauggccaccacacuccaacugccugaggauauugaacagauggcuaauggaaucgcccugggccuuauggcgcugaaacucauuacccaguucgagaccuaucagcuguggacagcccucaucucccugacguguagcaacaccauguuuacacuuaccguggcuuggcggacagccacccugauucucgcuggcgugucccugcugccggucugccaaucuagcuccaugagaaagacggacuggcuucccauggccguugccgcuaugggggugccuccccugccucucuucaucuuuucucugaaggauacacucaaacgcagaagcuggccccugaaugagggagugauggcggucggccuuguguccauccuggccucuagccugcuccggaacgacguuccuauggcugggccccugguggccggaggccuucugauugccuguuacgucaucaccgggaccuccgcugaucucacaguggaaaaggccgcggacauuaccugggaggaagaggcugaacagacaggaguuagccacaaccugaugaucacgguggacgaugacggcaccaugcgcauuaaagaugacgagacagagaauauccucaccguccugcuuaagacagcccugcugaucgugucuggcgucuucccguacuccauuccugccacccuccugguguggcauacguggcagaaacagacccaaagaagcgggguucuuugggaugugcccucuccucccgaaacacagaaggcugagcuggaagagggagucuaucggaucaaacagcagggcauuuuugggaagacccaagugggaguuggcgugcagaaggagggggucuuccacacaauguggcaugugacccgcggagccgugcucacauacaacggcaaaagacuggaaccgaauugggcguccguuaagaaagaccucaucagcuauggcgggggauggcggcugucugcucaguggcaaaagggcgaggaaguccaggugauugccguggagccugggaaaaaccccaagaauuuccagacgaugccuggaaccuuucagacaaccaccggcgaaaucggggccauugcucuugauuucaagcccggaacauccggcagccccaucaucaaccgcgagggcaaagucguggggcuguacggaaauggcguugugacgaagaacgggggauaugucuccggcauugcccaaaccaaugcugagccugacgggccgacacccgaacuggaggaagagauguuuaaaaagagaaaccucaccaucauggaucugcacccuggcagcggaaaaacacggaaguaccuucccgccauugugcgcgaagcgaucaagagacggcugagaacccucauucuggccccuacgcgcguuguggcugccgagauggaggaagcucucaaaggccugcccauccgguaucagacaaccgccaccaagucugagcacacagggagagaaaucgucgaccuuaugugccaugccaccuucacaaugcgccugcugagcccugugcggguuccgaauuacaaccucauuaucauggaugaggcucacuuuaccgaccccgcguccauugccgcuagaggauacaucucuacgcgcgugggcaugggggaagccgccgcuauuuucaugacagccaccccucccggaacagcggaugcuuuuccucagagcaaugcccccauccaggacgaggagcgggacaucccggaaagauccuggaacucuggcaaugaguggauuaccgauuucgccgggaaaacggucugguuugugccuagcaucaaggcuggcaacgacauugccaacugucugcgcaaaaauggaaagaaggugauccaacuuucccggaaaaccuucgauacagaauaucagaagaccaaacugaacgacugggauuuugucguuacaaccgacauuucugagaugggcgcgaauuucaaggccgauagagugaucgacccccggcgcugccucaaacccgugauucugacagaugggccugagagagucauccuggcuggacccaugccugugaccgccgcuagcgccgcucagcggcgcggcagaguugggcggaacccgcagaaggaaaaugaccaauacaucuucacgggacagccccucaacaaugaugaggaccaugcccacuggacagaagcgaagaugcuucuggacaacauuaauaccccugagggcaucauucccgcccuguuugaaccugagagagagaaauccgcugccaucgauggggaauaucgccucaagggcgagagccggaaaaccuucguggaacugaugagacgcggagaccuucccgucuggcuggcucauaagguggccucugagggcauuaaauacacagaucggaaguggugcuuugacgggcagagaaacaaucagauccucgaagagaacauggauguugagaucuggaccaaagaaggagagaagaagaaacugcgcccgcgguggcuggacgccagaacauauuccgauccucucgcucuuaaggaauucaaagacuuugcggccggccgcaagagcauugcucuggaucuggugacggagaucgggagaguccccucucaccucgcccaccggacccgcaaugcccuggacaaccuugugaugcugcauacauccgaacacggaggcagagcuuaccggcaugccgucgaggagcucccugaaaccauggagacacugcugcuccuuggccugaugauucugcucaccgggggagcgaugcuguuccuuaucagcggcaaagggauuggaaagacguccaucggccugaucugugugauugccucuagcgggaugcucuggauggcugaaaucccccugcaauggauugccuccgcuaucguucuggaguuuuucaugauggugcuccuuauuccugagcccgaaaagcagcgcaccccgcaggauaaucaacuggccuauguggucaucggaauucugacacucgcggccaucaucgcugccaacgagaugggccugcuugaaaccacaaaaagagaccugggcaugagcaaggagccugggguugugucucccaccuccuaccucgauguggaccugcaccccgcuagcgccuggacgcuguacgcugucgccacaaccgugauuacaccuaugcuccggcacaccaucgaaaauucuaccgcgaacguuagccuugccgcuauugccaaccaggcugugguccugaugggacuggacaaaggcuggccgaucuccaagauggaucucggggugccccugcuugcccugggaugcuauucucaggucaauccucucacacugacggccgcggugcugcuccuuauuacccauuacgcuaucaucggccccgggcugcaggccaaagcuacaagagaggcccaaaagcgcaccgccgcuggaauuaugaagaacccuacaguugacggcaucaugaccauugaucuggaccccgugaucuaugauagcaaauuugagaagcagcucggccaggucaugcugcuugugcugugugccguucagcuccugcugaugcggacguccugggcgcucugcgaagcccuuacacuggcuaccgggccuauuaccacacugugggagggaucuccgggcaaauucuggaauaccacaaucgccgugagcauggcuaacaucuuuagaggguccuaccucgccggagcgggccuggccuucagcauuaugaagucugucgggacgggaaaacgcggcaccggcucccaaggggaaacacuuggagagaaguggaagaaaaagcugaaucagcucagccggaaagaauuugaccuguauaagaaauccggcaucaccgagguggauagaacagaggcuaaggaagggcugaaacggggagagauuacccaccaugccgugucucgcggcagcgcuaagcuccagugguucguugaaagaaacauggucauccccgaggggcgggugauugaccuuggauguggccgcggcgggugguccuacuauugcgccggacugaagaaagugacggaagucagaggcuacaccaaggggggaccuggccacgaggagcccguuccuaugucuacauacggguggaauaucgugaaacugaugagcggaaaggauguguucuaucuccccccggaaaaaugugacacccugcuuugcgauauuggcgaguccagcccuucucccacagucgaagagucccggaccauccgcgugcugaagaugguugagcccuggcucaagaacaaucaguuuuguaucaaagugcugaacccuuacaugcccacagucauugaacaucuggagagacuccaacggaagcacggcgggaugcuugugcgcaauccucugagcagaaacucuacccacgaaauguauuggaucuccaauggaacgggcaacauuguugcuagcgugaauauggucucucggcugcuccugaacagauucacaaugacccaucgccggccgaccaucgagaaagacguggaucuuggggccggaacaagacacgugaacgcggaacccgagacgccuaauauggacgucauuggcgagcgcaucaagcggaucaaagaagagcauaacagcaccuggcacuacgacgaugaaaaucccuauaagacaugggccuaccacggguccuaugagguuaaggcuaccggaucugccagcuccaugauuaacggcguggugaaacugcucacaaagccuugggacgucgugcccaugguuacccagauggcuaugacagauaccacgccguuuggccagcaaagaguguucaaagaaaaggucgacacccgcacaccucggagcaugcccgggaccagacgcgugaugggaaucacagccgaguggcuguggcggacccugggcagaaauaaaaagccucgccucugcacgcgggaggaauuuacaaagaaaguuagaaccaacgccgcgaugggggcuguguucacagaggaaaaucagugggauuccgccaaggccgcugucgaggacgaagauuuuuggaaacugguggaccgcgagagagagcuucauaagcugggaaaauguggcucuugcguuuacaacaugauggggaagcgggaaaaaaagcucggcgaguucggaaaggccaaaggcagccgcgcuauuugguacauguggcugggggccagauaucuugaauuugaggcgcugggauuccucaaugaggaucacugguuuucccgggaaaacucuuacagcggcguggagggggaaggacugcauaagcugggcuauauccucagagacauuuccaaaauccccgggggcgccauguacgcugaugacaccgccggaugggacacgcggaucaccgaggaugaccugcacaaugaagagaagauuacacagcagauggauccugagcaucgccaacuugcuaacgccaucuucaaacugaccuaucagaauaaggucgugaagguccagagacccacaccgaccggcacagugauggacauuaucucucggaaagaucagcgcgggagcggacaaguuggcaccuacgggcucaacacguuuacaaauauggaagcgcagcugauuagacagauggagggagaaggcgugcuuuccaaggccgaccuggagaacccucaccuccccgaaaaaaagaucacccaguggcuggagaccaaaggggucgagcggcugaagcgcauggcuaucagcggcgaugacugcguggugaagcccauugaugacagauucgccaacgcucuccuggcccuuaaugauaugggaaaaguucggaaggacaucccucaauggcagccgucuaaaggcuggcacgauuggcagcaggugcccuucuguucccaucacuuucaugaacugauuaugaaggacgggcgcaaacucgucgugccuugcagaccccaagacgagcugaucggacgggcucgcauuagccagggcgccggguggucucuuagagaaacagcgugucugggaaaggccuaugcucagauguggucccucauguacuuccaccggcgcgaucugagacuggccagcaacgccaucugcucugcuguuccugugcacuggguccccaccucccggacaacguggagcauucaugcccaccaucaauggaugaccacagaggacaugcucaccguguggaauagagucuggaucgaagauaacccuuggauggaggacaagacacccgugaccacgugggagaauguuccguaccugggcaaacgcgaagaucaguggugugggucccuuaucggccugaccagccgggcgacaugggcucagaacauuccuaccgccauccagcaagugagaucucucauuggaaaugaggaauuucuggacuauaugcccagcaugaagcgcuuccggaaagaggaggaauccgagggcgccaucugguga

SEQ ID NO: 20372 - RNA, 9873 nt, Artificial Sequence
  derived and/or modified CDS sequence (opt5) from DENV-3__JX669496__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaccaauauguguacacuuaucgcuauggaucugggggagaugugcgacgauaccgucacauacaaauguccgcauauuaccgaaguugagcccgaagacaucgauugcugguguaaccucacauccaccugggugacguauggaaccugcaaucaggccggcgagagacggcgcgacaagagaucuguggcccuggcuccucacgucgggaugggacuggauacacggacccaaacauggaugagcgccgagggcgcuuggcgccagguggaaaaaguugagaccugggcccucagacaucccggcuucacgauucuggcgcuuuuucuggcccacuacaucgggacaucccucacccagaagguggucaucuucauucugcuuaugcuggugacaccuucuaugaccaugcgguguguuggagugggcaaccgcgacuuugucgaagggcucagcggagcuaccuggguggaugugguccuggagcauggcgggugcguuacaacgauggccaagaauaaacccacccuggacaucgagcuccagaagacagaagcuacccaacuggccacacuuagaaaacuguguauugagggaaagaucaccaacauuacgacagauucccggugcccuacccagggcgaagcggugcucccggaggaacaggaccagaauuauguguguaaacacaccuacgucgaucgcggcugggggaacggaugcggccuguucgggaagggaagccuugugacaugcgccaaguuucaaugucuggagcccaucgagggcaaaguugugcaguaugaaaaucucaaguacaccgucauuaucacagugcacacgggggaccagcaucagguuggaaacgagacccaaggcgugacagcugaaaucaccccucaggccucuacaaccgaggcuauucugcccgaauauggcacgcuggggcucgagugcuccccuagaaccggacuggacuucaaugagaugauccuucugacaaugaaaaacaaggccuggaugguccaccggcagugguuuuucgaucucccccugccguggaccagcggcgccacaaccgaaacgccuacauggaaucgcaaagagcuucuggugaccuuuaagaacgcucaugcgaaaaagcaagaagucgugguucucgggucucaggagggagccaugcacacagcucugaccggcgccaccgaaauucagaauuccgggggcacaagcaucuucgccggacaccugaaguguagacucaaaauggacaagcuggagcuuaaaggcaugucuuacgcuaugugcgccaacacguuugugcugaagaaagaggucuccgaaacccagcaugggacaauucucaucaagguggaguaccggggagaagaugcgcccuguaagaucccuuucagcaccgaggacggccaagggaaagcucacaacggaagacugauuacagccaaucccguugugaccaagaaagaggaacccgucaacaucgaggccgaaccuccguucggcgaguccaauauugugaucgggauuggcgauaacgcucugaagaucaauugguauaaaaagggaucuagcaucggcaagauguuugaagccacggcucgcggggcccggagaauggcgauucuuggagacacagccugggauuucggcuccguggggggaguucucaacagccugggcaaaaugguccaucagaucuuugggucugcuuacaccgcccuguucuccggcgugagcugggugaugaagauuggaaucggcguccuccugaccuggauugggcuuaauucuaaaaacacaagcauguccuuuucuugcaucgcuauuggaaucaucacccuguaucucggcgccgugguucaggcggacauggggugugugauuaauuggaagggaaaagagcugaagugcggcagcgggaucuucgucacaaacgaggugcacacguggaccgaacaguacaaguuucaagccgauucccccaaacgccuggcuacagccauugcuggcgccugggagaauggaguuuguggcauccggagcaccacaagaauggaaaaccuucucuggaagcagauugccaaugagcugaacuauauccugugggaaaauaacaucaaacucaccguggucgugggggacauuaucggaguucuggagcagggcaagcgcacgcuuaccccucagcccauggagcugaaauacucuuggaagacaugggggaaagcuaagauugugaccgcggaaacacaaaacuccagcuucaucauugauggaccuaauacccccgagugcccgucugccucccgggcuuggaacgucugggaaguggaggacuauggcuuuggcguguucacaaccaauaucuggcucaagcugagagaagucuacacgcagcugugugaccaucgccuuaugagcgccgccguuaaagaugagcgggcugugcacgccgacaugggguacuggaucgagucccagaagaacggaucuuggaaacucgaaaaggcgagccugauugaggugaaaacaugcaccuggccuaagucccacacccuguggucuaauggcguccucgaaagcgauaugaucauucccaagucccuggcugggccuaucagccagcauaaccacagacccggauaucauacacaaaccgccggcccuuggcaccuugggaaacuggagcucgacuuuaauuacugcgagggaacgacagugguuauuaccgaaaacuguggcacacgcggccccucucugcggaccacaaccguguccgggaagcugauccacgaguggugcuguagaagcugcacgcuuccgccucuccgguauaugggagaagauggcuguugguacgggauggagauccgccccauuucugaaaaagaggagaauauggucaagucccuggugagcgccggaucuggcaaaguugacaacuucaccaugggggugcugugccucgcuauccuguuugaagaggucaugagaggaaaguucggcaagaaacauaugauugccggcgugcuuuucacauuuguucugcuccugagcgggcagaucaccuggcgggauauggcgcacacacugauuaugaucggauccaaugcuagcgacagaaugggcaugggggugaccuaucuugcccugauugccacguucaagauccagcccuuucucgcucugggauucuuucuccgcaaacugacaucucgggaaaaccuucugcucggcgucgggcuggccauggcuaccacacugcaacuuccugaggauaucgaacagauggccaauggaauugcgcugggccucauggcccugaagcucaucacccaguucgagaccuaccagcuguggacagcucuuauuucccugacguguagcaacaccauguuuacacucaccguggccuggagaacagcuacccugauccuggccggcgugucccuucugccggucugccaaucuagcuccaugcgcaaaacggacuggcuccccauggccguugcugcgaugggggugccuccccugccucucuucauuuuuucucugaaggauacacuuaagagacggagcuggccccugaaugagggagugauggccgucggccugguguccauccucgcuucuagccugcuucgcaacgacguuccuauggccgggccccugguggccggaggccuccugaucgcuuguuaugucauuaccgggaccuccgccgaucucacaguggaaaaagcggcugacaucaccugggaggaagaggccgaacagacaggaguuagccauaaccugaugauuacgguggacgaugacggcaccaugagaaucaaggaugacgagacagagaauauucuuaccguccugcugaaaacagcccuccugaucgugucuggcgucuucccguacuccaucccugcuacccuucugguguggcacacguggcagaagcagacccaacggagcgggguucucugggaugugcccucuccucccgaaacacagaaagccgagcuggaagagggagucuaccgcauuaagcagcagggcaucuuugggaaaacccaagugggaguuggcgugcagaaggagggggucuuccauacaauguggcacgugaccagaggagcggugcucacauauaacggcaagcggcuggaaccgaauugggcuuccguuaaaaaggaccuuauuagcuacggcgggggauggcgccugucugcccaguggcaaaaaggcgaggaaguccaggugaucgccguggagccugggaagaaccccaaaaauuuucagacgaugccuggaaccuuccagacaaccaccggcgaaauuggggcuaucgcccuggauuucaagcccggaacauccggcagccccauuaucaacagagagggcaaggucguggggcucuauggaaauggcguugugacgaaaaacgggggauacgucuccggcaucgcucaaaccaaugccgagccugacgggccgacacccgaacuggaggaagagauguuuaagaaacggaaccuuaccauuauggaucugcacccuggcagcggaaagacacgcaaauaucuccccgcgaucgugagagaagccauuaagcggagacugcgcacccucauccuggcuccuacgcggguuguggccgcugagauggaggaagcccuuaagggccugcccauuagauaccagacaaccgccaccaaaucugagcauacagggcgcgaaaucgucgaccugaugugccacgcuaccuucacaaugcggcuccugagcccugugagaguuccgaauuauaaccuuaucauuauggaugaggcgcauuuuaccgaccccgccuccaucgcugcccgcggauacauuucuacgcgggugggcaugggggaagccgcugccaucuucaugacagcgaccccucccggaacagcugaugccuuuccucagagcaaugcccccauucaggacgaggagagagacaucccggaacgcuccuggaacucuggcaaugaguggaucaccgauuucgcugggaagacggucugguuugugccuagcauuaaagccggcaacgacaucgcgaacugucugcggaagaauggaaaaaaggugauucaacucuccagaaagaccuucgauacagaauaccagaaaaccaagcugaacgacugggauuuugucguuacaaccgacaucucugagaugggcgccaauuucaaagcugaucgggugauugacccccgcagaugccugaagcccgugauccucacagaugggccugagcgggucauucuugccggacccaugccugugaccgcugccagcgcugcccagcgcagaggccggguugggagaaacccgcagaaagaaaaugaccaauauaucuuuacgggacagccccugaacaaugaugaggaccacgcgcauuggacagaagccaagaugcugcucgacaacaucaauaccccugagggcauuauccccgcucuguucgaaccugagcgcgagaaguccgccgcuauugauggggaauaccggcuuaaaggcgagagcagaaagaccuucguggaacugaugcgccggggagaccuccccgucuggcuggcccacaaaguggccucugagggcaucaaguauacagauagaaaauggugcuuugacgggcagcgcaacaaucagauucuggaagagaacauggauguugagaucuggaccaaggaaggagagaaaaagaagcuccggccgagauggcuugacgcucgcacauacuccgauccucuggcgcugaaagaauucaaggacuuugccgcuggcagaaaaagcaucgcccucgaucuggugacggagauugggcggguccccucucaccuugcccaucgcaccagaaaugcucuggacaaccucgugaugcugcacacauccgaacauggaggccgggccuaucgccacgcggucgaggagcugccugaaaccauggagacacuccuucugcugggccucaugauccugcuuaccgggggagccaugcuguuccucauuagcggcaaggggaucggaaaaacguccauuggccugaucugugugaucgcuucuagcgggaugcuguggauggccgaaauuccccuccaauggaucgcuuccgccauuguucuugaguuuuucaugauggugcugcugaucccugagcccgaaaagcagagaaccccgcaggauaaucaacucgcguacguggucauuggaauccugacacuugccgcuauuaucgccgcuaacgagaugggccugcucgaaaccacaaagcgggaccugggcaugagcaaagagccugggguugugucucccaccuccuaucuggauguggaccuccaccccgccagcgcuuggacgcuuuacgccgucgcgacaaccgugaucacaccuaugcugagacauaccauugaaaauucuaccgccaacguuagccuggcugccaucgcuaaccaggccgugguccucaugggacuggacaagggcuggccgauuuccaaaauggaucuuggggugccccugcucgcccugggaugcuacucucaggucaauccucugacacucacggcggcugugcuucugcugaucacccacuaugccauuaucggccccgggcuccaggcuaaggccacacgcgaggcccaaaaacggaccgcugccggaaucaugaagaacccuacaguugacggcauuaugaccaucgaucuggaccccgugauuuacgauagcaaguuugagaaacagcuuggccaggucaugcugcucgugcugugugcgguucagcugcuccuuaugagaacguccugggcccugugcgaagcucugacacucgccaccgggccuaucaccacacugugggagggaucuccgggcaaguucuggaauaccacaauugcugugagcauggccaacaucuuucgcggguccuaucuugcgggagccggccuggcuuucagcaucaugaaaucugucgggacgggaaagcggggcaccggcucccaaggggaaacacucggagagaaauggaagaagaaacugaaucagcugagcagaaaggaauuugaccucuacaaaaaguccggcauuaccgagguggaucggacagaggccaaagaagggcuuaagcgcggagagaucacccaucacgcugugucuagaggcagcgccaaacugcagugguucguugaacggaacauggucauucccgaggggcgcgugaucgaccugggauguggcagaggcgggugguccuauuacugcgcuggacucaagaaggugacggaaguccggggcuauaccaaagggggaccuggccaugaggagcccguuccuaugucuacauacggguggaauauugugaagcugaugagcggaaaagauguguuuuaccuucccccggaaaagugugacacccugcucugcgauaucggcgaguccagcccuucucccacagucgaagagucccgcaccauuagagugcugaaaaugguugagcccuggcugaagaacaaucaguucuguaucaaggugcucaacccuuauaugcccacagucaucgaacaccuugagcggcugcaacgcaaacacggcgggaugcuggugagaaauccucucagccggaacucuacccaugaaauguacuggauuuccaauggaacgggcaacaucguugccagcgugaauacagucucuagacugcuucugaaccgcuucaccaugacccaccggagaccgacaacggagaaggacguggaucucggggcgggaacccgccaugugaacgccgaacccgagacaccuaauauggacgucauuggcgagcggaucaaaagaauuaaggaagagcacaacagcaccuggcacuaugacgaugaaaaucccuacaaaacaugggcuuaucauggguccuacgagguuaaggccaccggaucugcuagcuccaugaucaacggcguggugaagcugcugacaaaaccuugggacgucgugcccaugguuacccagauggccaugacggauaccacaccguuuggccagcaacgcguguucaaggaaaaagucgacacccggacaccuagaagcaugcccgggacccgccgggugaugggaaucacggccgaguggcucuggagaacacugggccgcaauaagaaaccucggcuuugcaccagagaggaauuuacaaagaagguucgcaccaacgcggcuaugggggccguguucacggaggaaaaucagugggauuccgccaaagcugccgucgaggacgaagauuuuuggaagcugguggacagagagcgggagcuccacaaacugggaaaguguggcucuugcguuuauaacaugauggggaaacgcgaaaagaaacuuggcgaguucggaaaggcuaagggcagcagagccauuugguacauguggcugggggcgcgguaccucgaauuugaggcccugggauuccugaaugaggaucauugguuuuccagagaaaacucuuauagcggcguggagggggaaggacuccacaaacugggcuacauccuucgggacauuuccaagauccccgggggcgcuauguaugccgaugacaccgcuggaugggacacacgcauuaccgaggaugaccugcauaaugaagagaaaaucacacagcagauggauccugagcacagacaacucgccaacgcgaucuucaagcugaccuaccagaauaaagucgugaagguccagcggcccacaccgaccggcacggugauggacauuaucucucgcaaggaucagagagggagcggacaaguuggcacauaugggcuuaacaccuuuaccaauauggaagcccagcugauucggcagauggagggagaaggcgugcucuccaaagcugaccuggagaacccucaccugcccgaaaagaaaaucacacaguggcucgagaccaagggggucgagcgccugaaaagaauggccauuagcggcgaugacugcguggugaagcccaucgaugaccgguucgcuaacgcccuucuggcucucaaugauaugggaaagguucgcaaagacaucccucaauggcagccgucuaagggcuggcaugauuggcagcaggugcccuuuuguucccaccauuuccacgaacugauuaugaaagacgggagaaagcuugucgugccuugccggccccaagacgagcugaucggacgcgccagaauuagccagggcgcgggguggucucuccgggaaacagccugucugggaaaagcuuacgcccagauguggucccugauguauuuccaccgcagagaucuccggcuggccagcaacgcuaucugcucugccguuccugugcauuggguccccacguccagaaccacauggagcauucacgcgcaucaccaauggaugaccacagaggacaugcuuaccguguggaaucgcgucuggaucgaagauaacccuuggauggaggacaagacgcccgugaccacaugggagaauguuccguaccugggcaagcgggaagaucaguggugugggucccucauuggccugaccagcagagcuacaugggcccagaacaucccuaccgccauccagcaagugcgcucucuuauuggaaaugaggaauuucuggacuacaugcccagcaugaaacgguucagaaaggaggaggaauccgagggcgcuaucugguga

SEQ ID NO: 20373 - RNA, 9873 nt, Artificial Sequence
  derived and/or modified CDS sequence (opt5) from DENV-3__JX669490__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauuccgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccguggggggaguucucaacagccugggcaaaaugguccaucagauuuuugggucugccuacaccgcucuguucuccggcgugagcugggugaugaagaucggaauuggcguccuccugaccuggaucgggcuuaauucuaaaaacacaagcauguccuuuucuugcauugccaucggaaucauuacccuguaucucggcgcugugguucaggccgacauggggugugugaucaauuggaagggaaaagagcugaagugcggcagcgggauuuucgucacaaacgaggugcacacguggaccgaacaguacaaguuucaagcggauucccccaaacgccuggccacagcuaucgccggcgcuugggagaauggaguuuguggcauucggagcaccacaagaauggaaaaccuucucuggaagcagaucgccaaugagcugaacuauauccugugggaaaauaacauuaaacucaccguggucgugggggacaucauuggaguucuggagcagggcaagcgcacgcuuaccccucagcccauggagcugaaauacucuuggaagacaugggggaaagccaagaucgugaccgcugaaacacaaaacuccagcuucauuaucgauggaccuaauacccccgagugcccgucugcgucccgggccuggaacgucugggaaguggaggacuauggcuuuggcguguucacaaccaauaucuggcucaagcugagagaagucuacacgcagcugugugaccaucgccuuaugagcgcugccguuaaagaugagcgggccgugcacgcugacaugggguacuggauugagucccagaagaacggaucuuggaaacucgaaaaggccagccugaucgaggugaaaacaugcaccuggccuaagucccacacccuguggucuaauggcguccucgaaagcgauaugauuauccccaagucccuggcggggccuauuagccagcauaaccacagacccggauaucauacacaaaccgcuggcccuuggcaccuugggaaacuggagcucgacuuuaauuacugcgagggaacgacagugguuaucaccgaaaacuguggcacacgcggccccucucugcggaccacaaccguguccgggaagcugauccacgaguggugcuguagaagcugcacgcuuccgccucuccgguauaugggagaagauggcuguugguacgggauggagauucgccccaucucugaaaaagaggagaauauggucaagucccuggugagcgccggaucuggcaaaguugacaacuucaccaugggggugcugugccucgccauucuguuugaagaggucaugagaggaaaguucggcaagaaacauaugaucgcuggcguguucuuuacauucguucuucugcucagcgggcagauuaccuggcgggauauggcccacacacugaucaugauuggauccaaugcgagcgacagaaugggcaugggggugaccuaucuggcucuuaucgccacguuuaagauccagcccuuccuggcccucggauuuuuccugcgcaaacucacaucucgggaaaaccugcuucugggcgucgggcucgcuauggccaccacacugcaacugccugaggauauugaacagauggcuaauggaaucgcccuuggccugauggcgcucaagcugauuacccaguuugagaccuaccagcucuggacagcccugaucucccuuacguguagcaacaccauguucacacugaccguggcuuggagaacagccacccucauucuggcuggcgugucccugcuuccggucugccaaucuagcuccaugcgcaaaacggacuggcugcccauggccguugccgcuaugggggugccuccccucccucuguuuaucuucucucucaaggauacacugaagagacggagcuggccccuuaaugagggagugauggcggucggccugguguccauccuggccucuagccuccugcgcaacgacguuccuauggcugggccccuuguggccggaggccugcucauugccuguuaugucaucaccgggaccuccgcugaucugacaguggaaaaagccgcggacauuaccugggaggaagaggcugaacagacaggaguuagccauaaccucaugaucacgguggacgaugacggcaccaugagaauuaaggaugacgagacagagaauauccugaccguccuucugaaaacagcccugcucaucgugucuggcgucuuuccguacuccauuccugccacccugcuuguguggcacacguggcagaagcagacccaacggagcgggguucugugggaugugcccucuccucccgaaacacagaaagcugagcucgaagagggagucuaccgcaucaagcagcagggcauuuucgggaaaacccaagugggaguuggcgugcagaaggagggggucuuucauacaauguggcacgugaccagaggagccgugcugacauauaacggcaagcggcucgaaccgaauugggcguccguuaaaaaggaccugaucagcuacggcgggggauggcgccuuucugcucaguggcaaaaaggcgaggaaguccaggugauugccguggagccugggaagaaccccaaaaauuuccagacgaugccuggaaccuuccagacaaccaccggcgaaaucggggccauugcucuggauuuuaagcccggaacauccggcagccccaucaucaacagagagggcaaggucguggggcuguauggaaauggcguugugacgaaaaacgggggauacgucuccggcauugcccaaaccaaugcugagccugacgggccgacacccgaacucgaggaagagauguucaagaaacggaaccugaccaucauggaucuucacccuggcagcggaaagacacgcaaauaucugcccgccauugugagagaagcgaucaagcggagacuccgcacccugauucucgccccuacgcggguuguggcugccgagauggaggaagcucugaagggccuucccaucagauaccagacaaccgccaccaaaucugagcauacagggcgcgaaaucgucgaccugaugugccacgccaccuuuacaaugcggcugcucagcccugugagaguuccgaauuauaaccugauuaucauggaugaggcucauuucaccgaccccgcguccauugccgcucgcggauacaucucuacgcgggugggcaugggggaagccgccgcuauuuuuaugacagccaccccucccggaacagcggaugcuuucccucagagcaaugcccccauccaggacgaggagagagacaucccggaacgcuccuggaacucuggcaaugaguggauuaccgauuuugccgggaagacggucugguucgugccuagcaucaaagcuggcaacgacauugccaacugucuucggaagaauggaaaaaaggugauccaacuguccagaaagaccuuugauacagaauaccagaaaaccaagcucaacgacugggauuucgucguuacaaccgacauuucugagaugggcgcgaauuuuaaagccgaucgggugaucgacccccgcagaugccugaagcccgugauucugacagaugggccugagcgggucauccucgcuggacccaugccugugaccgccgcuagcgccgcucagcgcagaggccggguugggagaaacccgcagaaagaaaaugaccaauauaucuucacgggacagccccuuaacaaugaugaggaccacgcccauuggacagaagcgaagaugcugcuggacaacauuaauaccccugagggcaucauucccgcccucuucgaaccugagcgcgagaaguccgcugccaucgauggggaauaccggcugaaaggcgagagcagaaagaccuuuguggaacuuaugcgccggggagaccugcccgucuggcucgcucacaaaguggccucugagggcauuaaguauacagauagaaaauggugcuucgacgggcagcgcaacaaucagauccuggaagagaacauggauguugagaucuggaccaaggaaggagagaaaaagaagcugcggccgagauggcucgacgcccgcacauacuccgauccucuugcucugaaagaauuuaaggacuucgcggccggcagaaaaagcauugcucuggaucucgugacggagaucgggcggguccccucucaccuggcccaucgcaccagaaaugcccuugacaaccuggugaugcuccacacauccgaacauggaggccgggcuuaucgccacgccgucgaggagcugccugaaaccauggagacacugcuccuucugggccugaugauucuccugaccgggggagcgaugcuuuuucugaucagcggcaaggggauuggaaaaacguccaucggccucaucugugugauugccucuagcgggaugcuguggauggcugaaaucccccugcaauggauugccuccgcuaucguucucgaguucuuuaugauggugcuucugauuccugagcccgaaaagcagagaaccccgcaggauaaucaacuggccuacguggucaucggaauucucacacuggcggccaucaucgcugccaacgagaugggccuucuggaaaccacaaagcgggaccucggcaugagcaaagagccugggguugugucucccaccuccuaucuggauguggaccugcaccccgcuagcgccuggacgcucuacgcugucgccacaaccgugauuacaccuaugcuuagacauaccaucgaaaauucuaccgcgaacguuagccuggccgcuauugccaaccaggcugugguccugaugggacucgacaagggcuggccgaucuccaaaauggaucugggggugccccuucuggcccucggaugcuacucucaggucaauccucugacacugacggccgcggugcuccuucugauuacccacuaugcuaucaucggccccgggcugcaggccaaggcuacacgcgaggcccaaaaacggaccgccgcuggaauuaugaagaacccuacaguugacggcaucaugaccauugaucucgaccccgugaucuacgauagcaaguucgagaaacagcugggccaggucaugcuucuggugcucugugccguucagcugcugcucaugagaacguccugggcgcuuugcgaagcccugacacuggcuaccgggccuauuaccacacucugggagggaucuccgggcaaguuuuggaauaccacaaucgccgugagcauggcuaacaucuuccgcggguccuaucuggccggagcgggccuugccuuuagcauuaugaaaucugucgggacgggaaagcggggcaccggcucccaaggggaaacacugggagagaaauggaagaagaaacucaaucagcugagcagaaaggaauucgaccuguacaaaaaguccggcaucaccgagguggaucggacagaggcuaaagaagggcucaagcgcggagagauuacccaucacgccgugucuagaggcagcgcuaaacuucagugguuuguugaacggaacauggucauccccgaggggcgcgugauugaccugggauguggcagaggcgggugguccuauuacugcgccggacugaagaaggugacggaaguccggggcuauaccaaagggggaccuggccaugaggagcccguuccuaugucuacauacggguggaauaucgugaagcucaugagcggaaaagauguguucuaccugcccccggaaaagugugacacccuucugugcgauauuggcgaguccagcccuucucccacagucgaagagucccgcaccaucagagugcucaaaaugguugagcccuggcugaagaacaaucaguucuguaucaaggugcugaacccuuauaugcccacagucauugaacaccucgagcggcuucaacgcaaacacggcgggaugcuggugagaaauccucugagccggaacucuacccaugaaauguacuggaucuccaauggaacgggcaacauuguugcuagcgugaauauggucucuagacuccugcuuaaccgcuuuacaaugacccaccggagaccgaccaucgagaaggacguggaucugggggccggaacacgccaugugaacgcggaacccgagacgccuaauauggacgucauuggcgagcggaucaaaagaaucaaggaagagcacaacagcaccuggcacuaugacgaugaaaaucccuacaaaacaugggccuaucauggguccuacgagguuaaggcuaccggaucugccagcuccaugauuaacggcguggugaagcuccugacaaaaccuugggacgucgugcccaugguuacccagauggcuaugacagauaccacgccguucggccagcaacgcguguuuaaggaaaaagucgacacccggacaccuagaagcaugcccgggacccgccgggugaugggaaucacagccgaguggcuguggagaacccucggccgcaauaagaaaccucggcugugcacgagagaggaauucacaaagaagguucgcaccaacgccgcgaugggggcuguguuuacagaggaaaaucagugggauuccgccaaagccgcugucgaggacgaagauuucuggaagcuuguggacagagagcgggagcugcacaaacucggaaaguguggcucuugcguuuauaacaugauggggaaacgcgaaaagaaacugggcgaguuuggaaaggccaagggcagcagagcuauuugguacauguggcuuggggcccgguaccuggaauucgaggcgcucggauuucugaaugaggaucauugguucuccagagaaaacucuuauagcggcguggagggggaaggacugcacaaacucggcuacauccugcgggacauuuccaagauccccgggggcgccauguaugcugaugacaccgccggaugggacacgcgcaucaccgaggaugaccuucauaaugaagagaaaauuacacagcagauggauccugagcacagacaacuggcuaacgccaucuuuaagcucaccuaccagaauaaagucgugaagguccagcggcccacaccgaccggcacagugauggacauuaucucucgcaaggaucagagagggagcggacaaguuggcaccuaugggcugaacacguucacaaauauggaagcgcagcuuauucggcagauggagggagaaggcgugcuguccaaagccgaccucgagaacccucaccugcccgaaaagaaaaucacccaguggcuggagaccaagggggucgagcgccucaaaagaauggcuaucagcggcgaugacugcguggugaagcccauugaugaccgguuugccaacgcucugcuugcccugaaugauaugggaaagguucgcaaagacaucccucaauggcagccgucuaagggcuggcaugauuggcagcaggugcccuucuguucccaccauuuccacgaacucauuaugaaagacgggagaaagcuggucgugccuugccggccccaagacgagcuuaucggacgcgcuagaauuagccagggcgccggguggucucugcgggaaacagcgugucucggaaaagccuacgcucagauguggucccugauguauuuucaccgcagagaucugcggcucgccagcaacgccaucugcucugcuguuccugugcauuggguccccaccuccagaacaacguggagcauucacgcccaucaccaauggaugaccacagaggacaugcugaccguguggaaucgcgucuggaucgaagauaacccuuggauggaggacaagacacccgugaccacgugggagaauguuccguaccuuggcaagcgggaagaucaguggugugggucccugaucggccucaccagcagagcgacaugggcucagaacauuccuaccgccauccagcaagugcgcucucugauuggaaaugaggaauuccuugacuacaugcccagcaugaaacgguuuagaaaggaggaggaauccgagggcgccaucugguga

SEQ ID NO: 20374 - RNA, 9873 nt, Artificial Sequence
  derived and/or modified CDS sequence (opt5) from DENV-3__JN406515__SS-prME
accagccucugccucaugaugaugcugcccgccacccuugcuuuccaccugacgucccgggacggagagccucggaugaucguggggaagaacgaacgcggaaagucucuccuguuuaagaccgccagcggcauuaauauguguacacuuaucgcgauggaucugggggagaugugcgacgauaccgucaccuacaaguguccgcucauuaccgaaguugagcccgaagacaucgauugcugguguaaccugacauccaccugggugacguauggaaccugcaaucaggcuggcgagcaucggcgggacaagcgcucuguggcccuggccccucacgucgggaugggacucgauacacgggcucaaaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacgagcaaggcaaagcucauaacgggcgccugauuacagccaacccuguggucaccaagaaagaggaacccgugaauaucgaagccgagcccccuuuuggagaaucuaacauuaucauuggcaucggggauaaggcucuuaagaucaauugguacaaaaagggcagcuccauuggaaaaauguucgaggccacagcuagaggcgcccggagaauggcgauccucggggacaccgccugggauuuuggaagcgugggcgggguucugaacucucugggaaagaugguccaccagauuuucggcuccgcuuauacggcccucuuuagcggggugucuuggaucaugaaaauuggcaucggagugcugcuuacauggauuggccugaauagcaagaacaccuccaugucuuucagcugcaucgucaucgggauuaucacccucuaccugggagcugugguucaggccgacaugggcugugugauuaauuggaaggggaaagagcugaagugcggauccggcaucuuugucacaaacgaagugcauaccuggacagagcaguauaaauuccaagcggauagcccgaagcgccuugccacggcuauugccggggcuugggaaaauggcguuuguggaauccggucuaccacaagaauggagaaccuccuguggaaacagaucgccaaugaacugaacuacauucucugggagaauaacaucaagcugaccguggucgugggcgacauuaucgggguucuugagcagggaaaacgcacacugacaccccagccuauggaacucaaguauuccuggaagacguggggcaaagccaagauugugaccgcugagacacaaaauagcucuuuuaucaucgaugggcccaacaccccugaaugccccaacgcgucccgggccuggaaugucugggagguggaagacuacggauucggcguguuuacaaccaacauuuggcugaaacugagagagauguauacacagcuuugugaccaccgccucaugagcgcugccgucaaggaugagcgggccguucacgcugacaugggcuacuggaucgaaucccagaaaaaugggucuuggaagcuggagaaggccagccugauugaagugaaaaccugcacguggccgaagucccauacacucuggucuaacggagugcuggagagcgauaugaucauuccuaaaucccuugcgggccccaucagccagcacaauuacagaccuggguaucauacccaaaccgcuggacccuggcaccugggcaagcucgagcuggacuucaacuacugcgaagggacaaccgucgugaucacggagaauuguggaacacgcggcccuucucugcggaccacaaccguuuccggcaaacuuauucacgaauggugcuguagaagcugcacacugcccccgcugcgcuauaugggggaggauggauguugguacggcauggaaauccggccuauuaacgagaaggaggaaaauauggugaagucucuggucuccgccgggagcggaaaaguggacaacuuuaccaugggcguucucugccuggccauccuuuucgaggaagugaugagagggaaguucggcaagaagcauaugauugcuggcguccuguuuacguucgugcuccugcugucuggccagaucaccuggcgggauauggcccgcacacuuauuaugaucgggagcaaugcguccgacagaaugggaaugggcguuaccuaucuggcucucaucgccacauuuaaaauucagcccuuccuggcccucggguuuuuccugcggaaacuuaccagcagagagaaccugcuccugggagugggccuggcuauggccacgacacuucaacugcccgaagaugucgagcagauggcuaaugggaucgcccucggacugauggcgcucaagcugauuacccaguuugagacauaccagcuuuggaccgcccuggugucucucauguguuccaacaccaucuucacacugacgguggcuuggcgcaccgccacacugauucuugcuggcaucagccuguuuccugucugccaauccucuagcaugcggaaaaccgacuggcucccgaugacaguugccgccaugggcgugcccccucugccccucuucaucuuuucccugaaggauacccuuaaaagacgcucuuggccucugaaugaaggggugauggcugucggacuggugagcauucucgcguccucucugcuuagaaacgacguucccauggccggcccucugguggcugggggacuccugaucgccuguuaugucauuacgggcacaagcgccgaucucaccguggagaaggcugccgacguuaccugggaagaggaagcggagcagacaggggugucccacaaccugaugaucaccgucgacgaugacggaacaaugcggauuaaagaugacgagacggaaaauauccuuaccgugcugcugaagacagcucuccugaucgucagcggcauuuuccccuacucuaucccggccacccuucugguguggcauacauggcagaaacagacccaacgcuccggcguucucugggaugugccuucucccccugagacgcagaaggccgaacuggaggagggggucuacagaauuaagcagcagggaaucuuuggcaaaacccaaguggggguuggagugcagaaggaaggcgucuuccacacaauguggcaugugaccagaggggcugugcucacauauaacggaaaacgccuggagcccaauugggccuccguuaagaaagaccuuauuuccuacggcggcggguggagacugagcgcgcaguggcaaaagggagaagagguccaggugaucgcuguggaaccgggcaagaacccuaaaaauuuccagaccaugcccgggauuuuucagacaacgaccggagagaucggcgccaucgcccuggauuucaagccugggacaucuggaucccccauuaucaaccgggagggcaaagucgugggccucuaugggaauggaguugugaccaagaacggcggguacgucagcggaauugcucaaaccaaugccgaacccgacggcccuacaccggagcuggaagaggaaauguuuaaaaagcgcaaccuuacgaugauggaucugcaccccggguccggcaagaccagaaaauaucucccugcuaucgugcgggaggccauuaagcgcagacugcggacacucauccuggcgcccaccagaguuguggccgcugagauggaagaggcccuuaaaggacugccuauccgcuaccagacaaccgcuacaaagagcgaacacacgggcaaagagauugucgaccugaugugccaugccaccuucaccaugcggcuccugucucccgugagaguuccuaauuauaaccuuaucauuauggaugaagcccacuuuacagacccggcuagcaucgcggcccgcggguacauuuccacccgggugggaaugggcgaggcugccgccaucuucaugacagcuacacccccugggacggccgaugcguuuccccagucuaaugcuccuauccaggacgaggaaagagacauucccgagcgcagcuggaacuccggaaaugauuggaucacagacuucgccggcaagaccgucugguuugugccgucuauuaaggccgggaacgauaucgcuaacugucugcggaaaaauggcaagaaagugauucaacucagcagaaagacauucgacaccgaauaccagaaaacgaagcugaacgauugggacuuugucguuaccacagauaucuccgagaugggagccaauuucaaggcggaccgcgugauugauccucggagaugccugaaacccgugauccucaccgacggccccgagcgggucauccuugccgggccuaugcccgugacaguugcuucugccgcucagcgcagaggacgggugggccgcaacccucagaaggaaaaugaucaauauauuuucaccgggcagccgcugaacaaugacgaggaccaugcccacuggacagaagcuaaaaugcugcucgauaacaucaauacccccgagggaauuaucccugcccuguuugaacccgagagagaaaagagcgcggccauugacggcgaauaccggcuuaaaggggaguccagaaagacguucgucgaacugaugcgccggggcgaucucccuguguggcuggcucauaaaguugccagcgagggaaucaaguauacagacagaaaguggugcuuugauggcgaacgcaacaaucagauccuggaggagaacauggacguggaaauuuggaccaaagagggggaaaagaaaaagcuccggcccagauggcuugaugcucgcaccuacucugacccgcuggcccugaaagaguucaaggauuuugccgcuggacggaaguccaucgcgcucgaccuggucacagaaauuggcagagugccuagccaccuugcccaccgcaccagaaaugcucuggauaaccucgucaugcugcauacaucugagcacgggggacgggccuaucgccaugccguggaggaacugcccgagacgauggaaacccuccuucugcugggccucaugauccugcuuacaggcggggcuaugcuguuccucauuuccggaaaaggcguugggaagaccagcaucggacugaucugugugguggccuccucuggcaugcuguggauggcggacauuccucuccaguggaucgccagcgcuauuguccuugaguuuuucaugaugguucugcugauccccgagccugaaaaacaaagaacaccccaggauaaucagcucgccuacguggugauugggauccugacccuugcugccauugucgcggccaacgagaugggacugcucgaaacgaccaagcgggaccugggcauguccaaagagccgggcgugguuagcccuacaucuuaucuggacguggaucuccaccccgcuuccgccuggacccuuuacgcugucgccacaaccgugaucacgcccaugcugcgccacacaaucgaaaauagcaccgcuaacgucucucuggccgcgauugccaaccaagcugugguucucauggggcuggacaagggauggccuaucagcaagauggaucuuggcgugccgcugcucgcccuggggugcuacucccaggucaauccccugacacucaccgcugccgugcuucugcugguuacccauuaugccauuaucggaccuggccuccaggcgaaagcuacaagagaggcccagaagcggacggcugccgggauuaugaaaaaccccaccguggacggaaucaugacaaucgaucuggacccugucauuuacgauucuaaguuugagaaacaacuuggccaggugaugcugcucgugcugugugccguucagcugcuccuuaugagaaccagcugggcuuucugcgaagcccugacacuggcgaccggccccaucacgacacucugggagggguccccuggaaaguuuuggaauaccaccauugccgucucuauggcuaacaucuuccgcggcagcuaucuggccggggcuggacuugccuuuuccauuaugaaaagcgugggcacagggaaacggggaaccggcucucagggcgaaacacugggggagaaguggaaaaagaaacucaaucaacuguccagaaaggaguucgaccuguacaaaaagagcggaaucacggagguggaucgcaccgaggcgaaggaaggccucaaaagaggggaaaucacacaccaugccgucuccagaggaucugcuaaacuucagugguucguugaacggaacauggugauuccggagggccgcgugaucgaccugggguguggaagaggcggcuggagcuauuacugcgccgggcugaaaaaggucaccgaagugcggggauauacaaaaggcgggcccggacacgaggagccuguucccauguccaccuacggcuggaauauugugaagcucaugucugggaaggaugucuuuuaccugccucccgaaaaaugugacacgcuucugugcgauaucggagagagcuccccgagcccuaccguggaagagucucgcacaauuagaguucucaagaugguggagcccuggcugaaaaacaaucaguucuguaucaagguccugaaccccuauaugccuaccgugauugaacaucucgagcggcuucagcgcaaacacggcggcaugcuggugagaaauccccugucccggaacagcacacacgaaauguacuggaucucuaaugggaccggaaacaucgucuccagcguuaauauggugucucgccuccugcuuaacagauuuacaaugaccuaucggagaccuacgauugagaaggacguggaccugggcgcugggacacgccaugucaacgccgaaccggagacccccaauauggaugugaucggagagcggauuagacgcaucaaggaggagcacagcuccaccuggcauuacgacgaugaaaacccuuauaaaacaugggcuuaccacggcucuuaugagguuaaggccacggggagcgcguccagcaugauuaauggaguggucaaacuccugaccaagcccugggacgugguuccuacagugacccaaauggccaugacagauaccacacccuucggccagcagcgggucuuuaaagaaaagguggacaccagaacgccgaagccuaugcccggcacccgcaaaguuauggagaucacagcugaguggcuguggcggacccucgggagaaacaagcgcccucggcugugcacaagagaagaguucaccaaaaaggugcgcacgaaugccgcuaugggagccgucuuuacagaagagaaccaaugggauuccgcccgggcggcuguggaagacgaggaguucuggaaacuugucgauagagaacgcgagcugcacaagcucggcaaaugugggucuugcguguacaauaugaugggaaagagagaaaagaaacugggcgaguuugggaaggccaaaggcagccgggccaucugguacauguggcuuggagcucgcuaucuggaguucgaagcccucggcuuucugaacgaggaccauugguucuccagagaaaauucuuacagcgggguugagggagaaggccugcacaagcucggguauauucugcgggauaucuccaaaauucccggaggcgcuauguacgccgacgacaccgcggggugggauacaagaaucaccgaggacgaucuucauaacgaggaaaagauuacgcagcagauggacccugagcaccggcagcuggccaaugcuaucuuuaagcucaccuaucaaaacaaaguggucaaggugcagcgccccacaccgaaaggcaccgugauggauaucauuucuagaaaggaccagcggggaagcggccagguugggacauacggacugaauaccuucacaaacauggaagcccaacuuauccgccagauggagggcgaaggggugcuguccaaaaccgaucucgagaauccucaucugcuggagaagaagauuacgcaguggcucgaaacaaaaggagucgagagacugaagcggauggcuaucagcggcgacgauugcgugguuaaacccauugacgaucgcuucgccaacgcgcuucuggcccucaacgacauggggaaggugagaaaagauaucccccaguggcaaccuucuaagggcuggcacgacuggcagcaggucccguuuuguucccaccauuuccacgaacugaucaugaaggacggacggaaacuugugguccccugccgcccucaggaugagcugauuggcagagcucggaucagccaaggggccggauggucucucaaggaaaccgcuugucugggcaaagccuaugcucagaugugggcccugauguacuuucaucgcagagaccuccggcuggcguccaaugccauuugcagcgcugugcccguucacugggugccuaccucucgcacaaccugguccauccacgcccaucaccaguggaugacaacggaggauaugcuuaccgucuggaacagaguguggauugaggacaaucccuggauggaagauaaggccccuguuacaaccugggaggacgugcccuaccuggggaaacgggaagaucaaugguguggaagccucaucggccugacauccagagcuaccugggcccagaacauucuuacggcgauccagcagguccgcagccugaucgggaaugaggaguuccucgacuauaugccgucuaugaagcgguuuagaaaggaagaggaaagcgagggcgcuauuugguga

SEQ ID NO: 20375 - RNA, 9873 nt, Artificial Sequence
  derived and/or modified CDS sequence (opt5) from DENV-3__JN406514__SS-prME
accucccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacccuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuucuggaccuuccccugccguggaccagcggcgccacaaccgagcggccuacauggaaucgcaaagaacuccuggugaccuucaagaacgcccaugcuaaaaagcaagagguugugguccuggggucucaggaaggagcgaugcacacggcccucacaggcgcuaccgagauucaaaauuccgggggcacaagcaucuuugccggacaccugaaguguagacuuaaaauggauaagcuggaacucaaaggcaugucuuacgccaugugccugaacaccuucgugcugaagaaagagguuuccgagacccagcaugggacaauucuuaucaagguggaauacaagggagaggacgcucccuguaaaaucccuuuuagcacggaagauggccaagggaaggcccacaacggacggcucauuaccgcgaaucccgucgugaccaagaaggaggagcccgugaacaucgaagcugagccuccguucggcgaauccaauauuguuaucgggauuggcgacaaagcccugaagaucaacugguauaagaaaggaucuagcaucggcaagauguucgaggccaccgcuagaggggcccgccggauggcuauucugggagauacagccugggacuuuggcuccgucgggggagugcucaauagccugggcaaaauggugcaucagaucuucgggucugcguacaccgcccucuuuuccggcgucagcuggauuaugaagaucggaauuggcgugcugcucacguggaucgggcugaacucuaaaaauacaagcauguccuucucuugcauuguuaucggaaucauuacccuguaucuuggcgcugugguccaggccgauauggggugugugaucaacuggaagggaaaggaacucaaaugcggcagcgggauuuuuguuaccaaugaggugcacacauggaccgagcaguacaaguuccaagcugacucccccaaaagacuggccacagcgaucgccggcgcuugggaaaacggagucuguggcauucgcagcacgacccggauggagaaucugcucuggaagcagaucgccaacgaacugaauuauauccuuugggagaacaauauuaaacugacagugguugugggggauaccaucggaguccucgaacagggcaagagaacacugaccccucagcccauggagcugaaauacucuuggaagacgugggggaaggcuaaaauugugaccgccgagacacaaaacuccagcuuuaucauugacggaccuaacacccccgaaugcccgucugccucccgcgcuuggaaugugugggaggucgaagacuauggcuucggcguuuuuagcacaaacaucuggcuuaagcuccgggagguguacacccaguccugugaucauagacugaugucugcggccaucaaagacgaacgcgcugugcacgccgauaugggguacuggauugagagccagaagaauggauccuggaaacuggagaaggccucuuucaucgaagucaagacaugcauuuggccuaaaagccacacccucugguccaacggcgugcuggagagcgacaugaucauucccaagucucuugcugggccuaucucccagcauaaucaccggcccggauaucauacgcaaacagccggcccuuggcaccuggggaaacucgaacuggauuuuaacuacugcgagggaaccaccguugugaucacagagaauuguggcaccagaggccccagccugcgcacgacaaccgucucugggaaacuuauucacgaauggugcugucgguccugcacacucccgccucugagauauaugggagaggacggcuguugguacgggauggaaauccggcccauuaacgagaaagaagagaauaugguuaagagccuggugucugcgggaagcggcaagguggauaacuucaccauggggguccucugccuggcuauccuuuuugaggaagugaugcgcggaaaauucggcaagaaacauaugauugccggcguucuguucacauuugugcuccugcuguccgggcagaucaccuggagagacauggcccacacgcuuauuaugaucggaagcaaugcuucugaucggaugggcaugggggucaccuaucuggcccucaucgcgacauucaagauucagcccuuucuggcucucggauucuuucugagaaaacuuaccucccgcgagaaccugcuccugggcguggggcuggccauggccacaacccuucaacugccugaagacaucgagcagauggcuaauggaauugcccucggccugaugacgcucaagcugaucacacaguucgaaaccuaccagcuuuggacagcucuggugagccucaccuguuccaacaccauuuuuacacugacggucgccuggcggaccgcgacacugauccuugccggcguuucucugcucccgcugugccaaagcuccucuaugagaaagaccgauuggcuccccaugacaguggcugccaugggggugccuccccugccucuuuucaucuuuagccugaaagacacccccaagcgcagauccuggccucugaaugagggagucauggcugugggccucguuucuauucuggccagcucccuucugcggaacgaugugcccauggccgggccgcucgucgcuggaggccugcucaucgcguguuaugugauuacggggacaagcgccgaccugaccguugagaaagcugccgacgugaccugggaagaggaagccgagcagacaggagucucucauaaccuuaugaucaccguggaugacgauggcacaaugcgcauuaaggacgaugaaacggagaauauccugaccguccugcucaaaacagcucugcuuaucguguccggcauuuucccuuacagcauccccgccacccugcucguuuggcacacauggcagaagcagacccaaagaucuggggugcugugggacgucccuucucccccggagacgcagaaagcggaacucgaggaaggaguguaccggauuaagcagcagggcaucuuugggaagacccaaguuggagugggcguccagaaagaggggguguuccauacaauguggcacgugacccgcggagcuguucugacacacaacggcaagagacuugagccuaauugggccagcgucaaaaaggaucugauuagcuauggcgggggauggcggcuguccgcccaguggcaaaaaggcgaagagguccaggugaucgcugucgaacccgggaagaacccuaagaauuuucagaccaugcccggaauuuuccagacaacgaccggcgagaucggggccaucgcgcucgacuucaaacccggaacaagcggcuccccuauuaucaaccgcgaaggcaaggugguugggcuguacggaaauggcguggucaccaaaaacgggggauaugugagcggcauugcucaaaccaaugccgagccggaugggcccacaccugagcuugaagaggaaauguuuaagaaaagaaaccugacgaucauggaccuccaucccggcucuggaaagacccggaaguaccugccugccauuguucgcgaggcuaucaaaagacggcucagaacacugauccuugcccccacccgcguggucgcugccgaaauggaggaggcgcugaagggccugccuauucgguaucagacaaccgccacgaaaagcgaacacacagggagagagaucguggaucucaugugccaugcuaccuucaccaugcgccugcuuuccccgguucgggugcccaauuacaaccugauuaucauggacgaagcccacuuuacagauccugcuucuauugccgccagaggauauaucagcacccgcgucggcaugggggaggcugcggccaucuucaugacagcuacacccccuggaacggccgaagccuuuccccaguccaaugcuccgauucaggacgaggagcgggacaucccugaaagaucuuggaacagcggcaaugaguggauuacagauuucguggggaagaccgugugguuuguccccuccaucaaagccggcaacgacauugcgaacugucuccgcaagaauggaaagaaaguuauccaacugucucggaagacauucgauaccgaauaccagaaaacgagacugaacgacugggauuuuguggugaccacagacauuagcgagaugggcgcuaauuucaaggccgaucgggucaucgacccccgcagaugccucaaaccugugauccuuaccgaugggcccgagcggguuauucuggccggaccuaugccggugacagcugccuccgcggcccagcgcagaggccgggucgggagaaacccccagaaggaaaaugaccaauacaucuuuaccggacagccucugaacaaugaugaggaccaugcucacuggacagaagccaagaugcuccuggacaacauuaauacccccgagggcaucauuccugcucuuuucgaacccgagcgcgagaaaagcgccgcuaucgauggggaauaucggcugaagggcgagucuagaaaaacguucguggaacucaugcgccggggagaccugccgguuuggcuggcccacaagguggcguccgagggcaucaaauacacagauagaaaguggugcuuugacggggaacgcaacaaucagauucucgaggagaacauggaugucgaaaucuggaccaaagagggagaacggaagaaacuuagaccucgcuggcuggacgccagaaccuauagcgauccccuggcucucaaagaguucaaggacuuugccgcuggccggaaaucuauugcccuggaucuugugacagaaaucgggcgcgucccuucccaucuggcccacagaacccggaaugcucucgacaaccuggugaugcugcauacaagcgagcacggaggccgcgcguacagacacgccguugaggaacuccccgagacgauggaaacccuucugcugcucggccugaugauucuucugacagggggagcuaugcuuuuccugaucuccggcaaggggaucggaaaaaccucuauuggccugaucugugugauugugagcuccgggaugcucuggauggccgaugucccucuucaguggaucgccagcgcuauuguucuggaguuuuucaugauggugcugcucauccccgagccggaaaagcaacggacaccucaggacaaucagcuggccuauguggucauuggaauccuuacccuggcggccaucguggcugccaacgagaugggccuccuggaaacgaccaagagagaucugggcaugucuaaagagcccgggguugugucccccacaagcuaccucgacgucgaccuucauccugcuucugccuggacccuguaugcgguggccacaaccgucauuacgccgaugcugcgccacacaaucgaaaauagcaccgcuaacgugucccucgccgcuauugccaaccaagcuguugugcugaugggacuugauaagggcuggcccaucucuaaaauggaccugggggucccucuccuggcccugggaugcuacagccaggugaauccccucacacuuaccgcggccguucugcugcucgugacccauuacgcuauuaucggcccugggcugcaggccaaggcuacacgggaggcccagaaaagaacggccgcgggaaucaugaagaaccccaccgucgauggcauuaugacaaucgaccuugauccugugauuuaugacuccaaguuugagaaacaacugggccaggugaugcuccugguucugugugcuguccagcuccuucugaugcgcaccucuugggcccugugcgaagcucucacacuggccaccgggccgaucacgacacuuugggagggaagccccggcaaguucuggaauaccaccauugccguguccauggcuaacaucuuucgggggagcuaccuggccggagcgggccucgccuucucuaucaugaaauccguggggacaggaagacggggcaccggcagccagggggaaacacugggagagaaguggaaaaagaagcugaaucaacucucccgcaaagaauuugaucuuuauaagaaaucuggcauuacggaggucgacagaaccgaggcuaaggaagggcugaaacggggagagacaacccaccaugccguuagccgcggcuccgcuaagcugcagugguucguggaaagaaacauggugaucccugaggggcgggucauugaucucggauguggccgcggcggguggucuuacuauugcgccggacugaaaaaggugacagaaguuagaggcuacaccaaaggcgggcccgggcacgaggagccugugcccaugagcacguauggguggaauaucgucaaacuuauguccggaaaggacguguuuuaccugccgccugaaaaaugugauacccuccugugcgacauuggcgagagcucucccucccccacaguugaagagagccggaccauccgcgugcugaagauggucgagccuuggcucaaaaacaaucaguucuguauuaaggugcuuaaccccuacaugccuacagugaucgaacaccuggagagacugcagcggaaguauggcgggaugcucgucagaaauccgcugucucgcaacuccacccaugaaauguacuggaucagcaauggaacaggcaacauuguuucuagcgugaauauggugucccggcuucugcucaacagauucaccaugacgcaccgccggcccacaaucgagaaagaugucgaccugggggcgggaaccagacaugugaacgccgaaccugagacccccaauauggacguuauuggcgagcgcaucaagcggauuaaagaggaacacucuagcacauggcacuaugaugacgaaaacccuuacaagacgugggcuuaucauggguccuacgaggugaaagccaccggaagcgcuuccucuaugaucaauggcgucgugaagcugcucacaaagcccugggauguugugccgauggucacccaaauggccaugacagacaccacaccuuuuggccagcagagaguguucaaagaaaagguugauacccgcacgccccggccuaugcccgggaccagaaaagugauggagaucacagcugaguggcuguggcgcacccuuggacggaacaagaaaccuagacugugcacacgcgaagaguuuaccaagaaggucagaacgaaugccgcgaugggcgccguguucacagaagagaaccaaugggacagcgcucgggccgcugucgaagaugaggaguuuuggaaacucguggaccgcgaaagagagcugcacaaacuugggaaauguggauccugcguuuauaauaugaugggcaagcgggagaagaagcugggggaguucggcaaagccaagggaucuagagccauuugguacauguggcucggcgcgcgguaccuggaguuugaagcucugggguuccucaacgaggaucauugguuuagccgcgaaaauuccuauucuggaguggagggcgaagggcugcacaaacuuggauacauccugagagacauuagcaaaauccccggcggggccauguaugccgaugacaccgcuggcugggacacacggauuaccgaggaugaccuccauaacgaggaaaagaucacgcagcagauggauccggagcacaaacagcuggccaaugcuaucuucaaacuuaccuaccaaaacaaagucgugaaggugcagcgcccuacacccaagggaaccguuauggacauuaucuccagaaaagaucagcggggcagcggacaggugggaacauauggccugaauaccuuuacaaacauggaagcccaacucguccgccagauggagggggaaggagugcugucuaaggcggaccuggagaauccccaccuccuggagaaaaagauuacccaguggcuugaaacgaaaggcguugagagacugaagcggauggccaucuccggggaugacugcguggucaagccuauugaugaccgcuucgcuaacgcccuccuggcucuuaacgauaugggcaaagugagaaaggacaucccgcaguggcaacccagcaaaggauggcaugauuggcagcaggucccuuuuuguucucaccauuuccacgaacugaucaugaaggacggccggaaacucgugguucccugccgcccucaggacgagcugauugggagagcccggaucucccaaggagcgggcuggagccugaaggaaacagccugucucgggaaggcuuacgcccagauguggucucugauguauuuccaccgcagagaucuucggcuggcuuccaaugccauuugcagcgcugugcccguccauugggugccuaccuccagaaccacauggagcauccacgcccaucaccaguggaugaccacagaggacaugcucacgguuuggaaccgcguguggauugaggauaaucccuggauggaagacaaaaccccggucacaaccugggaggaugugccuuaccugggaaagcgggaagaccaaugguguggcucucuuaucgggcugacaagcagagcgaccugggcccagaacauucucacggcuauccaacaggugcgcucccugaucggcgaugaggaguuucuggacuacaugcccucuaugaaacgguucagaaaggaagaggaaagcgagggagccauuugguga

SEQ ID NO: 20376 - RNA, 9873 nt, Artificial Sequence
  derived and/or modified CDS sequence (opt5) from DENV-3__KT726340__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcgugaucaccaaaaacgggggauaugucuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauccucgccccuacaagaguuguggcggccgagauggaagaggcucugaagggccuucccauucgcuaucagaccaccgccacaaaaucugaacauaccgggcgggagaucgucgaccugaugugccacgcuacauuuaccaugagacugcucagcccugugcgcguuccgaauuacaaccugauuaucauggaugaagcccauuucacggaccccgccuccauugcugcgcggggauacaucucuacaagagugggcaugggggaggccgcugccaucuuuaugaccgccacaccucccggaaccgcugaugccuucccucagagcaaugcgcccauucaggacgaggaacgcgacaucccggagcgguccuggaacucuggcaaugaauggauuacggauuuugcugggaagaccgucugguucgugccuagcaucaaagccggcaacgacauugccaacugucuuagaaagaauggcaaaaaggugauccaacugucccgcaagacauuugauaccgaguaucagaaaacaaagcucaacgacugggauuucgucguuaccacagacauuucugagaugggagcuaauuuuaaagccgaucgggugaucgaccccagacggugccugaagcccgugauccugaccgaugggccugaacgcgucauucucgcgggacccaugccugugacggccgcuagcgccgcucagagacggggccgcguugggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccgucuggcucgcucacaaaguggccucugaaggcaucaaguacaccgaucgcaaauggugcuucgacgggcagcggaacaaucagauucuggaggagaacauggauguugaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccucucaccuggcccauagaacacggaaugcucuugacaaccuggugaugcuccacaccuccgagcauggaggcaaggccuaccgccacgccgucgaggaacugccugagacaauggaaacccugcuccuucugggccugaugauucuccugacagggggagcuaugcuuuuucugaucagcggcaaagggaucggaaagaccuccauuggccucaucugugugauugccucuagcgggaugcuguggauggcggagaucccccugcaauggauugccuccgcuaucguucucgaguucuuuaugauggugcuucugauuccugaacccgagaagcagagaacaccgcaggauaaucaacuggccuauguggucaucggaauccucacccuggcugccauuaucgcggccaacgaaaugggccuucuggagacaaccaaacgggaccucggcaugagcaaggaaccugggguugugucucccacguccuaccuggauguggaccugcaccccgcuagcgccuggacacucuacgcugucgccaccacagugauuaccccuaugcuucgccauaccaucgaaaauucuacagcuaacguuagccuggccgcgauugccaaccaggcugugguccugaugggacucgacaaaggcuggccgaucuccaagauggaucugggggugccccuucuggcccucggaugcuauucucaggucaauccucugacgcugaccgcugccgugcuccuucugaucacacacuacgccauuaucggccccgggcugcaggcgaaagcuaccagagaggcccaaaagcggacagcugccggaauuaugaagaacccuaccguugacggcaucaugacgauugaucucgaccccgugaucuaugauagcaaauucgagaagcagcugggccaggucaugcuucuggugcucugugccguucagcugcugcucaugagaacauccugggcucuuugcgaggcccugacccuggcgaccgggccuaucacaacccucugggaaggaucuccgggcaaauuuuggaauacaacgauugccgugagcauggcuaacaucuuccgcggguccuaccuggccggagcuggccuugccuuuagcauuaugaagucugucgggaccggaaaacggggcacaggcucccaaggggagacccugggagaaaaguggaagaaaaagcucaaucagcugagcagaaaagaguucgaccuguauaagaaauccggcaucacagagguggaucgcaccgaagcgaaggaggggcucaaacggggagaaauuacgcaucacgccgugucuagaggcagcgcuaaacuucagugguuuguugagcggaacauggucauccccgaagggcgcgugauugaccugggauguggcagaggcgggugguccuacuauugcgccggacugaagaaagugaccgagguccggggcuacacaaaagggggaccuggccaugaggaacccguuccuaugucuaccuacggguggaauaucgugaaacucaugagcggaaaggauguguucuaucugcccccggagaaaugugacacacuucugugcgauaucggcgaauccagcccuucucccaccgucgaggagucccgcacaauuagagugcucaagaugguugaacccuggcugaagaacaaucaguucuguaucaaagugcugaacccuuacaugcccaccgucguggagcaccucgaacggcuucaacgcaagcacggcgggaugcugguuagaaauccucugagccggaacucuacgcaugagauguauuggauuuccaauggaacaggcaacaucguggcuagcgucaauauggugucucgccuccugcuuaacagauuuaccaugacccaccggagaccgacaauugaaaaagacguggaucugggggccggaacgcgccaugucaacgcugagcccgagaccccuaauauggacguuaucggcgaacggaucaagagaauuaaagaggaacacaacagcacauggcacuacgacgaugagaaucccuauaagaccugggccuaccauggguccuaugaagugaaggcgacaggaucugccagcuccaugaucaacggcguggucaaacuccugaccaagccuugggacgugguucccauggugacacagauggcuaugaccgauacgaccccguucggccagcaacgcgucuuuaaagagaagguggacacacggaccccuagaagcaugcccgggacacgccggguuaugggaauuaccgccgaguggcuguggagaacgcucggccgcaauaaaaagccucggcugugcacaagagaagaguucaccaagaaagugcgcacaaacgcugccaugggggccgucuuuaccgaagagaaucagugggauuccgcgaaggcugccguggaagacgaggauuucuggaaacuuguugaccgggagagagaacugcacaagcucggaaaauguggcucuugcguguacaacaugauggggaagcgcgagaaaaagcugggcgaauuuggaaaggccaaaggcagcagagcuaucugguacauguggcuuggggcccgguaucuggaguucgaggcucucggauuucugaaugaagaucauugguucucccgcgagaacucuuacagcggcgucgaaggggagggacugcacaagcucggcuauauucugagagacaucuccaaaauccccgggggcgccauguacgcggaugacacggccggaugggacacccggauuacagaagaugaccuucauaaugaggagaagaucacccagcagauggauccugaacacagacaacuggcuaacgccauuuuuaaacucacauaucagaauaagguggucaaggugcagcggcccaccccgacaggcaccguuauggacaucauuucucgcaaagaucagagagggagcggacaagugggcacguacgggcugaacacauucaccaauauggaggcucagcuuauccggcagauggaaggagagggcguccuguccaaggccgaccucgaaaacccucgccugcccgagaaaaagaucacccaguggcuggagacaaaagggguggaaagacucaagcggauggcgauuagcggcgaugacugcgugguuaagcccaucgaugaccgcuuugccaacgcucugcuugcccugaaugauaugggaaaagugagaaaggacauuccucaauggcagccgucuaaaggcuggcacgauuggcagcagguccccuucuguucccaucacuuccaugagcucaucaugaaggacgggcggaaacuggugguuccuugccgcccccaagacgaacuuauuggacgggcucggaucagccagggcgccggguggucucugcgcgagaccgcuugucucggaaaggccuaugcgcagauguggucccugauguacuuucacagacgggaucugcgccucgccagcaacgcuauuugcucugccgugccuguccacugggugcccacauccagaacgaccuggagcauccaugcccaccaucaauggaugacaaccgaagacaugcugacagucuggaaucggguguggaucgaggauaacccuuggauggaggacaagacccccauuacgaccugggaaaauguuccguaccuuggcaaaagagaggaucaguggugugggucccugaucggccucacaagccgcgcuaccugggcccagaacauuccuacagcgauccagcaagugcggucucugauuggaaaugaagaguuccuugacuauaugcccagcaugaagagauuucgcaaagaggaagaguccgaaggcgcuaucugguga

SEQ ID NO: 20377 - RNA, 9873 nt, Artificial Sequence
  derived and/or modified CDS sequence (opt5) from DENV-3__KT726345__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucauuugggaggaagaggcggaacagaccggagugagccacaaccucaugaucacagucgacgaugacggcacgaugcggaucaaagaugacgagaccgagaauauucugacagugcuucugaagaccgcucugcucaucgucucuggcauuuuuccguacuccaucccugccacacugcuuguguggcauaccuggcagaaacagacgcaacgcagcgggguucugugggaugugcccucuccucccgaaacccagaaggccgagcucgaagagggagucuacagaauuaaacagcagggcaucuucgggaagacacaagugggaguuggcgugcagaaggagggggucuuucacaccauguggcacgugacacggggagcugugcugacccauaacggcaaacgccucgaaccgaauugggccuccguuaagaaagaccugauuagcuauggcgggggauggagacuuucugcgcaguggcaaaagggcgaggaaguccaggugaucgcuguggagccugggaaaaaccccaagaauuuccagacaaugccuggaacguuccagaccacaaccggcgaaaucggggccauugcccuggauuuuaagcccggaaccuccggcagccccaucauuaaccgggagggcaaagucguggggcuguacggaaauggcguugugacaaagaacgggggauaugucuccggcaucgcucaaacgaaugccgagccugacgggccgacccccgaacucgaggaagagauguucaaaaagcgcaaccugacaauuauggaucuucacccuggcagcggaaaaaccagaaaguaccugcccgcuaucgugcgggaagccaucaagcgcagacuccggacacugauucucgcgccuaccagaguuguggccgcugagauggaggaagcccugaaaggccuucccauccgcuaucagacgacagcuaccaagucugagcauaccgggcgggaaauugucgaccugaugugccacgccacauuuaccaugagacugcucagcccugugcgcguuccgaauuacaaccugaucauuauggaugaggcccauuucacagaccccgcuuccaucgcggcccggggauauaucucuaccagagugggcaugggggaagcugccgccauuuuuaugacggcuacaccucccggaaccgccgaugcguucccucagagcaaugcucccauccaggacgaggagcgcgacauuccggaacgguccuggaacucuggcaaugaguggaucacagauuuugccgggaaaaccgucugguucgugccuagcauuaaggccggcaacgacaucgcuaacugucuucgcaaaaauggaaagaaggugauucaacuguccagaaaaacguuugauaccgaauaccagaagacaaaacucaacgacugggauuucgucguuaccacagacaucucugagaugggcgccaauuuuaaggcggaucgggugaucgaccccagacggugccugaaacccgugauucugaccgaugggccugagcgcgucauccucgccggacccaugccugugacagcugccagcgcugcccagagacggggccgcguugggagaaacccgcagaaggaaaaugaccaauacauuuucaccggacagccccuuaacaaugaugaggaccacgcucacuggacggaagccaagaugcugcuggacaacaucaauacaccugagggcauuauccccgcccucuucgaaccugagcgggagaaauccgccgcuaucgauggggaauauagacugaagggcgagagccgcaaaaccuuuguggaacuuaugcggagaggagaccugcccgucuggcucgcccauaagguggcuucugagggcauuaaauacaccgaucgcaaguggugcuucgacgggcagcggaacaaucagauccuggaagagaacauggauguugagauuuggacaaaagaaggagagaagaagaaacugagaccgcgcuggcucgacgcccggaccuauuccgauccucuugcccugaaggaauuuaaagacuucgcugcgggcagaaagagcaucgcccuggaucucgugacagagauugggcgcguccccucucaccuggcucauagaacgcggaaugcccuugacaaccuggugaugcuccacaccuccgaacacggaggccgcgccuacagacaugcugucgaggagcugccugaaacaauggagacccugcuccuucugggccugaugauccuccugacagggggagccaugcuuuuucugaucagcggcaaagggauuggaaagaccuccaucggccucauuugugugaucgcgucuagcgggaugcuguggauggccgaaauuccccugcaauggaucgcuuccgccauuguucucgaguucuuuaugauggugcuucugaucccugagcccgaaaagcagcggacgccgcaggauaaucaacuggcuuauguggucaucggcauucucacccuggccgcgaucauugccgcuaacgagaugggccuucuggaaacaaccaaacgcgaccucggcaugagcaaggagccugggguugugucucccacauccuaccuggauguggaccugcaccccgccagcgcuuggacccucuaugccgucgcuacgacagugaucaccccuaugcuuagacauacaauugaaaauucuaccgccaacguuagccuggcggccaucgcuaaccaggccgugguccugaugggacucgacaaaggcuggccgaucuccaagauggaucugggggugccccuucuggcucucggaugcuacucucaggucaauccucugacccugacagccgccgugcuccuucugauuacgcacuacgcgaucauuggccccgggcugcaggcuaaagccacccgggaggcucaaaagagaacagccgccggaaucaugaagaacccuaccguugacggcauuaugacaaucgaucucgaccccgugaucuaugauagcaaauucgagaagcagcugggccaggucaugcuucuggugcucugugcuguucagcugcugcucaugcgcaccuccugggcccuuugcgaagcgcugacgcuggccacagggccuauuaccacccucugggagggaucuccgggcaaauuuuggaauacaaccaucgcugugagcauggccaacauuuuccggggguccuaccuggcuggagccggccuugcguuuagcaucaugaagucugucgggacaggaaaaagaggcacgggcucccaaggggaaacccugggagagaaguggaagaaaaagcucaaucagcugagccgcaaagaguucgaccuguauaagaaauccggcauuacagagguggaucggaccgaggccaaggaagggcucaaaagaggagagaucacacaucacgcugugucucggggcagcgccaaacuucagugguuuguugaacgcaacauggucauucccgaggggagagugaucgaccugggauguggccggggcgggugguccuacuauugcgcuggacugaagaaagugaccgaaguccgcggcuacacgaaagggggaccuggccacgaggagcccguuccuaugucuaccuauggguggaauaucgugaaacucaugagcggaaaggauguguucuaccugcccccggaaaaaugugacacacuucugugcgauauuggcgaguccagcccuucucccaccgucgaagaguccagaacaauccgggugcucaagaugguugagcccuggcugaagaacaaucaguucuguauuaaagugcugaacccuuacaugcccaccgucaucgaacaucucgagcgccuucaaagaaagcacggcgggaugcuggugcggaauccucugagccgcaacucuacacaugaaauguauuggauuuccaauggaaccggcaacaucguugccagcgugaauauggucucuagacuccugcuuaaccgguuuacgaugacacacagacgcccgaccaucgagaaagacguggaucugggggcuggaacccggcacgugaacgccgaacccgagacaccuaauauggacgucauuggcgagagaaucaagcgcauuaaagaagaacacaacagcacguggcacuacgacgaugaaaaucccuauaagaccugggcguaccauggguccuaugagguuaaggccacaggaucugcuagcuccaugaucaacggcguggugaaacuccugaccaagccuugggacgucgugcccaugguuacacagauggccaugaccgauacaaccccguucggccagcaacggguguuuaaagaaaaggucgacacgagaaccccucgcagcaugcccgggacacggagagugaugggaauuaccgcugaguggcuguggcgcacacucggccggaauaaaaagccuagacugugcacccgcgaggaguucacgaagaaaguucggacaaacgccgccaugggggcgguguuuaccgaggaaaaucagugggauuccgcuaaggccgccgucgaggacgaagauuucuggaaacuuguggacagagagcgcgagcugcacaagcucggaaaauguggcucuugcguuuacaacaugauggggaagagagagaagaagcugggcgaguuuggaaaggcuaaaggcagccgggccaucugguauauguggcuuggggcucgcuaccuggaguucgaggcccucggauuucugaaugaggaucauugguucuccagagaaaacucuuacagcggcguggagggggaaggacugcacaagcucggcuauauccugcgggacauuuccaaaauccccgggggcgcgauguacgccgaugacacagcuggaugggacaccagaauuacggaggaugaccuucacaaugaagagaagaucacccagcagauggauccugagcaucggcaacuggccaacgcuauuuuuaaacucacauaucagaauaaggucgugaagguccagcgccccaccccgacaggcaccgugauggacaucaucucuagaaaagaucagcgggggagcggacaaguuggcacauacgggcugaacaccuucacgaauauggaagcccagcuuauucgccagauggagggagaaggcgugcuguccaaggcggaccucgagaacccucaucugcccgagaagaagaucacacaguggcuggagaccaaaggggucgagagacucaagcggauggccauuagcggcgaugacugcguggugaagcccaucgaugaccgcuuugcuaacgcccugcuugcucugaaugauaugggaaaaguuagaaaggacauuccucaauggcagccgucuaaaggcuggcaugauuggcaacaggugcccuucuguucccaccacuuccaugaacucaucaugaaggacgggcggaaacuggucgugccuugccgcccccaagacgagcuuauuggacgggcccggaucagccagggcgcuggguggucucugcgcgaaaccgccugucucggaaaggcguaugcccagauguggucccugauguacuuucacagacgggaucugcgccucgcuagcaacgccaucugcucugccguuccugugcauuggguccccacauccagaaccacauggagcauucacgcucaucaccaauggaugacgaccgaggacaugcugacaguguggaaucgggucuggaucgaagauaacccuuggauggaggacaagacccccgugacaaccugggagaauguuccguaucuuggcaaaagagaagaucaguggugugggucccugauuggccucacgagccgcgccaccugggcgcagaacaucccuacagcuauucagcaagugcggucucugaucggaaaugaggaguuccuugacuacaugcccagcaugaagagauuucgcaaagaggaggaauccgagggcgccaucugguga

SEQ ID NO: 20378 - RNA, 9873 nt, Artificial Sequence
  derived and/or modified CDS sequence (opt5) from DENV-3__KT726349__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagucuauccugaccgugcuucugaagacagcucugcucauugucuccggcaucuuuccguacagcauuccugccacccugcuuguguggcauacguggcagaaacagacccaacgcucugggguucugugggaugugcccuccccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacacauaauggcaaacgccucgaaccgaacugggccagcguuaagaaagaccugaucucuuauggcgggggauggagacuuuccgcgcaguggcaaaagggcgaggaaguccaggugauugcuguggagccugggaaaaaucccaagaacuuccagacgaugccuggaaccuuccagacaaccaccggcgaaaucggggccaucgcccuggauuuuaagcccggaacaagcggcucccccauuaucaaucgggagggcaaagucguggggcuguacggaaacggcguugugacgaagaaugggggauaugucagcggcauugcucaaaccaacgccgagccugacgggccgacacccgaacucgaggaagagauguucaaaaagcgcaaucugaccaucauggaucuucacccuggcucuggaaaaacaagaaaguaccugcccgcuauugugcgggaagccaucaagcgcagacuccggacccugauccucgcgccuacgagaguuguggccgcugagauggaggaagcccugaaaggccuucccauucgcuaucagacaaccgcuaccaagagcgagcauacagggcgggaaaucgucgaccugaugugccacgccaccuuuacaaugagacugcucuccccugugcgcguuccgaacuacaaucugauuaucauggaugaggcccauuucaccgaccccgcuucuauugcggcccggggauauaucagcacgagagugggcaugggggaagcugccgccaucuuuaugacagcuaccccucccggaacagccgaugcguucccucaguccaacgcucccauucaggacgaggagcgcgacaucccggaacggucuuggaauagcggcaacgaguggauuaccgauuuugccgggaaaacggucugguucgugccuuccaucaaggccggcaaugacauugcuaacugucuucgcaaaaacggaaagaaggugauccaacugucuagaaaaaccuuugauacagaauaccagaagaccaaacucaaugacugggauuucgucguuacaaccgacauuagcgagaugggcgccaacuuuaaggcggaucgggugaucgaccccagacggugccugaaacccgugauccugacagaugggccugagcgcgucauucucgccggacccaugccugugaccgcugccuccgcugcccagagacggggccgcguugggagaaauccgcagaaggaaaacgaccaauacaucuucacgggacagccccuuaauaacgaugaggaccacgcucacuggacagaagccaagaugcugcuggacaauauuaacaccccugagggcaucauucccgcccucuucgaaccugagcgggagaaaagcgccgcuaucgauggggaauauagacugaagggcgagucucgcaaaaccuuuguggaacuuaugcggagaggagaccugcccgucuggcucgcccauaagguggcuuccgagggcaucaaauacacagaucgcaaguggugcuucgacgggcagcggaauaaccagauucuggaagagaauauggauguugagaucuggaccaaagaaggagagaagaagaaacugagaccgcgcuggcucgacgcccggacauauagcgauccucuugcccugaaggaauuuaaagacuucgcugcgggcagaaagucuauugcccuggaucucgugacggagaucgggcgcguccccucccaccuggcucauagaacccggaacgcccuugacaaucuggugaugcuccacacaagcgaacacggaggccgcgccuacagacaugcugucgaggagcugccugaaaccauggagacacugcuccuucugggccugaugauucuccugaccgggggagccaugcuuuuucugaucuccggcaaagggaucggaaagacgucuauuggccucaucugugugauugcgagcuccgggaugcuguggauggccgaaaucccccugcaauggauugcuagcgccaucguucucgaguucuuuaugauggugcuucugauuccugagcccgaaaagcagcggaccccgcaggauaaccaacuggcuuauguggucaucggaauccucacacuggccgcgauuaucgccgcuaaugagaugggccuucuggaaaccacaaaacgcgaccucggcaugucuaaggagccugggguugugucccccaccagcuaccuggauguggaccugcaccccgccucugcuuggacgcucuaugccgucgcuacaaccgugauuacaccuaugcuuagacauaccaucgaaaacagcaccgccaauguuucccuggcggccauugcuaaccaggccgugguccugaugggacucgacaaaggcuggccgaucucuaagauggaucugggggugccccuucuggcucucggaugcuacagccaggucaacccucugacacugacggccgccgugcuccuucugaucacccacuacgcgauuaucggccccgggcugcaggcuaaagccacacgggaggcucaaaagagaaccgccgccggaauuaugaagaauccuacaguugacggcaucaugaccauugaucucgaccccgugaucuaugauuccaaauucgagaagcagcugggccaggucaugcuucuggugcucugugcuguucagcugcugcucaugcgcacgucuugggcccuuugcgaagcgcugacacuggccaccgggccuaucaccacacucugggagggaagcccgggcaaauuuuggaacaccacaauugcuguguccauggccaauaucuuccgggggagcuaccuggcuggagccggccuugcguuuucuauuaugaaguccgucgggacgggaaaaagaggcaccggcagccaaggggaaacacugggagagaaguggaagaaaaagcucaaccagcugucccgcaaagaguucgaccuguauaagaaaucuggcaucaccgagguggaucggacagaggccaaggaagggcucaaaagaggagagauuacccaucacgcugugagccggggcuccgccaaacuucagugguuuguugaacgcaauauggucauccccgaggggagagugauugaccugggauguggccggggcggguggucuuacuauugcgcuggacugaagaaagugacggaaguccgcggcuacaccaaagggggaccuggccacgaggagcccguuccuaugagcacauauggguggaacaucgugaaacucauguccggaaaggauguguucuaccugcccccggaaaaaugugacacccuucugugcgauaucggcgagagcucuccuucccccacagucgaagagagcagaaccauucgggugcucaagaugguugagcccuggcugaagaauaaccaguucuguaucaaagugcugaauccuuacaugcccacagucauugaacaucucgagcgccuucaaagaaagcacggcgggaugcuggugcggaacccucugucucgcaauuccacccaugaaauguauuggaucagcaacggaacgggcaauauuguugccucugugaacauggucagcagacuccugcuuaaucgguuuacaaugacccacagacgcccgaccaucgagaaagacguggaucugggggcuggaacacggcacgugaacgccgaacccgagacgccuaacauggacgucaucggcgagagaauuaagcgcaucaaagaagaacacaauuccaccuggcacuacgacgaugaaaaccccuauaagacaugggcguaccaugggucuuaugagguuaaggccaccggaagcgcuuccagcaugauuaauggcguggugaaacuccugacaaagccuugggacgucgugcccaugguuacccagauggccaugacagauaccacgccguucggccagcaacggguguuuaaagaaaaggucgacaccagaacaccucgcuccaugcccgggacccggagagugaugggaaucacagcugaguggcuguggcgcacccucggccggaacaaaaagccuagacugugcacgcgcgaggaguucacaaagaaaguucggaccaaugccgccaugggggcgguguuuacagaggaaaaccagugggauucugcuaaggccgccgucgaggacgaagauuucuggaaacuuguggacagagagcgcgagcugcacaagcucggaaaauguggcagcugcguuuacaauaugauggggaagagagagaagaagcugggcgaguuuggaaaggcuaaaggcucccgggccauuugguauauguggcuuggggcucgcuaccuggaguucgaggcccucggauuucugaacgaggaucauugguucucuagagaaaauagcuacuccggcguggagggggaaggacugcacaagcucggcuauauccugcgggacaucucuaaaauucccgggggcgcgauguacgccgaugacaccgcuggaugggacacgagaaucaccgaggaugaccuucacaacgaagagaagauuacacagcagauggauccugagcaucggcaacuggccaaugcuaucuuuaaacucaccuaucagaacaaggucgugaagguccagcgccccacaccgaccggcacagugauggacauuaucagcagaaaagaucagcggggguccggacaaguuggcaccuacgggcugaauacguucacaaacauggaagcccagcuuauccgccagauggagggagaaggcgugcugagcaaggcggaccucgagaauccucaucugcccgagaagaagauuacccaguggcuggagaccaaaggggucgagagacucaagcggauggccaucucuggcgaugacugcguggugaagcccauugaugaccgcuuugcuaacgcccugcuugcucugaacgauaugggaaaaguuagaaaggacaucccucaauggcagccguccaaaggcuggcaugauuggcaacaggugcccuucuguagccaccacuuccaugaacucauuaugaaggacgggcggaaacuggucgugccuugccgcccccaagacgagcuuaucggacgggcccggauuucucagggcgcuggguggucccugcgcgaaacagccugucucggaaaggcguaugcccagauguggagccugauguacuuucacagacgggaucugcgccucgcuucuaaugccaucugcuccgccguuccugugcauuggguccccaccagcagaacaacgugguccauccacgcucaucaccaauggaugaccacagaggacaugcugaccguguggaaccgggucuggauugaagauaauccuuggauggaggacaagacacccgugaccacgugggagaacguuccguaucuuggcaaaagagaagaucaguggugugggagccugaucggccucaccucucgcgccacaugggcgcagaauauuccuaccgcuauccagcaagugcggagccugauuggaaacgaggaguuccuugacuacaugcccuccaugaagagauuucgcaaagaggaggaaucugagggcgccaucugguga

SEQ ID NO: 20379 - RNA, 9873 nt, Artificial Sequence
  derived and/or modified CDS sequence (opt5) from DENV-3__KT726347__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucuggccaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugaccaacgagguucauacauggacggaacaguacaaauuucaagcggauucccccaagcggcuggccaccgcuaucgccggcgcuugggagaauggaguguguggcauuagaagcacaacccgcauggaaaaccuucucuggaaacagaucgccaaugagcugaacuauauccugugggaaaauaacauuaagcucacagucgugguuggggacaucauuggagugcuggagcagggcaaacggacccuuacgccucagcccauggagcugaaguacucuuggaaaaccugggggaaggccaagaucgucacagcugaaacccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaaccaucgccccggauaucacacccaaacagcuggcccuuggcaccuugggaagcuggagcucgacuuuaauuacugcgagggaaccacgguugugaucacagaaaacuguggcacccggggccccucucugagaacaaccacagucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgccggaucuggcaagguggacaacuucacgauggggguccugugccucgccauucuguuugaagaggugaugcggggaaaguucggcaaaaagcacaugaucgcuggcguuuucuuuaccuucgugcuucugcucagcgggcagauuacauggcgcgauauggcccauacccugaucaugauuggauccaaugcgagcgacagaaugggcaugggggucacauaucuggcucuuaucgccaccuuuaaaauccagcccuuccuggcccucggauuuuuccugcggaagcucacgucuagagaaaaccugcuucugggcguggggcucgcuauggccacaacccugcaacugccugaggauauugaacagauggcuaauggaaucgcccuuggccugauggcgcucaaacugauuacacaguuugagaccuaccagcucuggaccgcccugaucucccuuacauguagcaacacgauuuucacccugacaguggcuuggcgcaccgccacacucauccuggcuggcgucucccugcuuccgguuugccaaucuagcuccaugcggaagaccgacuggcugcccauggccguggccgcuaugggggugccuccccucccucuguuuaucuucucucucaaggauacgcugaaaagacgcagcuggccccuuaaugagggagucauggcggugggccugguuuccauucuggccucuagccuccugagaaacgacgugccuauggcugggccccuugucgccggaggccugcucaucgccuguuaugugauuacagggaccuccgcugaucugaccguugaaaaggccgcggacaucacaugggaggaagaggcugaacagaccggagugagccacaaccucaugauuacagucgacgaugacggcacgaugcggaucaaagaugacgagaccgagaauauccugacagugcuucugaagaccgcccugcucauugucucuggcaucuuuccguacuccauuccugccacacugcuuguguggcauaccuggcagaaacagacgcaacgcagcgggguucugugggaugugcccucuccucccgaaacccagaaggcugagcucgaagagggagucuacagaaucaaacagcagggcauuuucgggaagacacaagugggaguuggcgugcagaaggagggggucuuucacaccauguggcacgugacacggggagccgugcugacccauaacggcaaacgccucgaaccgaauugggcguccguuaagaaagaccugaucagcuauggcgggggauggagacuuucugcucaguggcaaaagggcgaggaaguccaggugauugccguggagccugggaaaaaccccaagaauuuccagacaaugccuggaacguuccagaccacaaccggcgaaaucggggccaucgcucuggauuuuaagcccggaaccuccggcagccccauuaucaaccgggagggcaaagucguggggcuguacggaaauggcguugugacaaagaacgggggauaugucuccggcauugcccaaacgaaugcugagccugacgggccgacccccgaacucgaggaagagauguucaaaaagcgcaaccugacaaucauggaucuucacccuggcagcggaaaaaccagaaaguaccugcccgccauugugcgggaagcgaucaagcgcagacuccggacacugauccucgccccuaccagaguuguggcugccgagauggaggaagcucugaaaggccuucccauucgcuaucagacgacagccaccaagucugagcauaccgggcgggaaaucgucgaccugaugugccacgccacauuuaccaugagacugcucagcccugugcgcguuccgaauuacaaccugauuaucauggaugaggcucauuucacagaccccgcguccauugccgcucggggauauaucucuaccagagugggcaugggggaagccgccgcuaucuuuaugacggccacaccucccggaaccgcggaugcuuucccucagagcaaugcccccauucaggacgaggagcgcgacaucccggaacgguccuggaacucuggcaaugaguggauuacagauuuugccgggaaaaccgucugguucgugccuagcaucaaggcuggcaacgacauugccaacugucuucgcaaaaauggaaagaaggugauccaacuguccagaaaaacguuugauaccgaauaccagaagacaaaacucaacgacugggauuucgucguuaccacagacauuucugagaugggcgcgaauuuuaaggccgaucgggugaucgaccccagacggugccugaaacccgugauccugaccgaugggccugagcgcgucauucucgcuggacccaugccugugacagccgcuagcgccgcucagagacggggccgcguugggagaaacccgcagaaggaaaaugaccaauacaucuucaccggacagccccuuaacaaugaugaggaccacgcccacuggacggaagcgaagaugcugcuggacaacauuaauacaccugagggcaucauucccgcccucuucgaaccugagcgggagaaauccgcugccaucgauggggaauauagacugaagggcgagagccgcaaaaccuuuguggaacuuaugcggagaggagaccugcccgucuggcucgcucauaagguggccucugagggcaucaaauacaccgaucgcaaguggugcuucgacgggcagcggaacaaucagauucuggaagagaacauggauguugagaucuggacaaaagaaggagagaagaagaaacugagaccgcgcuggcucgacgcccggaccuauuccgauccucuugcucugaaggaauuuaaagacuucgcggccggcagaaagagcauugcucuggaucucgugacagagaucgggcgcguccccucucaccuggcccauagaacgcggaaugcccuugacaaccuggugaugcuccacaccuccgaacacggaggccgcgcuuacagacaugccgucgaggagcugccugaaacaauggagacccugcuccuucugggccugaugauucuccugacagggggagcgaugcuuuuucugaucagcggcaaagggaucggaaagaccuccauuggccucaucugugugauugccucuagcgggaugcuguggauggcugaaaucccccugcaauggauugccuccgcuaucguucucgaguucuuuaugauggugcuucugauuccugagcccgaaaagcagcggacgccgcaggauaaucaacuggccuauguggucaucggaauccucacccuggcggccauuaucgcugccaacgagaugggccuucuggaaacaaccaaacgcgaccucggcaugagcaaggagccugggguugugucucccacauccuaccuggauguggaccugcaccccgcuagcgccuggacccucuaugcugucgccacgacagugauuaccccuaugcuuagacauacaaucgaaaauucuaccgcgaacguuagccuggccgcuauugccaaccaggcugugguccugaugggacucgacaaaggcuggccgaucuccaagauggaucugggggugccccuucuggcccucggaugcuacucucaggucaauccucugacccugacagccgcggugcuccuucugaucacgcacuacgcuauuaucggccccgggcugcaggccaaagcuacccgggaggcccaaaagagaacagccgcuggaauuaugaagaacccuaccguugacggcaucaugacaauugaucucgaccccgugaucuaugauagcaaauucgagaagcagcugggccaggucaugcuucuggugcucugugccguucagcugcugcucaugcgcaccuccugggcgcuuugcgaagcccugacgcuggcuacagggccuaucaccacccucugggagggaucuccgggcaaauuuuggaauacaaccauugccgugagcauggcuaacaucuuccggggguccuaccuggccggagcgggccuugccuuuagcauuaugaagucugucgggacaggaaaaagaggcacgggcucccaaggggaaacccugggagagaaguggaagaaaaagcucaaucagcugagccgcaaagaguucgaccuguauaagaaauccggcaucacagagguggaucggaccgaggcuaaggaagggcucaaaagaggagagauuacacaucacgccgugucucggggcagcgcuaaacuucagugguuuguugaacgcaacauggucauccccgaggggagagugauugaccugggauguggccggggcgggugguccuacuauugcgccggacugaagaaagugaccgaaguccgcggcuacacgaaagggggaccuggccacgaggagcccguuccuaugucuaccuauggguggaauaucgugaaacucaugagcggaaaggauguguucuaccugcccccggaaaaaugugacacacuucugugcgauaucggcgaguccagcccuucucccaccgucgaagaguccagaacaauucgggugcucaagaugguugagcccuggcugaagaacaaucaguucuguaucaaagugcugaacccuuacaugcccaccgucauugaacaucucgagcgccuucaaagaaagcacggcgggaugcuggugcggaauccucugagccgcaacucuacacaugaaauguauuggaucuccaauggaaccggcaacauuguugcuagcgugaauauggucucuagacuccugcuuaaccgguuuacgaugacacacagacgcccgaccaucgagaaagacguggaucugggggccggaacccggcacgugaacgcggaacccgagacaccuaauauggacgucaucggcgagagaauuaagcgcaucaaagaagaacacaacagcacguggcacuacgacgaugaaaaucccuauaagaccugggccuaccauggguccuaugagguuaaggcuacaggaucugccagcuccaugauuaacggcguggugaaacuccugaccaagccuugggacgucgugcccaugguuacacagauggcuaugaccgauacaaccccguucggccagcaacggguguuuaaagaaaaggucgacacgagaaccccucgcagcaugcccgggacacggagagugaugggaaucaccgccgaguggcuguggcgcacacucggccggaauaaaaagccuagacugugcacccgcgaggaguucacgaagaaaguucggacaaacgccgcgaugggggcuguguuuaccgaggaaaaucagugggauuccgccaaggccgcugucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggcuauuugguauauguggcuuggggcccgcuaccuggaguucgaggcgcucggauuucugaaugaggaucauugguucuccagagaaaacucuuacagcggcguggagggggaaggacugcacaagcucggcuauauccugcgggacaucuccaaaauucccgggggcgccauguacgcugaugacacagccggaugggacaccagaaucacggaggaugaccuucacaaugaagagaagauuacccagcagauggauccugagcaucggcaacuggcuaacgccaucuuuaaacucacauaucagaauaaggucgugaagguccagcgccccaccccgacaggcaccgugauggacauuaucucuagaaaagaucagcgggggagcggacaaguuggcacauacgggcugaacaccuucacgaauauggaagcgcagcuuauccgccagauggagggagaaggcgugcuguccaaggccgaccucgagaacccucaucugcccgagaaaaagauuacacaguggcuggagaccaaaggggucgagagacucaagcggauggcuaucagcggcgaugacugcguggugaagcccauugaugaccgcuuugccaacgcucugcuugcccugaaugauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcucggauuagccagggcgccggguggucucugcgcgaaaccgcgugucucggaaaggccuaugcucagauguggucccugauguacuuucacagacgggaucugcgccucgccagcaacgccaucugcucugcuguuccugugcauuggguccccacauccagaaccacauggagcauccacgcccaucaccaauggaugacgaccgaggacaugcugacaguguggaaucgggucuggauugaagauaacccuuggauggaggacaagacccccgugacaaccugggagaauguuccguaucuuggcaaaagagaagaucaguggugugggucccugaucggccucacgagccgcgcgaccugggcucagaacauuccuacagccauccagcaagugcggucucugauuggaaaugaggaguuccuugacuacaugcccagcaugaagagauuucgcaaagaggaggaauccgagggcgccaucugguga

SEQ ID NO: 20380 - RNA, 9873 nt, Artificial Sequence
  derived and/or modified CDS sequence (opt5) from DENV-3__KT726352__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacacauaacggcaaacgccucgaaccgaauugggccuccguuaagaaagaccugaucagcuauggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguacggaaauggcguugugacgaagaacgggggauaugucuccggcauugcucaaaccaaugccgagccugacgggccgacacccgaacucgaggaagagauguucaaaaagcgcaaccugaccaucauggaucuucacccuggcagcggaaaaacaagaaaguaccugcccgcuauugugcgggaagccaucaagcgcagacuccggacccugauccucgcgccuacgagaguuguggccgcugagauggaggaagcccugaaaggccuucccauucgcuaucagacaaccgcuaccaagucugagcauacagggcgggaaaucgucgaccugaugugccacgccaccuuuacaaugagacugcucagcccugugcgcguuccgaauuacaaccugauuaucauggaugaggcccauuucaccgaccccgcuuccauugcggcccggggauauaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauacaucuucacgggacagccccuuaacaaugaugaggaccacgcucacuggacagaagccaagaugcugcuggacaacauuaauaccccugagggcaucauucccgcccucuucgaaccugagcgggagaaauccgccgcuaucgauggggaauauagacugaagggcgagagccgcaaaaccuuuguggaacuuaugcggagaggagaccugcccgucuggcucgcccauaagguggcuucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcccggacauauuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacacggaggccgcgccuacagacaugcugucgaggagcugccugaaaccauggagacacugcuccuucugggccugaugauucuccugaccgggggagccaugcuuuuucugaucagcggcaaagggaucggaaagacguccauuggccucaucugugugauugcgucuagcgggaugcuguggauggccgaaaucccccugcaauggauugcuuccgccaucguucucgaguucuuuaugauggugcuucugauuccugagcccgaaaagcagcggaccccgcaggauaaucaacuggcuuauguggucaucggaauccucacacuggccgcgauuaucgccgcuaacgagaugggccuucuggaaaccacaaaacgcgaccucggcaugagcaaggagccugggguugugucucccaccuccuaccuggauguggaccugcaccccgccagcgcuuggacgcucuaugccgucgcuacaaccgugauuacaccuaugcuuagacauaccaucgaaaauucuaccgccaacguuagccuggcggccauugcuaaccaggccgugguccugaugggacucgacaaaggcuggccgaucuccaagauggaucugggggugccccuucuggcucucggaugcuacucucaggucaauccucugacacugacggccgccgugcuccuucugaucacccacuacgcgauuaucggccccgggcugcaggcuaaagccacacgggaggcucaaaagagaaccgccgccggaauuaugaagaacccuacaguugacggcaucaugaccauugaucucgaccccgugaucuaugauagcaaauucgagaagcagcugggccaggucaugcuucuggugcucugugcuguucagcugcugcucaugcgcacguccugggcccuuugcgaagcgcugacacuggccaccgggccuaucaccacacucugggagggaucuccgggcaaauuuuggaauaccacaauugcugugagcauggccaacaucuuccggggguccuaccuggcuggagccggccuugcguuuagcauuaugaagucugucgggacgggaaaaagaggcaccggcucccaaggggaaacacugggagagaaguggaagaaaaagcucaaucagcugagccgcaaagaguucgaccuguauaagaaauccggcaucaccgagguggaucggacagaggccaaggaagggcucaaaagaggagagauuacccaucacgcugugucucggggcagcgccaaacuucagugguuuguugaacgcaacauggucauccccgaggggagagugauugaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuacaugcccacagucauugaacaucucgagcgccuucaaagaaagcacggcgggaugcuggugcggaauccucugagccgcaacucuacccaugaaauguauuggaucuccaauggaacgggcaacauuguugccagcgugaauauggucucuagacuccugcuuaaccgguuuacaaugacccacagacgcccggcuaucgagaaagacguggaucugggggccggaacccggcacgugaacgcggaacccgagacaccuaauauggacgucaucggcgagagaauuaagcgcaucaaagaagaacacaacagcacguggcacuacgacgaugaaaaucccuauaagaccugggccuaccauggguccuaugagguuaaggcuacaggaucugccagcuccaugauuaacggcguggugaaacuccugaccaagccuugggacgucgugcccaugguuacacagauggcuaugaccgauacaaccccguucggccagcaacggguguuuaaagaaaaggucgacacgagaaccccucgcagcaugcccgggacacggagagugaugggaaucaccgccgaguggcuguggcgcacacucggccggaauaaaaagccuagacugugcacccgcgaggaguucacgaagaaaguucggacaaacgccgcgaugggggcuguguuuaccgaggaaaaucagugggauuccgccaaggccgcugucgaggacgaagauuucuggaaacuuguggacagagagcgcgagcugcacaagcucggaaaauguggcucuugcguuuacaacaugauggggaagagagagaagaagcugggcgaguuuggaaaggccaaaggcagccgggcuauuugguauauguggcuuggggcccgcuaccuggaguucgaggcgcucggauuucugaaugaggaucauugguucuccagagaaaacucuuacagcggcguggagggggaaggacugcacaagcucggcuauauccugcgggacaucuccaaaauucccgggggcgccauguacgcugaugacacagccggaugggacaccagaaucacggaggaugaccuucacaaugaagagaagauuacccagcagauggauccugagcaucggcaacuggcuaacgccaucuuuaaacucacauaucagaauaaggucgugaagguccagcgccccaccccgacaggcaccgugauggacauuaucucuagaaaagaucagcgggggagcggacaaguuggcacauacgggcugaacaccuucacgaauauggaagcgcagcuuauccgccagauggagggagaaggcgugcuguccaaggccgaccucgagaacccucaucugcccgagaagaagauuacacaguggcuggagaccaaaggggucgagagacucaagcggauggcuaucagcggcgaugacugcguggugaagcccauugaugaccgcuuugccaacgcucugcuugcccugaaugauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcucggauuagccagggcgccggguggucucugcgcgaaaccgcgugucucggaaaggccuaugcucagauguggucccugauguacuuucacagacgggaucugcgccucgccagcaacgccaucugcucugcuguuccugugcauuggguccccacauccagaaccacauggagcauccacgcccaucaccaauggaugacgaccgaggacaugcugacaguguggaaucgggucuggauugaagauaacccuuggauggaggacaagacccccgugacaaccugggagaauguuccguaucuuggcaaaagagaagaucaguggugugggucccugaucggccucacgagccgcgcgaccugggcucagaacauuccuacagccauccagcaagugcggucucugauuggaaaugaggaguuccuugacuacaugcccagcaugaagagauuucgcaaagaggaggaauccgagggcgccaucugguga

SEQ ID NO: 20381 - RNA, 9873 nt, Artificial Sequence
  derived and/or modified CDS sequence (opt5) from DENV-3__KT726356__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuucuggcuggaggccuccugaucgccuguuaugucauuaccgggaccuccgccgaucucacaguggaaaaggcugccgacaucaccugggaggaagaggcggaacagacaggaguuagccacaaccugaugauuacgguggacgaugacggcaccaugcggaucaaagaugacgagacagagaauauccuuaccguccugcugaagacagcucuccugauugugucuggcaucuuuccguacuccauuccugccacccuucuggucuggcauacguggcagaaacagacccaacgcagcggggugcucugggauguucccucuccucccgaaacacagaaggccgagcuggaagagggaguguacagaaucaaacagcagggcauuuucgggaagacccaagucggagugggcguucagaaggaggggguguuucacacaauguggcacgucacccggggagcugugcucacacauaacggcaaacgccuggaaccgaauugggccuccgugaagaaagaccuuaucagcuauggcgggggauggagacugucugcgcaguggcaaaagggcgaggaaguucaggucauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaaguggucgggcucuacggaaauggcgugguuacgaagaacgggggauauguguccggcauugcucaaaccaaugccgagccugacgggccgacacccgaacuggaggaagagauguucaaaaagcgcaaccuuaccaucauggaucugcacccuggcagcggaaaaacaagaaaguaccuccccgcuauuguccgggaagccaucaagcgcagacugcggacccucauccuggcgccuacgagagugguugccgcugagauggaggaagcccuuaaaggccugcccauucgcuaucagacaaccgcuaccaagucugagcauacagggcgggaaaucguggaccugaugugccacgccaccuuuacaaugagacuccugagcccuguccgcgugccgaauuacaaccuuauuaucauggaugaggcccauuucaccgaccccgcuuccauugcggcccggggauauaucucuacgagaguuggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggugugguucgucccuagcaucaaggccggcaacgacauugcuaacugucugcgcaaaaauggaaagaaggugauccaacucuccagaaaaaccuuugauacagaauaccagaagaccaaacugaacgacugggauuucguggucacaaccgacauuucugagaugggcgccaauuuuaaggcggaucggguuaucgaccccagacggugccugaaacccgugauccucacagaugggccugagcgcgugauucuugccggacccaugccugucaccgcugccagcgcugcccagagacggggccgcguggggagaaacccgcagaaggaaaaugaccaauacaucuucacgggacagccccugaacaaugaugaggaccacgcucacuggacagaagccaagaugcugcucgacaacauuaauaccccugagggcaucauucccgcgcuguucgaaccugagcgggagaaauccgccgcuaucgauggggaauauagacuuaagggcgagagccgcaaaaccuuuguugaacugaugcggagaggagaccuccccguguggcuggcccauaaggucgcuucugagggcaucaaauacacagaucgcaaguggugcuucgacgggcagcggaacaaucagauucuggaagagaacauggauguggagaucuggaccaaagaaggagagaagaagaaacucagaccgcgcuggcuugacgcccggacauauuccgauccucuggcccugaaggaauuuaaagacuucgcugcgggcagaaagagcauugcccucgaucugguuacggagaucgggcgcgugcccucucaccuugcucauagaacccggaaugcccuggacaaccucgucaugcugcacacauccgaacacggaggccgcgccuacagacaugcuguggaggagcugccugaaaccauggagacacuccuucugcugggccucaugauucugcuuaccgggggagccaugcuguuucucaucagcggcaaagggaucggaaagacguccauuggccugaucugugucauugcgucuagcgggaugcuguggauggccgaaaucccccuccaauggauugcuuccgccaucgugcuugaguucuuuaugaugguucugcugauuccugagcccgaaaagcagcggaccccgcaggauaaucaacucgcuuauguggugaucggaauccugacacuugccgcgauuaucgccgcuaacgagaugggccugcucgaaaccacaaaacgcgaccugggcaugagcaaggagccuggggucguuucucccaccuccuaccuggauguggaccuccaccccgccagcgcuuggacgcuuuaugccguggcuacaaccgucauuacaccuaugcugagacauaccaucgaaaauucuaccgccaacgugagccuggcggccauugcuaaccaggccguugugcucaugggacuggacaaaggcuggccgaucuccaagauggaucuuggggucccccugcucgcucugggaugcuacucucaggugaauccucugacacucacggccgccguccuucugcugaucacccacuacgcgauuaucggccccgggcuccaggcuaaagccacacgggaggcucaaaagagaaccgccgccggaauuaugaagaacccuacaguggacggcaucaugaccauugaucuggaccccguuaucuaugauagcaaauucgagaagcagcuuggccaggugaugcugcucguccugugugcugugcagcugcuccuuaugcgcacguccugggcccugugcgaagcgcugacacucgccaccgggccuaucaccacacugugggagggaucuccgggcaaauuuuggaauaccacaauugcuguuagcauggccaacaucuuccggggguccuaccuugcuggagccggccuggcguuuagcauuaugaagucuguggggacgggaaaaagaggcaccggcucccaaggggaaacacucggagagaaguggaagaaaaagcugaaucagcugagccgcaaagaguucgaccucuauaagaaauccggcaucaccgaggucgaucggacagaggccaaggaagggcuuaaaagaggagagauuacccaucacgcugugucucggggcagcgccaagcugcagugguuuguggaacgcaacaugguuauccccgaggggagagucauugaccugggauguggccggggcgggugguccuacuauugcgcuggacucaagaaagugacggaagugcgcggcuacaccaaagggggaccuggccacgaggagcccgucccuaugucuacauauggguggaauaucguuaaacugaugagcggaaaggauguguucuaccuucccccggaaaaaugugacacccugcucugcgauaucggcgaguccagcccuucucccacaguggaagaguccagaaccauucggguccugaagaugguggagcccuggcugaagaacaaucaguucuguaucaaaguucucaacccuuacaugcccacagugauugaacaucuugagcgccugcaaagaaagcacggcgggaugcugguccggaauccucucagccgcaacucuacccaugaaauguauuggaucuccaauggaacgggcaacauuguggccagcguuaauauggugucuagacugcuucugaaccgguuuacaaugaccuacagacgcccgaccaucgagaaagacgucgaucucggggcuggaacacggcacgugaacgccgaacccgagacgccuaauauggacgugaucggcgagagaauuaagcgcaucaaagaagaacacaacagcaccuggcauuaugacgaugaaaaucccuacaagacaugggcguaucacggguccuacgaggucaaggccaccggaucugcuagcuccaugauuaacggcguugugaaacugcugacaaagccuugggacgugguccccauggugacccagauggccaugacagauaccacgccguucggccagcaacggguuuuuaaagaaaagguggacaccagaacaccucgcagcaugcccgggacccggagagucaugggaaucacagcugaguggcucuggcgcacccugggccggaauaaaaagccuagacuuugcacgcgcgaggaguucacaaagaaagugcggaccaacgccgccaugggggcgguuuuuacagaggaaaaucagugggauuccgcuaaggccgccguggaggacgaagauuucuggaaacuggucgacagagagcgcgagcuccauaagcugggaaaauguggcucuugcguguauaacaugauggggaagagagagaagaaacuuggcgaguuuggaaaggcuaaaggcagccgggccauuugguacauguggcugggggcucgcuaccucgaguucgaggcccugggauuucugaaugaggaucacugguucuccagagaaaacucuuauagcggcguugagggggaaggacuccauaagcugggcuacauccuucgggacaucuccaaaauucccgggggcgcgauguaugccgaugacaccgcuggaugggacacgagaaucaccgaggaugaccugcacaaugaagagaagauuacacagcagauggauccugagcaccggcaacucgccaacgcuaucuuuaaacugaccuaccagaauaagguggucaaggugcagcgccccacaccgaccggcacagucauggacauuaucucuagaaaagaucagcgggggagcggacaagugggcaccuaugggcuuaacacguucacaaauauggaagcccagcugauccgccagauggagggagaaggcguucucuccaaggcggaccuggagaacccucaucugcccgagaagaagauuacccaguggcucgagaccaaagggguggagagacugaagcggauggccaucagcggcgaugacugcgucgugaagcccauugaugaccgcuuugcuaacgcccuucuggcucucaaugauaugggaaaagugagaaaggacaucccucaauggcagccgucuaaaggcuggcacgauuggcagcagguucccuucuguucccaucacuuccacgaacugauuaugaaggacgggcggaaacuuguggucccuugccgcccccaagacgagcugaucggacgggcccggauuagccagggcgcuggguggucucuccgcgaaacagccugucugggaaaggcguacgcccagauguggucccugauguauuuucauagacgggaucuccgccuggcuagcaacgccaucugcucugccgugccuguucacugggugcccaccuccagaacaacguggagcauccaugcucaccaucaauggaugaccacagaggacaugcuuaccgucuggaaucggguguggauugaagauaacccuuggauggaggacaagacacccgucaccacgugggagaaugugccguaccugggcaaaagagaagaucaguggugugggucccucaucggccugaccagccgcgccacaugggcgcagaacauuccuaccgcuauccagcaaguucggucucuuauuggaaaugaggaguuccuggacuacaugcccagcaugaagagauuucgcaaagaggaggaauccgagggcgccaucugguga

SEQ ID NO: 20382 - RNA, 9873 nt, Artificial Sequence
  derived and/or modified CDS sequence (opt5) from DENV-3__KT726342__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacacauaacggcaaacgccucgaaccgaauugggccuccguuaagaaagaccugaucagcuauggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguacggaaauggcguugugacgaagaacgggggauaugucuccggcauugcucaaaccaaugccgagccugacgggccgacacccgaacucgaggaagagauguucaaaaagcgcaaccugaccaucauggaucuucacccuggcagcggaaaaacaagaaaguaccugcccgcuauugugcgggaagccaucaagcgcagacuccggacccugauccucgcgccuacgagaguuguggccgcugagauggaggaagcccugaaaggccuucccauucgcuaucagacaaccgcuaccaagucugagcauacagggcgggaaaucgucgaccugaugugccacgccaccuuuacaaugagacugcucagcccugugcgcguuccgaauuacaaccugauuaucauggaugaggcccauuucaccgaccccgcuuccauugcggcccggggauauaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauacaucuucacgggacagccccuuaacaaugaugaggaccacgcucacuggacagaagccaagaugcugcuggacaacauuaauaccccugagggcaucauucccgcccucuucgaaccugagcgggagaaauccgccgcuaucgauggggaauauagacugaagggcgagagccgcaaaaccuuuguggaacuuaugcggagaggagaccugcccgucuggcucgcccauaagguggcuucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcccggacauauuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacacggaggccgcgccuacagacaugcugucgaggagcugccugaaaccauggagacacugcuccuucugggccugaugauucuccugaccgggggagccaugcuuuuucugaucagcggcaaagggaucggaaagacguccauuggccucaucugugugauugcgucuagcgggaugcuguggauggccgaaaucccccugcaauggauugcuuccgccaucguucucgaguucuuuaugauggugcuucugauuccugagcccgaaaagcagcggaccccgcaggauaaucaacuggcuuauguggucaucggaauccucacacuggccgcgauuaucgccgcuaacgagaugggccuucuggaaaccacaaaacgcgaccucggcaugagcaaggagccugggguugugucucccaccuccuaccuggauguggaccugcaccccgccagcgcuuggacgcucuaugccgucgcuacaaccgugauuacaccuaugcuuagacauaccaucgaaaauucuaccgccaacguuagccuggcggccauugcuaaccaggccgugguccugaugggacucgacaaaggcuggccgaucuccaagauggaucugggggugccccuucuggcucucggaugcuacucucaggucaauccucugacacugacggccgccgugcuccuucugaucacccacuacgcgauuaucggccccgggcugcaggcuaaagccacacgggaggcucaaaagagaaccgccgccggaauuaugaagaacccuacaguugacggcaucaugaccauugaucucgaccccgugaucuaugauagcaaauucgagaagcagcugggccaggucaugcuucuggugcucugugcuguucagcugcugcucaugcgcacguccugggcccuuugcgaagcgcugacacuggccaccgggccuaucaccacacucugggagggaucuccgggcaaauuuuggaauaccacaauugcugugagcauggccaacaucuuccggggguccuaccuggcuggagccggccuugcguuuagcauuaugaagucugucgggacgggaaaaagaggcaccggcucccaaggggaaacacugggagagaaguggaagaaaaagcucaaucagcugagccgcaaagaguucgaccuguauaagaaauccggcaucaccgagguggaucggacagaggccaaggaagggcucaaaagaggagagauuacccaucacgcugugucucggggcagcgccaaacuucagugguuuguugaacgcaacauggucauccccgaggggagagugauugaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuacaugcccacagucauugaacaucucgagcgccuucaaagaaagcacggcgggaugcuggugcggaauccucugagccgcaacucuacccaugaaauguauuggaucuccaauggaacgggcaacauuguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucaucggcgagagaauuaagcgcaucaaagaagaacacaacagcaccuggcacuacgacgaugaaaaucccuauaagacaugggcguaccauggguccuaugagguuaaggccaccggaucugcuagcuccaugauuaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggagagugaugggaaucacagcugaguggcuguggcgcacccucggccggaauaaaaagccuagacugugcacgcgcgaggaguucacaaagaaaguucggaccaacgccgccaugggggcgguguuuacagaggaaaaucagugggauuccgcuaaggccgccgucgaggacgaagauuucuggaaacuuguggacagagagcgcgagcugcacaagcucggaaaauguggcucuugcguuuacaacaugauggggaagagagagaagaagcugggcgaguuuggaaaggcuaaaggcagccgggccauuugguauauguggcuuggggcucgcuaccuggaguucgaggcccucggauuucugaaugaggaucauugguucuccagagaaaacucuuacagcggcguggagggggaaggacugcacaagcucggcuauauccugcgggacaucuccaaaauucccgggggcgcgauguacgccgaugacaccgcuggaugggacacgagaaucaccgaggaugaccuucacaaugaagagaagauuacacagcagauggauccugagcaucggcaacuggccaacgcuaucuuuaaacucaccuaucagaauaaggucgugaagguccagcgccccacaccgaccggcacagugauggacauuaucucuagaaaagaucagcgggggagcggacaaguuggcaccuacgggcugaacacguucacaaauauggaagcccagcuuauccgccagauggagggagaaggcgugcuguccaaggcggaccucgagaacccucaucugcccgagaagaagauuacccaguggcuggagaccaaaggggucgagagacucaagcggauggccaucagcggcgaugacugcguggugaagcccauugaugaccgcuuugcuaacgcccugcuugcucugaaugauaugggaaaaguuagaaaggacaucccucaauggcagccgucuaaaggcuggcaugauuggcaacaggugcccuucuguucccaccacuuccaugaacucauuaugaaggacgggcggaaacuggucgugccuugccgcccccaagacgagcuuaucggacgggcccggauuagccagggcgcuggguggucucugcgcgaaacagccugucucggaaaggcguaugcccagauguggucccugauguacuuucacagacgggaucugcgccucgcuagcaacgccaucugcucugccguuccugugcauuggguccccaccuccagaacaacguggagcauccacgcucaucaccaauggaugaccacagaggacaugcugaccguguggaaucgggucuggauugaagauaacccuuggauggaggacaagacacccgugaccacgugggagaauguuccguaucuuggcaaaagagaagaucaguggugugggucccugaucggccucaccagccgcgccacaugggcgcagaacauuccuaccgcuauccagcaagugcggucucugauuggaaaugaggaguuccuugacuacaugcccagcaugaagagauuucgcaaagaggaggaauccgagggcgccaucugguga

SEQ ID NO: 20383 - RNA, 9873 nt, Artificial Sequence
  derived and/or modified CDS sequence (opt5) from DENV-3__KT726343__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauuuucacacugaccguggcuuggcgcacagccacccucauccuggcuggcgugucccugcuuccggucugccaaucuagcuccaugcggaagacggacuggcugcccauggccguugccgcuaugggggugccuccccucccucuguuuaucuucucucucaaggauacacugaaaagacgcagcuggccccuuaaugagggagugauggcggucggccugguguccauucuggccucuagccuccugagaaacgacguuccuauggcugggccccuuguggccggaggccugcucaucgccuguuaugucauuaccgggaccuccgcugaucugacaguggaaaaggccgcggacaucaccugggaggaagaggcugaacagacaggaguuagccacaaccucaugauuacgguggacgaugacggcaccaugcggaucaaagaugacgagacagagaauauccugaccguccuucugaagacagcccugcucauugugucuggcaucuuuccguacuccauuccugccacccugcuugucuggcauacguggcagaaacagacccaacgcagcggggugcugugggauguucccucuccucccgaaacacagaaggcugagcucgaagagggaguguacagaaucaaacagcagggcauuuucgggaagacccaagucggagugggcguucagaaggaggggguguuucacacaauguggcacgucacccggggagccgugcugacacauaacggcaaacgccucgaaccgaauugggcguccgugaagaaagaccugaucagcuauggcgggggauggagacuuucugcucaguggcaaaagggcgaggaaguucaggucauugccguggagccugggaaaaaccccaagaauuuccagacgaugccuggaaccuuccagacaaccaccggcgaaaucggggccaucgcucuggauuuuaagcccggaacauccggcagccccauuaucaaccgggagggcaaaguggucgggcuguacggaaauggcgugguuacgaagaacgggggauauguguccggcauugcccaaaccaaugcugagccugacgggccgacacccgaacucgaggaagagauguucaaaaagcgcaaccugaccaucauggaucuucacccuggcagcggaaaaacaagaaaguaccugcccgccauuguccgggaagcgaucaagcgcagacuccggacccugauccucgccccuacgagagugguugcugccgagauggaggaagcucugaaaggccuucccauucgcuaucagacaaccgccaccaagucugagcauacagggcgggaaaucguggaccugaugugccacgccaccuuuacaaugagacugcucagcccuguccgcgugccgaauuacaaccugauuaucauggaugaggcucauuucaccgaccccgcguccauugccgcucggggauauaucucuacgagaguuggcaugggggaagccgccgcuaucuuuaugacagccaccccucccggaacagcggaugcuuucccucagagcaaugcccccauucaggacgaggagcgcgacaucccggaacgguccuggaacucuggcaaugaguggauuaccgauuuugccgggaaaacggugugguucgucccuagcaucaaggcuggcaacgacauugccaacugucuucgcaaaaauggaaagaaggugauccaacuguccagaaaaaccuuugauacagaauaccagaagaccaaacucaacgacugggauuucguggucacaaccgacauuucugagaugggcgcgaauuuuaaggccgaucggguuaucgaccccagacggugccugaaacccgugauccugacagaugggccugagcgcgugauucucgcuggacccaugccugucaccgccgcuagcgccgcucagagacggggccgcguggggagaaacccgcagaaggaaaaugaccaauacaucuucacgggacagccccuuaacaaugaugaggaccacgcccacuggacagaagcgaagaugcugcuggacaacauuaauaccccugagggcaucauucccgcccucuucgaaccugagcgggagaaauccgcugccaucgauggggaauauagacugaagggcgagagccgcaaaaccuuuguugaacuuaugcggagaggagaccugcccguguggcucgcucauaaggucgccucugagggcaucaaauacacagaucgcaaguggugcuucgacgggcagcggaacaaucagauucuggaagagaacauggauguggagaucuggaccaaagaaggagagaagaagaaacugagaccgcgcuggcucgacgcccggacauauuccgauccucuugcucugaaggaauuuaaagacuucgcggccggcagaaagagcauugcucuggaucucguuacggagaucgggcgcgugcccucucaccuggcccauagaacccggaaugcccuugacaaccuggucaugcuccacacauccgaacacggaggccgcgcuuacagacaugccguggaggagcugccugaaaccauggagacacugcuccuucugggccugaugauucuccugaccgggggagcgaugcuuuuucugaucagcggcaaagggaucggaaagacguccauuggccucaucugugucauugccucuagcgggaugcuguggauggcugaaaucccccugcaauggauugccuccgcuaucgugcucgaguucuuuaugaugguucuucugauuccugagcccgaaaagcagcggaccccgcaggauaaucaacuggccuauguggugaucggaauccucacacuggcggccauuaucgcugccaacgagaugggccuucuggaaaccacaaaacgcgaccucggcaugagcaaggagccuggggucguuucucccaccuccuaccuggauguggaccugcaccccgcuagcgccuggacgcucuaugcuguggccacaaccgucauuacaccuaugcuuagacauaccaucgaaaauucuaccgcgaacgugagccuggccgcuauugccaaccaggcuguugugcugaugggacucgacaaaggcuggccgaucuccaagauggaucugggggucccccuucuggcccucggaugcuacucucaggugaauccucugacacugacggccgcgguccuccuucugaucacccacuacgcuauuaucggccccgggcugcaggccaaagcuacacgggaggcccaaaagagaaccgccgcuggaauuaugaagaacccuacaguggacggcaucaugaccauugaucucgaccccguuaucuaugauagcaaauucgagaagcagcugggccaggugaugcuucugguccucugugccgugcagcugcugcucaugcgcacguccugggcgcuuugcgaagcccugacacuggcuaccgggccuaucaccacacucugggagggaucuccgggcaaauuuuggaauaccacaauugccguuagcauggcuaacaucuuccggggguccuaccuggccggagcgggccuugccuuuagcauuaugaagucuguggggacgggaaaaagaggcaccggcucccaaggggaaacacugggagagaaguggaagaaaaagcucaaucagcugagccgcaaagaguucgaccuguauaagaaauccggcaucaccgaggucgaucggacagaggcuaaggaagggcucaaaagaggagagauuacccaucacgccgugucucggggcagcgcuaaacuucagugguuuguggaacgcaacaugguuauccccgaggggagagucauugaccugggauguggccggggcgggugguccuacuauugcgccggacugaagaaagugacggaagugcgcggcuacaccaaagggggaccuggccacgaggagcccgucccuaugucuacauauggguggaauaucguuaaacucaugagcggaaaggauguguucuaccugcccccggaaaaaugugacacccuucugugcgauaucggcgaguccagcccuucucccacaguggaagaguccagaaccauucggguccucaagaugguggagcccuggcugaagaacaaucaguucuguaucaaaguucugaacccuuacaugcccacagugauugaacaucucgagcgccuucaaagaaagcacggcgggaugcugguccggaauccucugagccgcaacucuacccaugaaauguauuggaucuccaauggaacgggcaacauuguggcuagcguuaauauggugucuagacuccugcuuaaccgguuuacaaugacccacagacgcccgaccaucgagaaagacgucgaucugggggccggaacacggcacgugaacgcggaacccgagacgccuaauauggacgugaucggcgagagaauuaagcgcaucaaagaagaacacaacagcaccuggcacuacgacgaugaaaaucccuauaagacaugggccuaccauggguccuaugaggucaaggcuaccggaucugccagcuccaugauuaacggcguugugaaacuccugacaaagccuugggacgugguccccauggugacccagauggcuaugacagauaccacgccguucggccagcaacggguuuuuaaagaaaagguggacaccagaacaccucgcagcaugcccgggacccggagagucaugggaaucacagccgaguggcuguggcgcacccucggccggaauaaaaagccuagacugugcacgcgcgaggaguucacaaagaaagugcggaccaacgccgcgaugggggcuguuuuuacagaggaaaaucagugggauuccgccaaggccgcuguggaggacgaagauuucuggaaacuugucgacagagagcgcgagcugcacaagcucggaaaauguggcucuugcguguacaacaugauggggaagagagagaagaagcugggcgaguuuggaaaggccaaaggcagccgggcuauuugguauauguggcuuggggcccgcuaccuggaguucgaggcgcucggauuucugaaugaggaucauugguucuccagagaaaacucuuacagcggcguugagggggaaggacugcacaagcucggcuauauccugcgggacaucuccaaaauucccgggggcgccauguacgcugaugacaccgccggaugggacacgagaaucaccgaggaugaccuucacaaugaagagaagauuacacagcagauggauccugagcaucggcaacuggcuaacgccaucuuuaaacucaccuaucagaauaagguggucaaggugcagcgccccacaccgaccggcacagucauggacauuaucucuagaaaagaucagcgggggagcggacaagugggcaccuacgggcugaacacguucacaaauauggaagcgcagcuuauccgccagauggagggagaaggcguucuguccaaggccgaccucgagaacccucaucugcccgagaagaagauuacccaguggcuggagaccaaagggguggagagacucaagcggauggcuaucagcggcgaugacugcgucgugaagcccauugaugaccgcuuugccaacgcucugcuugcccugaaugauaugggaaaagugagaaaggacaucccucaauggcagccgucuaaaggcuggcaugauuggcagcagguucccuucuguucccaccacuuccaugaacucauuaugaaggacgggcggaaacugguggucccuugccgcccccaagacgagcuuaucggacgggcucggauuagccagggcgccggguggucucugcgcgaaacagcgugucucggaaaggccuaugcucagauguggucccugauguacuuucacagacgggaucugcgccucgccagcaacgccaucugcucugcugugccuguucauugggugcccaccuccagaacaacguggagcauccacgcccaucaccaauggaugaccacagaggacaugcugaccgucuggaaucggguguggauugaagauaacccuuggauggaggacaagacacccgucaccacgugggagaaugugccguaucuuggcaaaagagaagaucaguggugugggucccugaucggccucaccagccgcgcgacaugggcucagaacauuccuaccgccauccagcaaguucggucucugauuggaaaugaggaguuccuugacuacaugcccagcaugaagagauuucgcaaagaggaggaauccgagggcgccaucugguga

SEQ ID NO: 20384 - RNA, 9873 nt, Artificial Sequence
  derived and/or modified CDS sequence (opt5) from DENV-3__KT726351__SS-prME
acaagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagucaccuacaaguguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacacauaacggcaaacgccucgaaccgaauugggccuccguuaagaaagaccugaucagcuauggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguacggaaauggcguugugacgaagaacgggggauaugucuccggcauugcucaaaccaaugccgagccugacgggccgacacccgaacucgaggaagagauguucaaaaagcgcaaccugaccaucauggaucuucacccuggcagcggaaaaacaagaaaguaccugcccgcuauugugcgggaagccaucaagcgcagacuccggacccugauccucgcgccuacgagaguuguggccgcugagauggaggaagcccugaaaggccuucccauucgcuaucagacaaccgcuaccaagucugagcauacagggcgggaaaucgucgaccugaugugccacgccaccuuuacaaugagacugcucagcccugugcgcguuccgaauuacaaccugauuaucauggaugaggcccauuucaccgaccccgcuuccauugcggcccggggauauaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauacaucuucacgggacagccccuuaacaaugaugaggaccacgcucacuggacagaagccaagaugcugcuggacaacauuaauaccccugagggcaucauucccgcccucuucgaaccugagcgggagaaauccgccgcuaucgauggggaauauagacugaagggcgagagccgcaaaaccuuuguggaacuuaugcggagaggagaccugcccgucuggcucgcccauaagguggcuucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcccggacauauuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacacggaggccgcgccuacagacaugcugucgaggagcugccugaaaccauggagacacugcuccuucugggccugaugauucuccugaccgggggagccaugcuuuuucugaucagcggcaaagggaucggaaagacguccauuggccucaucugugugauugcgucuagcgggaugcuguggauggccgaaaucccccugcaauggauugcuuccgccaucguucucgaguucuuuaugauggugcuucugauuccugagcccgaaaagcagcggaccccgcaggauaaucaacuggcuuauguggucaucggaauccucacacuggccgcgauuaucgccgcuaacgagaugggccuucuggaaaccacaaaacgcgaccucggcaugagcaaggagccugggguugugucucccaccuccuaccuggauguggaccugcaccccgccagcgcuuggacgcucuaugccgucgcuacaaccgugauuacaccuaugcuuagacauaccaucgaaaauucuaccgccaacguuagccuggcggccauugcuaaccaggccgugguccugaugggacucgacaaaggcuggccgaucuccaagauggaucugggggugccccuucuggcucucggaugcuacucucaggucaauccucugacacugacggccgccgugcuccuucugaucacccacuacgcgauuaucggccccgggcugcaggcuaaagccacacgggaggcucaaaagagaaccgccgccggaauuaugaagaacccuacaguugacggcaucaugaccauugaucucgaccccgugaucuaugauagcaaauucgagaagcagcugggccaggucaugcuucuggugcucugugcuguucagcugcugcucaugcgcacguccugggcccuuugcgaagcgcugacacuggccaccgggccuaucaccacacucugggagggaucuccgggcaaauuuuggaauaccacaauugcugugagcauggccaacaucuuccggggguccuaccuggcuggagccggccuugcguuuagcauuaugaagucugucgggacgggaaaaagaggcaccggcucccaaggggaaacacugggagagaaguggaagaaaaagcucaaucagcugagccgcaaagaguucgaccuguauaagaaauccggcaucaccgagguggaucggacagaggccaaggaagggcucaaaagaggagagauuacccaucacgcugugucucggggcagcgccaaacuucagugguuuguugaacgcaacauggucauccccgaggggagagugauugaccugggauguggccggggcgggugguccuacuauugcgcuggacugaagaaagugacggaaguccgcggcuacaccaaagggggaccuggccacgaggagcccguuccuaugucuacauauggguggaauaucgugaaacucaugagcggaaaggauguguucuaccugcccccggaaaaaugugacacccuucugugcgauaucggcgaguccagcccuucucccacagucgaagaguccagaaccauucgggugcucaagaugguugagcccuggcugaagaacaaucaguucuguaucaaagugcugaacccuuacaugcccacagucauugaacaucucgagcgccuucaaagaaagcacggcgggaugcuggugcggaauccucugagccgcaacucuacccaugaaauguauuggaucuccaauggaacgggcaacauuguugccagcgugaauauggucucuagacuccugcuuaaccgguuuacaaugacccacagacgcccgaccaucgagaaagacguggaucugggggcuggaacacggcacgugaacgccgaacccgagacgccuaauauggacgucaucggcgagagaauuaagcgcaucaaagaagaacacaacagcaccuggcacuacgacgaugaaaaucccuauaagacaugggcguaccauggguccuaugagguuaaggccaccggaucugcuagcuccaugauuaacggcguggugaaacuccugacaaagccuugggacgucgugcccaugguuacccagauggccaugacagauaccacgccguucggccagcaacggguguuuaaagaaaaggucgacaccagaacaccucgcagcaugcccgggacccggaaagugaugggaaucacagcugaguggcuguggagaacccucggccgcaauaagaagccucggcugugcacgagagaggaguucaccaagaagguucgcaccaacgccgccaugggggcgguguuuacagaggaaaaucagugggauuccgcuaaagccgccgucgaggacgaagauuucuggaaacuuguggaccgggagagagagcugcacaaacucggaaaguguggcucuugcguuuacaacaugauggggaaacgcgaaaagaagcugggcgaguuuggaaaagcuaagggcagcagagccauuugguauauguggcuuggggcucgguaccuggaguucgaggcccucggauuucugaaugaggaucauugguucucccgcgaaaacucuuacagcggcguggagggggaaggacugcacaaacucggcuauauccugagagacaucuccaagauucccgggggcgcgauguacgccgaugacaccgcuggaugggacacgcggaucaccgaggaugaccuucacaaugaagagaaaauuacacagcagauggauccugagcauagacaacuggccaacgcuaucuuuaagcucaccuaucagaauaaggucgugaaaguccagcggcccacaccgaccggcacagugauggacauuaucucucgcaaggaucagagagggagcggacaaguuggcaccuacgggcugaacacguucacaaauauggaagcccagcuuauccggcagauggagggagaaggcgugcuguccaaagcggaccucgagaacccucaucugcccgaaaagaaaauuacccaguggcuggagaccaagggggucgagcgccucaagagaauggccaucagcggcgaugacugcguggugaaacccauugaugaccgguuugcuaacgcccugcuugcucugaaugauaugggaaagguucgcaaagacaucccucaauggcagccgucuaagggcuggcaugauuggcaacaggugcccuucuguucccaccacuuccaugaacucauuaugaaagacgggagaaagcuggucgugccuugccggccccaagacgagcuuaucggacgcgccagaauuagccagggcgcuggguggucucugcgggaaacagccugucucggaaaggcguaugcccagauguggucccugauguacuuucaccgcagagaucugcggcucgcuagcaacgccaucugcucugccguuccugugcauuggguccccaccucccgcacaacguggagcauccacgcucaucaccaauggaugaccacagaggacaugcugaccguguggaauagagucuggauugaagauaacccuuggauggaggacaaaacacccgugaccacgugggagaauguuccguaucuuggcaagcgggaagaucaguggugugggucccugaucggccucaccagcagagccacaugggcgcagaacauuccuaccgcuauccagcaagugcgcucucugauuggaaaugaggaguuccuugacuacaugcccagcaugaaacgguuuagaaaggaggaggaauccgagggcgccaucugguga

SEQ ID NO: 20385 - RNA, 9873 nt, Artificial Sequence
  derived and/or modified CDS sequence (opt5) from DENV-3__KT726360__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagucaccuacaaguguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaaccaucgccccggauaucacacacaaaccgcgggcccuuggcaccuugggaagcuggagcucgacuuuaauuacugcgagggaacgacaguugugaucaccgaaaacuguggcacacggggccccucucugagaaccacaaccgucuccgggaaacugauccaugaguggugcugucgcagcugcacgcuuccgccucuccgguauaugggagaagauggcuguugguacgggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcacaugaucgccggcguuuucuuuacauucgugcuucugcucagcgggcagauuaccuggcgcgauauggcucauacacugaucaugauuggauccaaugccagcgacagaaugggcaugggggucaccuaucuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaccagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccauggcuguggccgccaugggggugccuccccucccucuguuuaucuucucucucaaggauacacugaaaagacgcagcuggccccuuaaugagggagucauggcugugggccugguuuccauucuggcgucuagccuccugagaaacgacgugccuauggccgggccccuugucgcuggaggccugcucaucgccuguuaugugauuaccgggaccuccgccgaucugacaguugaaaaggcugccgacaucaccugggaggaagaggcggaacagacaggagugagccacaaccucaugauuacggucgacgaugacggcaccaugcggaucaaagaugacgagacagagaauauccugaccgugcuucugaagacagcucugcucauugucucuggcaucuuuccguacuccauuccugccacccugcuuguguggcauacguggcagaaacagacccaacgcagcgggguucugugggaugugcccucuccucccgaaacacagaaggccgagcucgaagagggagucuacagaaucaaacagcagggcauuuucgggaagacccaagugggaguuggcgugcagaaggagggggucuuucacacaauguggcacgugacccggggagcugugcugacacauaacggcaaacgccucgaaccgaauugggccuccguuaagaaagaccugaucagcuauggcgggggauggagacuuucugcgcaguggcaaaagggcgaggaaguccaggugauugcuguggagccugggaaaaaccccaagaauuuccagacgaugccuggaaccuuccagacaaccaccggcgaaaucggggccaucgcccuggauuuuaagcccggaacauccggcagccccauuaucaaccgggagggcaaagucguggggcuguacggaaauggcguugugacgaagaacgggggauaugucuccggcauugcucaaaccaaugccgagccugacgggccgacacccgaacucgaggaagagauguucaaaaagcgcaaccugaccaucauggaucuucacccuggcagcggaaaaacaagaaaguaccugcccgcuauugugcgggaagccaucaagcgcagacuccggacccugauccucgcgccuacgagaguuguggccgcugagauggaggaagcccugaaaggccuucccauucgcuaucagacaaccgcuaccaagucugagcauacagggcgggaaaucgucgaccugaugugccacgccaccuuuacaaugagacugcucagcccugugcgcguuccgaauuacaaccugauuaucauggaugaggcccauuucaccgaccccgcuuccauugcggcccggggauauaucucuacgagagugggcaugggggaagcugccgccaucuuuaugacagcuaccccucccggaacagccgaugcguucccucagagcaaugcucccauucaggacgaggagcgcgacaucccggaacgguccuggaacucuggcaaugaguggauuaccgauuuugccgggaaaacggucugguucgugccuagcaucaaggccggcaacgacauugcuaacugucuucgcaaaaauggaaagaaggugauccaacuguccagaaaaaccuuugauacagaauaccagaagaccaaacucaacgacugggauuucgucguuacaaccgacauuucugagaugggcgccaauuuuaaggcggaucgggugaucgaccccagacggugccugaaacccgugauccugacagaugggccugagcgcgucauucucgccggacccaugccugugaccgcugccagcgcugcccagagacggggccgcguugggagaaacccgcagaaggaaaaugaccaauacaucuucacgggacagccccuuaacaaugaugaggaccacgcucacuggacagaagccaagaugcugcuggacaacauuaauaccccugagggcaucauucccgcccucuucgaaccugagcgggagaaauccgccgcuaucgauggggaauauagacugaagggcgagagccgcaaaaccuuuguggaacuuaugcggagaggagaccugcccgucuggcucgcccauaagguggcuucugagggcaucaaauacacagaucgcaaguggugcuucgacgggcagcggaacaaucagauucuggaagagaacauggauguugagaucuggaccaaagaaggagagaagaagaaacugagaccgcgcuggcucgacgcccggacauauuccgauccucuugcccugaaggaauuuaaagacuucgcugcgggcagaaagagcauugcccuggaucucgugacggagaucgggcgcguccccucucaccuggcucauagaacccggaaugcccuugacaaccuggugaugcuccacacauccgaacacggaggccgcgccuacagacaugcugucgaggagcugccugaaaccauggagacacugcuccuucugggccugaugauucuccugaccgggggagccaugcuuuuucugaucagcggcaaagggaucggaaagacguccauuggccucaucugugugauugcgucuagcgggaugcuguggauggccgaaaucccccugcaauggauugcuuccgccaucguucucgaguucuuuaugauggugcuucugauuccugagcccgaaaagcagcggaccccgcaggauaaucaacuggcuuauguggucaucggaauccucacacuggccgcgauuaucgccgcuaacgagaugggccuucuggaaaccacaaaacgcgaccucggcaugagcaaggauccugggguugugucucccaccuccuaccuggacguggaccugcaccccgccagcgcuuggacgcucuaugccgucgcuacaaccgugauuacaccuaugcuuagacauaccaucgaaaauucuaccgccaacguuagccuggcggccauugcuaaccaggccgugguccugaugggacucgauaaaggcuggccgaucuccaagauggaccugggggugccccuucuggcucucggaugcuacucucaggucaauccucugacacugacggccgccgugcuccuucugaucacccacuacgcgauuaucggccccgggcugcaggcuaaagccacacgggaagcucaaaagagaaccgccgccggaauuaugaagaacccuacaguugauggcaucaugaccauugaccucgaucccgugaucuaugacagcaaauucgagaagcagcugggccaggucaugcuucuggugcucugugcuguucagcugcugcucaugcgcacguccugggcccuuugcgaggcgcugacacuggccaccgggccuaucaccacacucugggaaggaucuccgggcaaauuuuggaauaccacaauugcugugagcauggccaacaucuuccggggguccuaccuggcuggagccggccuugcguuuagcauuaugaagucugucgggacgggaaaaagaggcaccggcucccaaggggagacacugggagaaaaguggaagaaaaagcucaaucagcugagccgcaaagaguucgaucuguauaagaaauccggcaucaccgaaguggaccggacagaggccaaggaggggcucaaaagaggagaaauuacccaucacgcugugucucggggcagcgccaaacuucagugguuuguugagcgcaacauggucauccccgaagggagagugauugaucugggauguggccggggcgggugguccuacuauugcgcuggacugaagaaagugacggagguccgcggcuacaccaaagggggaccuggccacgaggagcccguuccuaugucuacauauggguggaauaucgugaaacucaugagcggaaaggacguguucuaccugcccccggagaaaugugauacccuucugugcgacaucggcgaauccagcccuucucccacagucgaggaauccagaaccauucgggugcucaagaugguugagcccuggcugaagaacaaucaguucuguaucaaagugcugaacccuuacaugcccacagucauugagcaucucgaacgccuucaaagaaagcacggcgggaugcuggugcggaauccucugagccgcaacucuacccaugagauguauuggaucuccaauggaacgggcaacauuguugccagcgugaauauggucucuagacuccugcuuaaccgguuuacaaugacccacagacgcccgaccaucgaaaaagauguggaccugggggcuggaacacggcacgugaacgccgagcccgaaacgccuaauauggacgucaucggcgagagaauuaagcgcaucaaagaggaacauaacagcaccuggcacuacgaugacgagaaucccuauaagacaugggcguaccauggguccuaugaaguuaaggccaccggaucugcuagcuccaugauuaacggcguggugaaacuccugacaaagccuugggaugucgugcccaugguuacccagauggccaugacagacaccacgccguucggccagcaacggguguuuaaagagaaggucgauaccagaacaccucgcagcaugcccgggacccggagagugaugggaaucacagcugaauggcuguggcgcacccucggccggaauaaaaagccuagacugugcacgcgcgaggaguucacaaagaaaguucggaccaacgccgccaugggggcgguguuuacagaagagaaucagugggacuccgcuaaggccgccgucgaagaugaggacuucuggaaacuuguggauagagaacgcgagcugcacaagcucggaaaauguggcucuugcguuuacaacaugauggggaagagagagaaaaagcugggcgaauuuggaaaggcuaaaggcagccgggccauuugguauauguggcuuggggcucgcuaccuggaguucgaagcccucggauuucugaaugaggaccauugguucuccagagagaacucuuacagcggcguggaaggggagggacugcacaagcucggcuauauccugcgggauaucuccaaaauucccgggggcgcgauguacgccgacgacaccgcuggaugggauacgagaaucaccgaagacgaucuucacaaugaggaaaagauuacacagcagauggacccugagcaucggcaacuggccaacgcuaucuuuaaacucaccuaucagaauaaggucgugaagguccagcgccccacaccgaccggcacagugauggauauuaucucuagaaaagaccagcgggggagcggacaaguuggcaccuacgggcugaacacguucacaaauauggaggcccagcuuauccgccagauggaaggagagggcgugcuguccaaggcggaucucgaaaacccucaucugcccgagaaaaagauuacccaguggcuggaaaccaaaggggucgagagacucaagcggauggccaucagcggcgacgauugcguggugaagcccauugacgaucgcuuugcuaacgcccugcuugcucugaaugacaugggaaaaguuagaaaggauaucccucaauggcagccgucuaaaggcuggcaugacuggcaacaggugcccuucuguucccaccacuuccaugagcucauuaugaaggacgggcggaaacuggucgugccuugccgcccccaagaugaacuuaucggacgggcccggauuagccagggcgcuggguggucucugcgcgagacagccugucucggaaaggcguaugcccagauguggucccugauguacuuucacagacgggaccugcgccucgcuagcaacgccaucugcucugccguuccugugcauuggguccccaccuccagaacaacguggagcauccacgcucaucaccaauggaugaccacagaagauaugcugaccguguggaaucgggucuggauugaggacaacccuuggauggaagauaagacacccgugaccacgugggagaauguuccguaucuuggcaaaagagaggaccaguggugugggucccugaucggccucaccagccgcgccacaugggcgcagaacauuccuaccgcuauccagcaagugcggucucugauuggaaaugaagaguuccuugauuacaugcccagcaugaagagauuucgcaaagaagaggaguccgaaggcgccaucugguga

SEQ ID NO: 20386 - RNA, 9873 nt, Artificial Sequence
  derived and/or modified CDS sequence (opt5) from DENV-3__KF041259__SS-prME
acaagccugugccucaugaugauccugcccgcggcucuugccuuccaccugacgucccgggacggagaaccucggaugauuguggggaagaaugaacgcggaaagucucuccuguuuaagacggcgagcggcaucaauauguguacccuuauugcuauggaucugggggagaugugcgacgauacagugaccuacaaguguccgcauaucaacgaaguugagcccgaagacauugauugcugguguaaucucacauccaccugggugacauauggaaccugcaaccaggccggcgagcaccggcgggacaagcgcucuguggcccuggcuccucaugucgggaugggacuggauacgcggacccaaacauggaugagcgccgagggcgcuuggagacagguggaaaagguugagaccugggcccuccgccaccccggcuucacaauccuggcgcuuuuucuggcccauuacaucgggaccucccucacgcagaagguggucauuuucauccugcuuaugcuggugacaccuucuaugaccaugagauguguuggagugggcaaucgggacuuugucgaagggcucagcggagcuacauggguggaugugguccuggagcacggcgggugcguuaccaccauggccaagaacaaacccacacuggacauugagcuccagaagacggaagcuacccaacuggccacacuucgcaaacuguguaucgagggaaagauuaccaauaucacaaccgauuccagaugcccuacgcagggcgaagcggugcucccggaggaacaggaccagaacuauguguguaaacacacauacgucgaucggggcugggggaauggaugcggccuguucgggaagggaagccuugugaccugcgccaaguuucaaugucuggagcccauugagggcaaaguugugcaguaugaaaaccucaaguacaccgucaucaucacagugcauaccggggaccagcaccagguuggaaaugagacacaaggcgugacggcugaaauuaccccucaggccucuacaaccgaggcuauccugcccgaauauggcacacuggggcucgagugcuccccucgcaccggacuggacuucaacgagaugauucuucugacgaugaaaaauaaggccuggaugguccauagacagugguuuuucgaucucccccugccguggaccagcggcgccacaaccgaaacaccuaccuggaaccggaaagagcuucuggugacguuuaagaaugcucacgcgaaaaagcaagaagucgugguucucgggucucaggagggagccaugcacacagcucugaccggcgccacagaaauccagaacuccgggggcaccagcauuuucgccggacaucugaagugucgccucaaaauggacaagcuggagcuuaaaggcaugucuuacgcuaugugcaccaacacauuugugcugaagaaagaggucuccgaaacgcagcacgggaccauccucaucaagguggaguacaagggagaagaugcccccuguaaaauuccuuucagcacagaggacggccaagggaaggcgcauaauggaagacugaucaccgcuaaccccguugugaccaagaaggaggaacccgucaauauugaggccgaaccuccguucggcgaguccaacaucgugauugggaucggcgauaaugcccugaaaaucaacugguauaagaagggaucuagcauuggcaaaauguuugaagcuaccgccagaggggcuagacgcauggccauccuuggagacacggcgugggauuucggcuccgucgggggaguucucaauagccugggcaagaugguccaccagauuuuugggucugccuacacagcucuguucuccggcgugagcugggugaugaaaaucggaauuggcguccuccugaccuggaucgggcuuaacucuaagaauaccagcauguccuuuucuugcauugccaucggaaucauuacacuguaucucggcgcugugguucaggccgacauggggugugugaucaacuggaaaggaaaggagcugaagugcggcagcgggauuuucgucaccaaugaggugcauacauggacggaacaguacaaauuucaagcggauucccccaagcggcuggccaccgcuaucgccggcgcuugggagaacggaguuuguggcauuagaagcacaacccgcauggaaaaucuucucuggaaacagaucgccaacgagcugaauuauauccugugggaaaacaacauuaagcucacaguggucgugggggacaccaucggaguucuggagcagggcaaacggacgcuuaccccucagcccauggagcugaaguacucuuggaaaacaugggggaaggccaagauugugaccgcugaaacacaaaauuccagcuucaucauugauggaccuaacacccccgagugcccgucugcguccagagccuggaaugucugggaaguggaggacuauggcuuuggcguguucacaaccaacaucuggcucaaacugcgcgaagucuacacgcagaugugugaccaccggcugaugagcgcugccguuaaggaugagagagccgugcacgcugacaugggguacuggaucgagucccagaaaaauggaucuuggaaacuugaaaaagccagccucauugaggugaagacaugcaccuggccuaagucccauacccuguggucuaacggcguccuggaaagcgauaugaucauucccaaaucccucgcggggccuaucagccagcacaauuaucgccccggauaccauacacaaaccgcuggcccuuggcaccuggggcggcuugagcuggacuuuaacuauugcgagggaacgacagugguuauuaccgaaaauuguggcacaagaggccccucucuccgcaccacaaccguguccgggaagcugauccacgaguggugcugucggagcugcacgcugccgccucuuagauacaugggagaagauggcuguugguaugggauggagauccggcccauuucugaaaaagaggagaacauggucaagucccucgugagcgccggaucuggcaaaguugacaauuucaccaugggggugcugugccuggccauccucuuugaagaggucaugcgcggaaaguucggcaagaaacauaugauugcuggcguguucuuuacauucguucugcuucugagcgggcagaucaccuggagagauauggcccacacacucauuaugaucggauccaacgcgagcgaccggaugggcaugggggugaccuaccuggcucugauugccacguuuaagauccagcccuuccuugcccugggauuuuuccucagaaaacugacaucucgcgaaaaucuccugcuuggcgucgggcuggcuauggccaccacacuccaacugccugaggauaucgaacagauggcuaacggaauugcccugggccuuauggcgcugaagcucaucacccaguuugagaccuaucagcuguggacagcccucauuucccugacguguagcaauaccaucuucacacuuaccguggcuuggcggacagccacccugauucucgcuggcgugucccugcugccggucugccaaucuagcuccaugagaaaaacggacuggcuucccaugacaguugccgccaugggggugccuccccugccucucuuuaucuucucucugaaggauacccucaagcgcagaagcuggccccugaacgagggagugauggcugucggccuuguguccauccuggcgucuagccugcuccggaacgacguuccuauggccgggccccugguggcuggaggccuucugauugccuguuacgucaucaccgggacauccgccgaucucaccguggaaaaagcugccgacguuacaugggaggaagaggcggaacagacgggagugagccauaaucugaugauuaccgucgacgaugacggcacaaugcgcaucaaggaugacgagaccgagaacauucucacagugcugcuuaaaaccgcucugcugaucgucucuggcaucuuuccguacuccauuccugccacgcuccugguguggcacaccuggcagaagcagacacaaagaagcgggguucuuugggaugugcccucuccucccgaaacccagaaagccgagcuggaagagggagucuaucggaucaagcagcagggcauucucgggaaaacacaagugggaguuggcgugcagaaggagggggucuuccauaccauguggcacgugacacgcggagcugugcugacgcacaauggcaagagacucgaaccgaacugggccuccguuaaaaaggaccugaucagcuacggcgggggauggcggcuuucugcgcaguggcaaaaaggcgaggaaguccaggugauugcuguggagccugggaagaaucccaaaaacuuucagaccaugccuggaacauuccagaccaccacaggcgaaaucggggccauugcccuggauuucaagcccggaacguccggcagccccaucaucaaucgcgagggcaaggucguggggcuguauggaaacggcguugugaccaaaaaugggggauacgucuccggcauugcucaaacaaacgccgagccugacgggccgacccccgaacucgaggaagagauguuuaagaaaagaaaucugacaaucauggaucuucauccuggcagcggaaagacccggaaauaucugcccgcuauugugcgcgaagccaucaagagacggcucagaacgcugauucucgcgccuacacgcguuguggccgcugagauggaggaagcccugaagggccuucccauccgguaccagaccaccgcuacaaaaucugagcacaccgggagagaaaucgucgaccugaugugccaugccacauucaccaugcgccugcucagcccugugcggguuccgaacuauaaucugauuaucauggaugaggcccacuuuacggaccccgcuuccauugcggccagaggauacaucucuacacgcgugggcaugggggaagcugccgccauuuucaugaccgcuacaccucccggaaccgccgaugcguuuccucagagcaacgcucccauccaggacgaggagcgggacaucccggaaagauccuggaacucuggcaacgaguggauuacggauuucgccgggaagaccgucugguuugugccuagcaucaaagccggcaacgacauugcuaauugucuucgcaagaacggcaaaaaggugauccaacugucccggaagacauucgauaccgaauaccagaaaacaaagcucaaugacugggauuuugucguuaccacagacauuucugagaugggagccaacuucaaagcggauagagugaucgacccccggcgcugccugaagcccgugauucugaccgaugggccugagagagucauccucgccggacccaugccugugacggcugccagcgcugcccagcggcgcggcagaguugggcggaauccgcagaaagaaaacgaccaauauaucuuuacaggacagccccuuaauaacgaugaggaccaugcucacuggaccgaagccaagaugcugcuggacaauauuaacaccccugagggcaucauucccgcccucuucgaaccugagagagagaaguccgccgcuaucgauggggaauaccgccugaaaggcgagagccggaagacauucguggaacuuaugagacgcggagaccugcccgucuggcucgcccacaaaguggcuucugagggcauuaaguauaccgaucggaaauggugcuuugacgggcagagaaauaaccagauccuggaagagaauauggauguugagaucuggacaaaggaaggagagaaacgcaagcugcggccgagauggcucgacgcccgcacguacuccgauccucuugcccugaaggaguucaaagacuuugcugcgggcagaaagagcauugcccuggaucucgugaccgagaucgggcggguccccucucaucuggcucaccgcacaagaaacgcccuugacaaucuggugaugcuccauaccuccgaacacggaggccgggccuaucgccacgcugucgaggagcugccugaaacaauggagacccugcuccuucugggccugaugauucuccugacagggggagccaugcuuuuccugaucagcggcaaagggauuggaaagaccuccaucggccucaucugugugauugcgucuagcgggaugcuguggauggccgaaaucccccugcaauggauugcuuccgccaucguucucgaguuuuucaugauggugcuucugauuccugagcccgaaaaacagagaacaccgcaggauaaccaacuggcuuacguggucaucggcauucucacccuggccgcgaucaucgccgcuaaugagaugggccuucuggaaacaaccaagcgggaccucggcaugagcaaggagccugggguugugucucccacguccuaucuggauguggaccugcaucccgccagcgcuuggacacucuacgccgucgcuaccacagugauuaccccuaugcuuagacacaccaucgaaaacucuacagccaacguuagccuggcggccauugcuaaucaggccgugguccugaugggacucgacaaaggcuggccgaucuccaagauggaucugggggugccccuucuggcucucggaugcuacucucaggucaacccucugacgcugaccgccgccgugcuccuucugauuacacauuaugcgaucaucggccccgggcugcaggcuaaagccacccgcgaggcucaaaagcggacagccgccggaauuaugaaaaauccuaccguugacggcaucauuacgaucgaucucgaccccgugauuuacgauagcaaguuugagaagcagcugggccaggucaugcuucuggugcucugugcuguucagcugcugcucaugagaacauccugggcccuuugcgaagcgcugacccuggccaccgggccuaucacaacccucugggagggaucuccgggcaaauucuggaacacaacgaucgcugugagcauggccaauauuuuucgcggguccuaucuggcuggagccggccuugcguucagcaucaugaagucugucgggaccggaaaacggggcacaggcucccaaggggaaacccugggagagaaguggaaaaagaagcucaaccagcugagcagaaaagaauuugaccuguacaagaaauccggcauuacagagguggaucggaccgaggccaaggaagggcucaaacgcggagagacgacccaccaugcugugucuagaggcagcgccaaacuucagugguucguugaacggaauauggucauccccgaggggcgcgugauugaccugggauguggcagaggcgggugguccuauuacugcgcuggacugaaaaaggugacagaaguccggggcuauaccaaagggggaccuggccacgaggagcccguuccuaugucuacauacggguggaacaucgugaaacucaugagcggaaaggauguguuuuaccugcccccggaaaaaugugacacccuucugugcgauauuggcgaguccagcccuucucccacagucgaagagucccgcaccaucagagugcucaagaugguugagcccuggcugaaaaauaaccaguucuguaucaaggugcugaauccuuauaugcccgccgucauugaacaccucgagcggcuucaacgcaagcauggcgggaugcuggugagaaacccucugagcagaaauucuacgcacgaaauguacuggaucuccaacggaacaggcaauauuguuagcucugugaacauggucagcagacuccugcuuaaccgcuucaaaaugacccaucggagaccgaccaucgagaaggacguggaucugggggcuggaacacgccacgugaaugccgaacccgagacgccuaacauggacgucauuggcgagcggaucaaaagaaucaaggaagaacacaauuccaccuggcauuaugacgaugaaaaccccuacaaaacaugggcguaucacgggucuuacgagguuaaggccaccggaagcgcuuccagcaugauuaauggcguggugaagcuccugacaaaaccuugggacgucgugcccaugguuacccagauggccaugacagauaccacgccguuuggccagcaacgcguguucaaggaaaaagucgacacccggacaccuagacccaugccugggacccgcaaggugauggagaucacagcugaguggcuguggcggacccucggaagaaacaaacgcccccggcugugcacgagagaagaguuuacaaagaagguucgcaccaaugccgccaugggcgcgguguucacagaagagaaccagugggauuccgcuaaagccgccgucgaagacgaggaguuuuggaaacuuguggauagagaacgggagcugcauaaacucgggaaguguggaucuugcguuuauaauaugaugggcaaacgcgaaaagaaacugggggaguucggcaaggcuaagggaagcagagccauuugguacauguggcuuggcgcucgguaccuggaguuugaagcccucggguuccugaacgaggaccacugguuuuccagagaaaauucuuauagcggaguggagggcgaagggcugcauaaacucggauacauccugcgggauauuuccaagaucccuggcggggcgauguaugccgacgauaccgcuggcugggacacgcgcaucaccgaggacgaucuucacaacgaggagaagauuacacagcagauggaccccgagcacagacugcucgccaaugcuaucuucaagcugaccuaccaaaacaaagucgugaagguccagcggccgacaccuaccggaacagugauggauauuaucucucgcaaggaccagagaggcagcgggcagguuggaaccuauggccuuaauacguuuacaaacauggaagcccaacuggugcggcagauggagggggaaggaguccucuccaaagcggaucuggagaacccccaucugcccgagaagaaaauuacccaguggcucgaaaccaagggcguggagcgccugaaaagaauggccaucagcggggacgauugcgugguuaagccuaucgacgaucgguucgcuaaugcccuucuggcucucaacgacaugggcaaggugcgcaaagauauuccgcaguggcaacccucuaagggauggcacgacuggcagcaggucccuuuuuguucccaucacuuccacgaacugaucaugaaagauggcagaaaacuugugguucccugccggccucaggacgagcugauugggcgcgccagaaucagccaaggagcuggcuggucucuccgggaaacagccugucuggggaaagcguacgcccagauguggucccugauguauuuccaucgcagagaccuccggcuggcuagcaaugccauuugcucugccgugcccguccacugggugccuaccuccagaacaacguggagcauccaugcucaccaucaguggaugaccacagaggauaugcuuaccgucuggaaccgcguguggauugaggacaaucccuggauggaagauaagacaccgguuaccacgugggagaacgugccuuaccugggaaagcgggaagaccaaugguguggcucccucaucgggcugaccagcagagccacaugggcgcagaauauccccaccgcuauucagcagguccgcucucuuaucggcaacgaggaguuucuggauuacaugccuagcaugaaacgguucagaaaggaagaggaacucgagggagccauuugguga

SEQ ID NO: 20387 - RNA, 9873 nt, Artificial Sequence
  derived and/or modified CDS sequence (opt5) from DENV-3__KF041258__SS-prME
accagccugugccucaugaugauccugcccgcggcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucggcgggguucucaacagccuggggaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagaugugugaccaccggcugaugagcgcugccguuaaggaugagagagccgugcacgcugacaugggguacuggaucgagucccagaaaaacggaucuuggaaacuugaaaaagccagccucauugaggugaagaccugcaccuggccuaagucccauacacuguggucuaauggcguccuggaaagcgauaugaucauucccaaaucccucgcggggccuaucagccagcacaacuaucgccccggauaccauacccaaacggcuggcccuuggcaccuggggaaacuugagcuggacuuuaauuauugcgagggaacaaccgugguuauuacagaaaacuguggcacccggggccccucucucagaacaaccacgguguccgggaaacugauccacgaguggugcugucgcagcugcacccugccgccucuucgguacaugggagaagauggcuguugguaugggauggagaucagacccauuucugaaaaggaggagaauauggucaaaucccucgugagcgccggaucuggcaagguugacaacuucacaaugggggugcugugccuggccauccucuuugaagaggucaugcggggaaaguucggcaaaaagcauaugauugcuggcguguucuuuaccuucguucugcuucugagcgggcagaucacauggcgcgauauggcccacacccucauuaugaucggauccaaugcgagcgacagaaugggcaugggggugacguaccuggcucugauugccacauuuaaaauccagcccuuccuugcccugggauuuuuccuccggaagcugaccucuagagaaaaccuccugcuuggcgucgggcuggcuauggccacaacccuccaacugccugaggauaucgaacagauggcuaauggaauugcccugggccuuauggcgcugaaacucaugacccaguuugagacauaucagcuguggacggcccucaucucccugaccuguagcaacacaauuuucacccuuacaguggcuuggcgcaccgccacgcugauccucgcuggcgugucccugcugccggucugccaaucuagcuccaugcggaagacagacuggcuucccaugaccguugccgccaugggggugccuccccugccucucuuuauuuucucucugaaggauacccucaaaagacgcagcuggccccugaaugagggagugauggcugucggccuuguguccauccuggcgucuagccugcucagaaacgacguuccuauggccgggccccugguggcuggaggccuucugaucgccuguuacgucauuacagggaccuccgccgaucucacaguggaaaaggcugccgacguuacgugggaggaagaggcggaacagaccggagugagccauaaccugaugaucacagucgacgaugacggcaccaugcggauuaaagaugacgagacagagaauauccucaccgugcugcuuaagacggcucugcugauugucucuggcaucuuuccguacuccaucccugccacccuccugguguggcacacauggcagaaacagacccaacgcagcgggguucuuugggaugugcccucuccucccgaaacacagaaggccgagcuggaagagggagucuauagaauuaaacagcagggcauccucgggaagacccaagugggaguuggcgugcagaaggagggggucuuccauacaauguggcacgugacgcggggagcugugcugacccacaacggcaaacgccucgaaccgaauugggccuccguuaagaaagaccugauuagcuacggcgggggauggagacuuucugcgcaguggcaaaagggcgaggaaguccaggugaucgcuguggagccugggaaaaaccccaagaauuuucagacaaugccuggaaccuuccagaccacaacgggcgaaauuggggccaucgcccuggauuucaagcccggaaccuccggcagccccauuaucaaccgggagggcaaagucguggggcuguauggaaauggcguugugacaaagaacgggggauacgucuccggcaucgcucaaaccaaugccgagccugacgggccgacacccgaacucgaggaagagauguuuaaaaagcgcaaccugaccauuauggaucuucauccuggcagcggaaaaacgagaaaguaucugcccgcuaucgugcgggaagccauuaagcgcagacuccggacacugauccucgcgccuaccagaguuguggccgcugagauggaggaagcccugaaaggccuucccauucgcuaccagaccacagcuaccaagucugagcacacagggcgggaaaucgucgaccugaugugccaugccaccuucacgaugagacugcucagcccugugcgcguuccgaauuauaaccugaucauuauggaugaggcccacuuuacagaccccgcuuccaucgcggcccggggauacauuucuaccagagugggcaugggggaagcugccgccaucuucaugacagcuaccccucccggaacggccgaugcguuuccucagagcaaugcucccauucaggacgaggagcgcgacaucccggaacgguccuggaacucuggcaaugaguggaucaccgauuucgccgggaaaacagucugguuugugccuagcauuaaggccggcaacgacaucgcuaacugucuucgcaaaaauggaaagaaggugauucaacuguccagaaaaaccuucgauacagaauaccagaagaccaaacucaacgacugggauuuugucguuacaaccgacaucucugagaugggcgccaauuucaaggcggaucgggugauugaccccagacggugccugaaacccgugauccugacggaugggccugagcgcgucauucucgccggacccaugccugugacagcugccagcgcugcccagagacggggccgcguugggagaaacccgcagaaggaaaaugaccaauauaucuuuaccggacagccccuuaacaaugaugaggaccaugcucacuggaccgaagccaagaugcugcuggacaacaucaauacaccugagggcauuauccccgcccucuucgaaccugagcgggagaaauccgccgcuauugauggggaauacagacugaagggcgagagccgcaaaaccuucguggaacuuaugcggagaggagaccugcccgucuggcucgcccacaagguggcuucugagggcaucaaauauacagaucgcaaguggugcuuugacgggcagcggaacaaucagauucuggaagagaacauggauguugagaucuggacgaaagaaggagagaagagaaagcugcgcccgcgguggcucgacgccagaaccuacuccgauccucuugcccugaaagaguucaaggacuuugcugcgggccgcaaaagcaucgcccuggaucucgugacagagauugggagaguccccucucaucuggcucaccggacccgcaaugcccuugacaaccuggugaugcuccauacauccgaacacggaggcagagccuaucggcacgcugucgaggagcugccugaaaccauggagacgcugcuccuucugggccugaugauccuccugaccgggggagccaugcuuuuccugauuagcggcaaggggaucggaaaaacauccauuggccucaucugugugaucgcgucuagcgggaugcuguggauggccgaaauuccccugcaauggaucgcuuccgccauuguucucgaguuuuucaugauggugcuucugaucccugagcccgaaaagcagcgcaccccgcaggauaaucaacuggcuuacguggucauuggaauccucacacuggccgcgauuaucgccgcuaacgagaugggccuucuggaaaccacgaagagagaccucggcaugagcaaagagccugggguugugucucccacauccuaucuggauguggaccugcaucccgccagcgcuuggacccucuacgccgucgcuacaaccgugaucaccccuaugcuucggcacacaauugaaaauucuacggccaacguuagccuggcggccaucgcuaaccaggccgugguccugaugggacucgacaagggcuggccgauuuccaaaauggaucugggggugccccuucuggcucucggaugcuacucucaggucaauccucugacccugacagccgccgugcuccuucugaucacccauuaugcgauuaucggccccgggcugcaggcuaaggccacaagagaggcucaaaaacgcaccgccgccggaaucaugaagaacccuacgguugacggcauuaucacaauugaucucgaccccgugaucuacgauagcaaguuugagaaacagcugggccaggucaugcuucuggugcucugugcuguucagcugcugcucaugcggaccuccugggcccuuugcgaagcgcugacccuggccacagggccuauuaccacacucugggagggaucuccgggcaaguucuggaauacgaccaucgcugugagcauggccaacaucuuuagaggguccuaucuggcuggagccggccuugcguucagcauuaugaaaucugucgggacaggaaagcgcggcaccggcucccaaggggaaacacugggagagaaauggaagaagaaacucaaucagcugagccggaaggaauuugaccuguacaaaaaguccggcaucaccgagguggauagaacggaggccaaagaagggcucaagcggggagagaccacacaccaugcugugucucgcggcagcgccaaacuucagugguucguugaaagaaacauggucauucccgaggggcgggugaucgaccugggauguggccgcggcgggugguccuauuacugcgcuggacugaagaaggugaccgaagucagaggcuauacaaaagggggaccuggccacgaggagcccguuccuaugucuaccuacggguggaauauugugaagcucaugagcggaaaagauguguuuuaccugcccccggaaaagugugacacacuucugugcgauaucggcgaguccagcccuucucccaccgucgaagagucccggacgauucgcgugcucaaaaugguugagcccuggcugaagaacaaucaguucuguaucaaggugcugaacccuuauaugcccgccgucaucgaacaccucgagagacuucaacggaaacauggcgggaugcuggugcgcaauccucugagcagaaacucuacacacgaaauguacuggauuuccaauggaaccggcaacaucguuagcucugugaauauggucagccggcuccugcuuaacagauucaccaugacacaucgccggccgacgauugagaaggacguggaucugggggcuggaaccagacacgugaacgccgaacccgagacaccuaauauggacgucaucggcgagcgcauuaaacggaucaaggaagaacacaacuccaccuggcauuaugacgaugaaaaucccuacaaaacaugggcguaucacgggucuuacgagguuaaggccaccggaagcgcuuccagcaugaucaacggcguggugaagcuccugacaaaaccuugggacgucgugcccaugguuacccagauggccaugacggauaccacaccguuuggccagcaaagaguguucaaggaaaaagucgacacccgcacaccucggcccaugccugggaccagaaaggugauggagauuacggcugaguggcuguggcgcacacucggacggaauaaaagaccccgccugugcacccgggaagaguuuacaaagaagguuagaaccaacgccgccaugggcgcgguguucacggaagagaaucagugggauuccgcuaaagccgccgucgaagacgaggaguuuuggaaacuuguggaucgcgaaagagagcugcauaaacucgggaaguguggaucuugcguuuauaacaugaugggcaaacgggaaaagaaacugggggaguucggcaaggcuaagggaagccgcgccaucugguacauguggcuuggcgcuagauaccuggaguuugaagcccucggguuccugaaugaggaccacugguuuucccgggaaaacucuuauagcggaguggagggcgaagggcugcauaaacucggauacguccugagagauauuuccaagaucccuggcggggcgauguaugccgacgauaccgcuggcugggacacacggauuaccgaggacgaucuucacaaugaggagaagaucacacagcagauggaccccgagcaccgccugcucgccaacgcuaucuucaagcugaccuaccaaaauaaaguggucaaggugcagagaccgacaccuaccggaacgguuauggauauuaucucucggaaggaccagcgcggcagcggacaggugggaacauauggccuuaacaccuuuaccaauauggaagcccaacuggucagacagauggagggggaaggagugcucuccaaagcggaucuggagaacccccaucugcccgagaagaaaauuacacaguggcucgaaaccaagggcguggagcggcugaaacgcauggccaucagcggggacgauugcguugugaagccuauugacgauagauucgcuaacgcccuucuggcucucaaugacaugggcaagguccggaaagauaucccgcaguggcaacccucuaagggauggcacgacuggcaacaggugccuuuuuguucccaucacuuccacgaacugaucaugaaagauggccgcaaacuuguugugcccugcagaccucaggacgagcugauugggcgggcccgcaucagccaaggagcuggcuggucucucagagaaacagccugucuggggaaagcguacgcccagauguggucccugauguauuuccaucggcgcgaccucagacuggcuagcaacgccauuugcucugccguccccgugcacugggucccuacgucccggaccacauggagcauccaugcucaccaucaguggaugaccacagaggauaugcuuaccguguggaauagaguuuggauugaggacaaccccuggauggaagauaagacgccggugaccacaugggagaaugucccuuaccugggaaagcgcgaagaccaaugguguggcucccucaucgggcugaccagccgggccacaugggcgcagaacauucccaccgcuauccaacaggugagaucucuuaucggcaaugaggaguuucuggauuacaugccuagcaugaaacgcuuccggaaggaagaggaacucgagggagccauuugguga

SEQ ID NO: 20388 - RNA, 9873 nt, Artificial Sequence
  derived and/or modified CDS sequence (opt5) from DENV-3__KF041257__SS-prME
accagccugugccucaugaugauccugcccgcggcucuugccuuccaccugacaucccgggacggagaaccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagaugugugaccaccggcugaugagcgcugccguuaaggaugagagagccgugcacgcugacaugggguacuggaucgagucccagaaaaacggaucuuggaaacuugaaaaagccagccucauugaggugaagaccugcaccuggccuaagucccauacacuguggucuaauggcguccuggaaagcgauaugaucauucccaaaucccucgcggggccuaucagccagcacaacuaucgccccggauaccauacccaaacggcuggcccuuggcaccuggggaaacuugagcuggacuuuaauuauugcgagggaacaaccgugguuauuacagaaaacuguggcacccggggccccucucucagaacaaccacgguguccgggaaacugauccacgaguggugcugucgcagcugcacccugccgccucuucgguacaugggagaagauggcuguugguaugggauggagaucagacccauuucugaaaaggaggagaauauggucaaaucccucgugagcgccggaucuggcaagguugacaacuucacaaugggggugcugugccuggccauccucuuugaagaggucaugcggggaaaguucggcaaaaagcauaugauugcuggcguguucuuuaccuucguucugcuucugagcgggcagaucacauggcgcgauauggcccacacccucauuaugaucggauccaaugcgagcgacagaaugggcaugggggugacguaccuggcucugauugccacauuuaaaauccagcccuuccuugcccugggauuuuuccuccggaagcugaccucuagagaaaaccuccugcuuggcgucgggcuggcuauggccacaacccuccaacugccugaggauaucgaacagauggcuaauggaauugcccugggccuuauggcgcugaaacucaucacccaguuugagacauaucagcuguggacggcccucauuucccugaccuguagcaacacaaucuucacccuuacaguggcuuggcgcaccgccacgcugauucucgcuggcgugucccugcugccggucugccaaucuagcuccaugcggaagacagacuggcuucccaugaccguugccgccaugggggugccuccccugccucucuuuaucuucucucugaaggauacccucaaaagacgcagcuggccccugaaugagggagugauggcugucggccuuguguccauccuggcgucuagccugcucagaaacgacguuccuauggccgggccccugguggcuggaggccuucugauugccuguuacgucaucacagggaccuccgccgaucucacaguggaaaaggcugccgacguuacgugggaggaagaggcggaacagaccggagugagccauaaccugaugauuacagucgacgaugacggcaccaugcggaucaaagaugacgagacagagaauauucucaccgugcugcuuaagacggcucugcugaucgucucuggcaucuuuccguacuccauuccugccacccuccugguguggcacacauggcagaaacagacccaacgcagcgggguucuuugggaugugcccucuccucccgaaacacagaaggccgagcuggaagagggagucuauagaaucaaacagcagggcauucucgggaagacccaagugggaguuggcgugcagaaggagggggucuuccauacaauguggcacgugacgcggggagcugugcugacccacaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuucagacaaugccuggaaccuuccagaccacaacgggcgaaaucggggccauugcccuggauuucaagcccggaaccuccggcagccccaucaucaaccgggagggcaaagucguggggcuguauggaaauggcguugugacaaagaacgggggauacgucuccggcauugcucaaaccaaugccgagccugacgggccgacacccgaacucgaggaagagauguuuaaaaagcgcaaccugaccaucauggaucuucauccuggcagcggaaaaacgagaaaguaucugcccgcuauugugcgggaagccaucaagcgcagacuccggacacugauucucgcgccuaccagaguuguggccgcugagauggaggaagcccugaaaggccuucccauccgcuaccagaccacagcuaccaagucugagcacacagggcgggaaaucgucgaccugaugugccaugccaccuucacgaugagacugcucagcccugugcgcguuccgaauuauaaccugauuaucauggaugaggcccacuuuacagaccccgcuuccauugcggcccggggauacaucucuaccagagugggcaugggggaagcugccgccauuuucaugacagcuaccccucccggaacggccgaugcguuuccucagagcaaugcucccauccaggacgaggagcgcgacaucccggaacgguccuggaacucuggcaaugaguggauuaccgauuucgccgggaaaacagucugguuugugccuagcaucaaggccggcaacgacauugcuaacugucuucgcaaaaauggaaagaaggugauccaacuguccagaaaaaccuucgauacagaauaccagaagaccaaacucaacgacugggauuuugucguuacaaccgacauuucugagaugggcgccaauuucaaggcggaucgggugaucgaccccagacggugccugaaacccgugauucugacggaugggccugagcgcgucauccucgccggacccaugccugugacagcugccagcgcugcccagagacggggccgcguugggagaaacccgcagaaggaaaaugaccaauauaucuuuaccggacagccccuuaacaaugaugaggaccaugcucacuggaccgaagccaagaugcugcuggacaacauuaauacaccugagggcaucauucccgcccucuucgaaccugagcgggagaaauccgccgcuaucgauggggaauacagacugaagggcgagagccgcaaaaccuucguggaacuuaugcggagaggagaccugcccgucuggcucgcccacaagguggcuucugagggcauuaaauauacagaucgcaaguggugcuuugacgggcagcggaacaaucagauccuggaagagaacauggauguugagaucuggacgaaagaaggagagaagagaaagcugcgcccgcgguggcucgacgccagaaccuacuccgauccucuugcccugaaagaguucaaggacuuugcugcgggccgcaaaagcauugcccuggaucucgugacagagaucgggagaguccccucucaucuggcucaccggacccgcaaugcccuugacaaccuggugaugcuccauacauccgaacacggaggcagagccuaucggcacgcugucgaggagcugccugaaaccauggagacgcugcuccuucugggccugaugauucuccugaccgggggagccaugcuuuuccugaucagcggcaaggggauuggaaaaacauccaucggccucaucugugugauugcgucuagcgggaugcuguggauggccgaaaucccccugcaauggauugcuuccgccaucguucucgaguuuuucaugauggugcuucugauuccugagcccgaaaagcagcgcaccccgcaggauaaucaacuggcuuacguggucaucggcauucucacacuggccgcgaucaucgccgcuaacgagaugggccuucuggaaaccacgaagagagaccucggcaugagcaaagagccugggguugugucucccacauccuaucuggauguggaccugcaucccgccagcgcuuggacccucuacgccgucgcuacaaccgugauuaccccuaugcuucggcacacaaucgaaaauucuacggccaacguuagccuggcggccauugcuaaccaggccgugguccugaugggacucgacaagggcuggccgaucuccaaaauggaucugggggugccccuucuggcucucggaugcuacucucaggucaauccucugacccugacagccgccgugcuccuucugauuacccauuaugcgaucaucggccccgggcugcaggcuaaggccacaagagaggcucaaaaacgcaccgccgccggaauuaugaagaacccuacgguugacggcaucauuacaaucgaucucgaccccgugauuuacgauagcaaguuugagaaacagcugggccaggucaugcuucuggugcucugugcuguucagcugcugcucaugcggaccuccugggcccuuugcgaagcgcugacccuggccacagggccuaucaccacacucugggagggaucuccgggcaaguucuggaauacgaccaucgcugugagcauggccaacauuuuuagaggguccuaucuggcuggagccggccuugcguucagcaucaugaaaucugucgggacaggaaagcgcggcaccggcucccaaggggaaacacugcgggagaaauggaagaagaaacucaaucagcugagcagaaaggaauuugaccuguacaaaaaguccggaauuaccgagguggaucggacggaggccaaagaaggccucaagcgcggggagaccacacaccaugcugugucuagaggaagcgccaaacuucagugguucguugaacggaacauggucauccccgagggccgcgugauugaccugggguguggaagaggcggcugguccuauuacugcgcugggcugaagaaggugaccgaaguccggggauauacaaaaggcgggccuggacacgaggagcccguuccuaugucuaccuacggcuggaauaucgugaagcucaugagcgggaaagauguguuuuaccugcccccggaaaagugugacacacuucugugcgauauuggagaguccagcccuucucccaccgucgaagagucccgcacgaucagagugcucaaaaugguugagcccuggcugaagaacaaucaguucuguaucaaggugcugaacccuuauaugcccgccgucauugaacaccucgagcggcuucaacgcaaacauggcggcaugcuggugagaaauccucugagccggaacucuacacacgaaauguacuggaucuccaaugggaccggaaacauuguuagcucugugaauauggucagcagacuccugcuuaaccgcuucaccaugacacaucggagaccgacgaucgagaaggacguggaucugggcgcugggacccgccacgugaacgccgaacccgagacaccuaauauggacgucauuggagagcggaucaaaagaaucaaggaagaacacaacuccaccuggcauuaugacgaugaaaaucccuacaaaacaugggcguaucacggcucuuacgagguuaaggccaccgggagcgcuuccagcaugauuaacggaguggugaagcuccugacaaaaccuugggacgucgugcccaugguuacccagauggccaugacggauaccacaccguuuggccagcaacgcguguucaaggaaaaagucgacacccggacaccuagacccaugccuggcacccgcaaggugauggagaucacggcugaguggcuguggcggacacucgggagaaauaaacgcccccggcugugcaccagagaagaguuuacaaagaagguucgcaccaacgccgccaugggagcgguguucacggaagagaaucagugggauuccgcuaaagccgccgucgaagacgaggaguuuuggaaacuuguggauagagaacgggagcugcauaaacucggcaagugugggucuugcguuuauaacaugaugggaaaacgcgaaaagaaacugggcgaguucgggaaggcuaagggcagcagagccauuugguacauguggcuuggagcucgguaccuggaguuugaagcccucggcuuccugaaugaggaccacugguuuuccagagaaaacucuuauagcgggguggagggagaaggccugcauaaacucggguacauccugcgggauauuuccaagaucccuggaggcgcgauguaugccgacgauaccgcugggugggacacacgcaucaccgaggacgaucuucacaaugaggagaagauuacacagcagauggaccccgagcacagacugcucgccaacgcuaucuucaagcugaccuaccaaaauaaagucgugaagguccagcggccgacaccuaccggcacggugauggauauuaucucucgcaaggaccagagaggaagcggccagguugggacauauggacuuaacaccuuuaccaauauggaagcccaacuggugcggcagauggagggcgaagggguccucuccaaagcggaucuggagaacccccaucugcccgagaagaaaauuacacaguggcucgaaaccaagggaguggagcgccugaaaagaauggccaucagcggcgacgauugcgugguuaagccuaucgacgaucgguucgcuaacgcccuucuggcucucaaugacauggggaaggugcgcaaagauauuccgcaguggcaacccucuaagggcuggcacgacuggcagcaggucccuuuuuguucccaucacuuccacgaacugaucaugaaagauggaagaaaacuugugguucccugccggccucaggacgagcugauuggccgcgccagaaucagccaaggggcuggauggucucuccgggaaacagccugucugggcaaagcguacgcccagauguggucccugauguauuuccaucgcagagaccuccggcuggcuagcaacgccauuugcucugccgugcccguccacugggugccuacguccagaaccacauggagcauccaugcucaccaucaguggaugaccacagaggauaugcuuaccgucuggaaucgcguguggauugaggacaaccccuggauggaagauaagacgccgguuaccacaugggagaaugugccuuaccuggggaagcgggaagaccaaugguguggaucccucaucggccugaccagcagagccacaugggcgcagaacauccccaccgcuauucagcagguccgcucucuuaucgggaaugaggaguuucuggauuacaugccuagcaugaaacgguucagaaaggaagaggaacucgagggcgccauuugguga

SEQ ID NO: 20389 - RNA, 9873 nt, Artificial Sequence
  derived and/or modified CDS sequence (opt5) from DENV-3__KF041255__SS-prME
accagccugugccucaugaugauccugcccgcggcucuugccuuccaccugacaucccggaauggagaaccucggaugauuguggggaagaaugaacgcggaaagucucuccuguuuaagacggcgagcggcaucaacauguguacccuuauugcuauggaccugggggagaugugcgaugacacagugaccuacaaauguccgcauaucacagaaguugagcccgaagauauugacugcugguguaaucucaccuccacaugggugaccuauggaacgugcaaccaggccggcgagcaccggcgggauaagcgcucuguggcccuggcuccucaugucgggaugggacuggacaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaucgggauuuugucgaagggcucagcggagcuaccuggguggacgugguccuggagcacggcgggugcguuaccacaauggccaagaacaaacccacgcuggauauugagcuccagaagaccgaagcuacacaacuggccacccuucgcaaacuguguaucgagggaaagauuacaaauaucaccacggacuccagaugcccuacacagggcgaagcggugcucccggaggaacaggaucagaacuauguguguaaacacaccuacgucgaccggggcugggggaauggaugcggccuguucgggaagggaagccuugugaccugcgccaaguuucaaugucuggagcccauugagggcaaaguugugcaguaugaaaaccucaaguacacagucaucaucaccgugcauacaggggaucagcaccagguuggaaaugagacgcaaggcgugaccgcugaaauuacaccucaggccucuaccacagaggcuauccugcccgaauauggcacccuggggcucgagugcuccccucgcacgggacuggacuucaacgagaugauucuucugaccaugaaaaauaaggccuggaugguccauagacagugguuuuucgaccucccccugccguggacaagcggcgccaccacagaaaccccuacguggaaccggaaagagcuucuggugacauuuaagaaugcucacgcgaaaaagcaagaagucgugguucucgggucucaggagggagccaugcacaccgcucugacaggcgccaccgaaauccagaacuccgggggcaccagcauuuucgccggacaucugaagugucgccucaaaauggauaagcuggagcuuaaaggcaugucuuacgcuaugugcacaaacacguuugugcugaagaaagaggucuccgaaacccagcacgggacaauccucaucaagguggaguacaagggagaagacgcccccuguaaaauuccuuucagcaccgaggauggccaagggaaggcgcauaauggaagacugaucacagcuaaccccguugugaccaaaaaggaggaacccgucaauauugaggccgaaccuccguucggcgaguccaacaucgugauugggaucggcgacaaugcccugaaaaucaacugguauaagaagggaucuagcauuggcaaaauguuugaagcuacggccagaggggcuagacgcauggccauccuuggagauacagcgugggacuucggcuccgucgggggaguucucaauagccugggcaagaugguccaccagauuuuugggucugccuacaccgcucuguucuccggcgugagcugggugaugaaaaucggaauuggcguccuccugaccuggaucgggcuuaacucuaagaauacaagcauguccuuuucuugcauugccaucggaaucauuacccuguaucucggcgcugugguucaggccgauauggggugugugaucaacuggaaaggaaaggagcugaagugcggcagcgggauuuucgucacaaaugaggugcauacguggaccgaacaguacaaauuucaagcggacucccccaagcggcuggccacagcuaucgccggcgcuugggagaacggaguuuguggcauuagaagcaccacacgcauggaaaaucuucucuggaaacagaucgccaacgagcugaauuauauccugugggaaaacaacauuaagcucaccguggucgugggggauacgaucggaguucuggagcagggcaaacggacccuuacaccucagcccauggagcugaaguacucuuggaaaaccugggggaaggccaagauugugacagcugaaacccaaaauuccagcuucaucauugacggaccuaacacacccgagugcccgucugcguccagagccuggaaugucugggaaguggaggauuauggcuuuggcguguucaccacgaacaucuggcucaaacugcgcgaagucuacacacagaugugugaccaccggcugaugagcgcugccguuaaggacgagagagccgugcacgcugauaugggguacuggaucgagucccagaaaaauggaucuuggaaacuugaaaaagccagccucauugaggugaagaccugcaccuggccuaagucccauacacuguggucuaacggcguccuggaaagcgacaugaucauucccaaaucccucgcggggccuaucagccagcacaauuaucgccccggauaccauacccaaacggcuggcccuuggcaccuggggaaacuugagcuggauuuuaacuauugcgagggaacaaccgugguuauuacagaaaauuguggcacccggggccccucucucagaacaaccacgguguccgggaaacugauccacgaguggugcugucgcagcugcacccugccgccucuucgguacaugggagaagacggcuguugguaugggauggagaucagacccauuucugaaaaggaggagaacauggucaaaucccucgugagcgccggaucuggcaagguugauaauuucacaaugggggugcugugccuggccauccucuuugaagaggucaugcggggaaaguucggcaaaaagcauaugauugcuggcguguucuuuaccuucguucugcuucugagcgggcagaucacauggcgcgacauggcccacacccucauuaugaucggauccaacgcgagcgauagaaugggcaugggggugacguaccuggcucugauugccacauuuaaaauccagcccuuccuugcccugggauuuuuccuccggaagcugaccucuagagaaaaucuccugcuuggcgucgggcuggcuauggccacaacccuccaacugccugaggacaucgaacagauggcuaacggaauugcccugggccuuauggcgcugaaacucaucacccaguuugagacauaucagcuguggacggcccucauuucccugaccuguagcaauacaaucuucacccuuacaguggcuuggcgcaccgccacgcugauucucgcuggcgugucccugcugccggucugccaaucuagcuccaugcggaagacagauuggcuucccaugaccguugccgccaugggggugccuccccugccucucuuuaucuucucucugaaggacacccucaaaagacgcagcuggccccugaacgagggagugauggcugucggccuuguguccauccuggcgucuagccugcucagaaacgauguuccuauggccgggccccugguggcuggaggccuucugauugccuguuacgucaucacagggaccuccgccgaccucacaguggaaaaggcugccgauguuacgugggaggaagaggcggaacagaccggagugagccauaaucugaugauuacagucgacgacgauggcaccaugcggaucaaagacgaugagacagagaacauucucaccgugcugcuuaagacggcucugcugaucgucucuggcaucuuuccguacuccauuccugccacccuccugguguggcacacauggcagaaacagacccaacgcagcgggguucuuugggacgugcccucuccucccgaaacacagaaggccgagcuggaagagggagucuauagaaucaaacagcagggcauucucgggaagacccaagugggaguuggcgugcagaaggagggggucuuccauacaauguggcacgugacgcggggagcugugcugacccacaauggcaaacgccucgaaccgaacugggccuccguuaagaaagaucugaucagcuacggcgggggauggagacuuucugcgcaguggcaaaagggcgaggaaguccaggugauugcuguggagccugggaaaaaucccaagaacuuucagacaaugccuggaaccuuccagaccacaacgggcgaaaucggggccauugcccuggacuucaagcccggaaccuccggcagccccaucaucaaucgggagggcaaagucguggggcuguauggaaacggcguugugacaaagaaugggggauacgucuccggcauugcucaaaccaacgccgagccugaugggccgacacccgaacucgaggaagagauguuuaaaaagcgcaaucugaccaucauggaccuucauccuggcagcggaaaaacgagaaaguaucugcccgcuauugugcgggaagccaucaagcgcagacuccggacacugauucucgcgccuaccagaguuguggccgcugagauggaggaagcccugaaaggccuucccauccgcuaccagaccacagcuaccaagucugagcacacagggcgggaaaucgucgaucugaugugccaugccaccuucacgaugagacugcucagcccugugcgcguuccgaacuauaaucugauuaucauggacgaggcccacuuuacagaucccgcuuccauugcggcccggggauacaucucuaccagagugggcaugggggaagcugccgccauuuucaugacagcuaccccucccggaacggccgacgcguuuccucagagcaacgcucccauccaggaugaggagcgcgacaucccggaacgguccuggaacucuggcaacgaguggauuaccgacuucgccgggaaaacagucugguuugugccuagcaucaaggccggcaacgauauugcuaauugucuucgcaaaaacggaaagaaggugauccaacuguccagaaaaaccuucgacacagaauaccagaagaccaaacucaaugauugggacuuugucguuacaaccgauauuucugagaugggcgccaacuucaaggcggaccgggugaucgaucccagacggugccugaaacccgugauucugacggacgggccugagcgcgucauccucgccggacccaugccugugacagcugccagcgcugcccagagacggggccgcguugggagaaauccgcagaaggaaaacgaucaauauaucuuuaccggacagccccuuaauaacgacgaggaucaugcucacuggaccgaagccaagaugcugcuggacaauauuaacacaccugagggcaucauucccgcccucuucgaaccugagcgggagaaauccgccgcuaucgacggggaauacagacugaagggcgagagccgcaaaaccuucguggaacuuaugcggagaggagaucugcccgucuggcucgcccacaagguggcuucugagggcauuaaauauacagaccgcaaguggugcuuugaugggcagcggaauaaccagauccuggaagagaauauggacguugagaucuggacgaaagaaggagagaagagaaagcugcgcccgcgguggcucgaugccagaaccuacuccgacccucuugcccugaaagaguucaaggauuuugcugcgggccgcaaaagcauugcccuggaccucgugacagagaucgggagaguccccucucaucuggcucaccggacccgcaacgcccuugauaaucuggugaugcuccauacauccgaacacggaggcagagccuaucggcacgcugucgaggagcugccugaaaccauggagacgcugcuccuucugggccugaugauucuccugaccgggggagccaugcuuuuccugaucagcggcaaggggauuggaaaaacauccaucggccucaucugugugauugcgucuagcgggaugcuguggauggccgaaaucccccugcaauggauugcuuccgccaucguucucgaguuuuucaugauggugcuucugauuccugagcccgaaaagcagcgcaccccgcaggacaaccaacuggcuuacguggucaucggcauucucacacuggccgcgaucaucgccgcuaaugagaugggccuucuggaaaccacgaagagagaucucggcaugagcaaagagccugggguugugucucccacauccuaucuggacguggaucugcaucccgccagcgcuuggacccucuacgccgucgcuacaaccgugauuaccccuaugcuucggcacacaaucgaaaacucuacggccaacguuagccuggcggccauugcuaaucaggccgugguccugaugggacucgacaagggcuggccgaucuccaaaauggaccugggggugccccuucuggcucucggaugcuacucucaggucaacccucugacccugacagccgccgugcuccuucugauuacccauuaugcgaucaucggccccgggcugcaggcuaaggccacaagagaggcucaaaaacgcaccgccgccggaauuaugaagaauccuacgguugauggcaucauuacaaucgaccucgaucccgugauuuacgacagcaaguuugagaaacagcugggccaggucaugcuucuggugcucugugcuguucagcugcugcucaugcggaccuccugggcccuuugcgaagcgcugacccuggccacagggccuaucaccacacucugggagggaucuccgggcaaguucuggaacacgaccaucgcugugagcauggccaauauuuuuagaggguccuaucuggcuggagccggccuugcguucagcaucaugaaaucugucgggacaggaaagcgcggcaccggcucccaaggggaaacacugggagagaaauggaagaagaaacucaaccagcugagccggaaggaauuugaucuguacaaaaaguccggcauuaccgagguggacagaacggaggccaaagaagggcucaagcggggagagaccacacaccaugcugugucucgcggcagcgccaaacuucagugguucguugaaagaaauauggucauccccgaggggcgggugauugaucugggauguggccgcggcgggugguccuauuacugcgcuggacugaagaaggugaccgaagucagaggcuauacaaaagggggaccuggccacgaggagcccguuccuaugucuaccuacggguggaacaucgugaagcucaugagcggaaaagacguguuuuaccugcccccggaaaagugugauacacuucugugcgacauuggcgaguccagcccuucucccaccgucgaagagucccggacgauccgcgugcucaaaaugguugagcccuggcugaagaauaaccaguucuguaucaaggugcugaauccuuauaugcccgccgucauugaacaccucgagagacuucaacggaaacauggcgggaugcuggugcgcaacccucugagcagaaauucuacacacgaaauguacuggaucuccaacggaaccggcaauauuguuagcucugugaacauggucagccggcuccugcuuaacagauucaagaugacccaucgccggccgacaaucgagaaagauguggaccugggggcuggaacgagacacgugaaugccgaacccgagaccccuaacauggaugucauuggcgagcgcaucaagcggaucaaagaagaacacaauuccacauggcauuaugacgacgaaaaccccuacaagaccugggcguaucacgggucuuacgagguuaaggccacaggaagcgcuuccagcaugauuaauggcguggugaaacuccugaccaagccuugggaugucgugcccaugguuacacagauggccaugaccgacacgaccccguuuggccagcaaagaguguucaaagaaaaggucgauacacgcaccccucggcccaugccugggacaagaaaagugauggagaucaccgcugaguggcuguggcgcacgcucggacggaacaagagaccccgccugugcacacgggaagaguuuaccaagaaaguuagaacaaaugccgccaugggcgcgguguucaccgaagagaaccagugggacuccgcuaaggccgccgucgaagaugaggaguuuuggaaacuuguggaccgcgaaagagagcugcauaagcucgggaaauguggaucuugcguuuauaauaugaugggcaagcgggagaagaagcugggggaguucggcaaggcuaaaggaagccgcgccauuugguacauguggcuuggcgcuagauaccuggaguuugaagcccucggguuccugaacgaggaucacugguuuucccgggaaaauucuuauagcggaguggagggcgaagggcugcauaagcucggauacauccugagagacauuuccaaaaucccuggcggggcgauguaugccgaugacacggcuggcugggauacccggaucacagaggacgaccuucacaacgaggaaaagauuacccagcagauggaucccgagcaccgccugcucgccaaugcuaucuucaaacugacauaccaaaacaaggucgugaagguccagagaccgaccccuacaggaaccgugauggacauuaucucucggaaagaucagcgcggcagcgggcagguuggaacguauggccuuaauacauuuaccaacauggaagcccaacuggugagacagauggagggggaaggaguccucuccaaggcggaccuggagaacccccaucugcccgagaaaaagauuacccaguggcucgaaacaaaaggcguggagcggcugaagcgcauggccaucagcggggaugacugcgugguuaagccuaucgaugacagauucgcuaaugcccuucuggcucucaacgauaugggcaaagugcggaaggacauuccgcaguggcaacccucuaaaggauggcacgauuggcagcaggucccuuuuuguucccaucacuuccacgaacugaucaugaaggacggccgcaaacuugugguucccugcagaccucaggaugagcugauugggcgggcccgcaucagccaaggagcuggcuggucucucagagaaaccgccugucuggggaaggcguacgcccagauguggucccugauguauuuccaucggcgcgaccucagacuggcuagcaaugccauuugcucugccgugcccguccacugggugccuacaucccggacgaccuggagcauccaugcucaccaucaguggaugacaaccgaggacaugcuuacagucuggaacagaguguggauugaggauaaucccuggauggaagacaagaccccgguuacgaccugggagaacgugccuuaccugggaaaacgcgaagaucaaugguguggcucccucaucgggcugacaagccgggccaccugggcgcagaauauccccacagcuauucagcaggucagaucucuuaucggcaacgaggaguuucuggacuacaugccuagcaugaagcgcuuccggaaagaagaggaacucgagggagccauuugguga

SEQ ID NO: 20390 - RNA, 9873 nt, Artificial Sequence
  derived and/or modified CDS sequence (opt5) from DENV-3__KF041256__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaagcccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagaugugugaccaccggcugaugagcgcugccguuaaggaugagagagccgugcacgcugacaugggguacuggaucgagucccagaaaaacggaucuuggaaacuugaaaaagccagccucauugaggugaagaccugcaccuggccuaagucccauacacuguggucuaauggcguccuggaaagcgauaugaucauucccaaaucccucgcggggccuaucagccagcacaacuaucgccccggauaccauacccaaacggcuggcccuuggcaccuggggaaacuugagcuggacuuuaauuauugcgagggaacaaccgugguuauuacagaaaacuguggcacccggggccccucucucagaacaaccacgguguccgggaaacugauccacgaguggugcugucgcagcugcacccugccgccucuucgguacaugggagaagauggcuguugguaugggauggagaucagacccauuucugaaaaggaggagaauauggucaaaucccucgugagcgccggaucuggcaagguugacaacuucacaaugggggugcugugccuggccauccucuuugaagaggucaugcggggaaaguucggcaaaaagcauaugauugcuggcguguucuuuaccuucguucugcuucugagcgggcagaucacauggcgcgauauggcccacacccucauuaugaucggauccaaugcgagcgacagaaugggcaugggggugacguaccuggcucugauugccacauuuaaaauccagcccuuccuugcccugggauuuuuccuccggaagcugaccucuagagaaaaccuccugcuuggcgucgggcuggcuauggccacaacccuccaacugccugaggauaucgaacagauggcuaauggaauugcccugggccuuauggcgcugaaacucaucacccaguuugagacauaucagcuguggacggcccucauuucccugaccuguagcaacacaaucuucacccuuacaguggcuuggcgcaccgccacgcugauucucgcuggcgugucccugcugccggucugccaaucuagcuccaugcggaagacagacuggcuucccaugaccguugccgccaugggggugccuccccugccucucuuuaucuucucucugaaggauacccucaaaagacgcagcuggccccugaaugagggagugauggcugucggccuuguguccauccuggcgucuagccugcucagaaacgacguuccuauggccgggccccugguggcuggaggccuucugauugccuguuacgucaucacagggaccuccgccgaucucacaguggaaaaggcugccgacguuacgugggaggaagaggcggaacagaccggagugagccauaaccugaugauuacagucgacgaugacggcaccaugcggaucaaagaugacgagacagagaauauucucaccgugcugcuuaagacggcucugcugaucgucucuggcaucuuuccguacuccauuccugccacccuccugguguggcacacauggcagaaacagacccaacgcagcgggguucuuugggaugugcccucuccucccgaaacacagaaggccgagcuggaagagggagucuauagaaucaaacagcagggcauucucgggaagacccaagugggaguuggcgugcagaaggagggggucuuccauacaauguggcacgugacgcggggagcugugcugacccacaacggcaaacgccucgaaccgaauugggccuccguuaagaaagaccugaucagcuacggcgggggauggagacuuucugcgcaguggcaaaagggcgaggaaguccaggugauugcuguggagccugggaaaaaccccaagaauuuucagacaaugccuggaaccuuccagaccacaacgggcgaaaucggggccauugcccuggauuucaagcccggaaccuccggcagccccaucaucaaccgggagggcaaagucguggggcuguauggaaauggcguugugacaaagaacgggggauacgucuccggcauugcucaaaccaaugccgagccugacgggccgacacccgaacucgaggaagagauguuuaaaaagcgcaaccugaccaucauggaucuucauccuggcagcggaaaaacgagaaaguaucugcccgcuauugugcgggaagccaucaagcgcagacuccggacacugauucucgcgccuaccagaguuguggccgcugagauggaggaagcccugaaaggccuucccauccgcuaccagaccacagcuaccaagucugagcacacagggcgggaaaucgucgaccugaugugccaugccacccugacgaugagacuccugagcccugugcgcguuccgaauuauaaccuuauuaucauggaugaggcccacuucacagaccccgcuuccauugcggcccggggauacaucucuaccagagugggcaugggggaagcugccgccauuuuuaugacagcuaccccucccggaacggccgaugcguucccucagagcaaugcucccauccaggacgaggagcgcgacaucccggaacgguccuggaacucuggcaaugaguggauuaccgauuuugccgggaaaacagucugguucgugccuagcaucaaggccggcaacgacauugcuaacugucugcgcaaaaauggaaagaaggugauccaacucuccagaaaaaccuuugauacagaauaccagaagaccaaacugaacgacugggauuucgucguuacaaccgacauuucugagaugggcgccaauuuuaaggcggaucgggugaucgaccccagacggugccugaaacccgugauucucacggaugggccugagcgcgucauccuugccggacccaugccugugacagcugccagcgcugcccagagacggggccgcguugggagaaacccgcagaaggaaaaugaccaauauaucuucaccggacagccccugaacaaugaugaggaccaugcucacuggaccgaagccaagaugcugcucgacaacauuaauacaccugagggcaucauucccgcgcuguuugaaccugagcgggagaaauccgccgcuaucgauggggaauacagacuuaagggcgagagccgcaaaaccuucguggaacugaugcggagaggagaccuccccgucuggcuggcccacaagguggcuucugagggcauuaaauauacagaucgcaaguggugcuucgacgggcagcggaacaaucagauccuggaagagaacauggauguugagaucuggacgaaagaaggagagaagagaaagcuccgcccgcgguggcuugacgccagaaccuacuccgauccucuggcccugaaagaauuuaaggacuucgcugcgggccgcaaaagcauugcccucgaucuggugacagagaucgggagaguccccucucaucuugcucaccggacccgcaaugcccuggacaaccucgugaugcugcauacauccgaacacggaggcagagccuaucggcacgcugucgaggagcugccugaaaccauggagacgcuccuucugcugggccucaugauucugcuuaccgggggagccaugcuguuucucaucagcggcaaggggauuggaaaaacauccaucggccugaucugugugauugcgucuagcgggaugcuguggauggccgaaaucccccuccaauggauugcuuccgccaucguucuugaguucuuuaugauggugcugcugauuccugagcccgaaaagcagcgcaccccgcaggauaaucaacucgcuuacguggucaucggcauucugacacuugccgcgaucaucgccgcuaacgagaugggccugcucgaaaccacgaagagagaccugggcaugagcaaagagccugggguugugucucccacauccuaucuggauguggaccuccaucccgccagcgcuuggacccuuuacgccgucgcuacaaccgugauuaccccuaugcugcggcacacaaucgaaaauucuacggccaacguuagccuggcggccauugcuaaccaggccgugguccucaugggacuggacaagggcuggccgaucuccaaaauggaucuuggggugccccugcucgcucugggaugcuacucucaggucaauccucugacccucacagccgccgugcuucugcugauuacccauuaugcgaucaucggccccgggcuccaggcuaaggccacaagagaggcucaaaaacgcaccgccgccggaauuaugaagaacccuacgguugacggcaucauuacaaucgaucuggaccccgugauuuacgauagcaaguucgagaaacagcuuggccaggucaugcugcucgugcugugugcuguucagcugcuccuuaugcggaccuccugggcccugugcgaagcgcugacccucgccacagggccuaucaccacacugugggagggaucuccgggcaaguuuuggaauacgaccaucgcugugagcauggccaacauuuucagaggguccuaucuugcuggagccggccuggcguuuagcaucaugaaaucugucgggacaggaaagcgcggcaccggcucccaaggggaaacacucggagagaaauggaagaagaaacugaaucagcugagccggaaggaguucgaccucuacaaaaaguccggcauuaccgagguggauagaacggaggccaaagaagggcuuaagcggggagagaccacacaccaugcugugucucgcggcagcgccaaacugcagugguuuguugaaagaaacauggucauccccgaggggcgggugauugaccugggauguggccgcggcgggugguccuauuacugcgcuggacucaagaaggugaccgaagucagaggcuauacaaaagggggaccuggccacgagaagcccguuccuaugucuaccuacggguggaauaucgugaaacugaugagcggaaaggauguguucuaccuucccccggagaaaugugacacacugcucugcgauauuggcgaauccagcccuucucccaccgucgaggaaucccggacgauccgcgugcugaagaugguugagcccuggcugaagaacaaucaguuuuguaucaaagugcucaacccuuauaugcccgccgucauugagcaccuugaaagacugcaacggaagcauggcgggaugcuggugcgcaauccucucagcagaaacucuacacacgagauguacuggaucuccaauggaaccggcaacauuguuagcucugugaauauggucagccggcugcuucugaacagauucaaaaugacccaucgccggccgacaaucgaaaaggacguggaucucggggcuggaacgagacacgugaacgccgagcccgaaaccccuaauauggacgucauuggcgagcgcaucaaacggaucaaggaggaacacaacuccacauggcauuaugacgaugagaaucccuacaagaccugggcguaucacgggucuuacgaaguuaaagccacaggaagcgcuuccagcaugauuaacggcguggugaagcugcugaccaaaccuugggacgucgugcccaugguuacacagauggccaugaccgauacgaccccguucggccagcaaagaguguuuaaggagaaagucgacacacgcaccccucggcccaugccugggacaagaaaggugauggaaaucaccgcugaguggcucuggcgcacgcugggacggaauaagagaccccgccuuugcacacgggaggaguucaccaaaaagguuagaacaaacgccgccaugggcgcgguguuuaccgaggaaaaucagugggauuccgcuaaagccgccgucgaggacgaagaguucuggaagcugguggaucgcgagagagaacuccauaaacuggggaaguguggaucuugcguuuauaacaugaugggcaaacgggagaagaaacuuggggaauuuggcaaagcuaagggaagccgcgccauuugguacauguggcugggcgcuagauaccucgaguucgaggcccugggguuucugaaugaagaccacugguucucccgggagaacucuuauagcggaguggaaggcgaggggcuccauaaacugggauacauccuuagagauauuuccaagaucccuggcggggcgauguaugccgacgauacggcuggcugggacacccggaucacagaagacgaucugcacaaugaggagaaaauuacccagcagauggaccccgaacaccgccuccuggccaacgcuaucuuuaaacuuacauaccaaaauaaggucgugaaaguccagagaccgaccccuacaggaaccgugauggauauuaucucucggaaggaccagcgcggcagcgggcagguuggaacguauggccugaacacauucaccaauauggaggcccaacucgugagacagauggaaggggagggaguccuguccaaagcggaucuggaaaacccccaucuccccgagaagaaaauuacccaguggcuggagacaaagggcguggaacggcuuaagcgcauggccaucagcggggacgauugcgugguuaaaccuaucgacgauagauuugcuaacgcccugcucgcucugaaugacaugggcaaggugcggaaagauauuccgcaguggcaacccucuaagggauggcacgacuggcagcaggucccuuucuguucccaucacuuucacgagcuuaucaugaaagauggccgcaagcuggugguucccugcagaccucaggacgaacucauugggcgggcccgcaucagccaaggagcuggcuggucucugagagagaccgccugucuggggaaggcguacgcccagauguggucccucauguauuuccaucggcgcgaccugagacuugcuagcaacgccauuugcucugccgugcccauccacugggucccuacaucccggacgaccuggagcauucaugcucaccaucaguggaugacaaccgaagauaugcugacaguguggaauagagucuggaucgaggacaaccccuggauggaggauaaaaccccggugacgaccugggaaaauguuccuuaccucggaaagcgcgaggaccaaugguguggcucccugaucgggcuuacaagccgggccaccugggcgcagaacauucccacagcuauccaacaggugagaucucugauuggcaaugaagaguuccucgauuacaugccuagcaugaaacgcuuucggaaggaggaagaacuggaaggagccaucugguga

SEQ ID NO: 20391 - RNA, 9873 nt, Artificial Sequence
  derived and/or modified CDS sequence (opt5) from DENV-3__KF041254__SS-prME
acaagccugugccucaugaugauccugcccgcugcucuugccuuccaccugacaucccgggacggagaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgugguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggagaaccugggggaaagccaagauugucacagccgaaacccaaaacuccagcuucaucauugauggaccuaauacacccgagugcccgucugcuucccgcgcguggaacgugugggaaguggaggacuauggcuuuggcgucuucaccacgaauaucuggcucaagcugcgggaaauguacacacagaugugugaccacagacugaugagcgccgcuguuaaagaugagcgcgccgugcacgccgacaugggguacuggaucgagucccagaagaacggaucuuggaaacuugaaaaggcuagccucauugaggugaaaaccugcaccuggccuaagucccauacacuguggucuaauggcguccuggaaagcgauaugaucauucccaagucccucgccgggccuaucagccagcacaacuaucggcccggauaccauacccaaacggcgggcccuuggcaccuggggaaacuugagcuggacuuuaauuauugcgagggaacaaccgugguuauuacagaaaacuguggcaccagaggccccucucuccgcacaaccacgguguccgggaagcugauccacgaguggugcugucggagcugcacccugccgccucuuagauacaugggagaagauggcuguugguaugggauggagauccggcccauuucugaaaaagaggagaauauggucaagucccucgugagcgcuggaucuggcaaaguugacaacuucacaaugggggugcugugccuggccauccucuuugaagaggucaugcgcggaaaguucggcaagaaacauaugauugccggcguguucuuuaccuucguucugcuucugagcgggcagaucacauggagagauauggcucacacccucauuaugaucggauccaaugccagcgaccggaugggcaugggggugacguaccuggcgcugauugcuacauuuaagauccagcccuuccuugcccugggauuuuuccucagaaaacugaccucucgcgaaaaccuccugcuuggcgucgggcuggccauggcuacaacccuccaacugccugaggauaucgaacagauggccaauggaauugcucugggccuuauggcccugaagcucaucacccaguuugagacauaucagcuguggacggcgcucauuucccugaccuguagcaacacaaucuucacccuuacaguggccuggcggaccgcuacgcugauucucgccggcgugucccugcugccggucugccaaucuagcuccaugagaaaaacagacuggcuucccaugaccguugcugccaugggggugccuccccugccucucuuuaucuucucucugaaggauacccucaagcgcagaagcuggccccugaaugagggagugauggccgucggccuuguguccauccuggcuucuagccugcuccggaacgacguuccuauggcggggccccugguggccggaggccuucugauugcuuguuacgucaucacagggaccuccgccgaucucacaguggaaaaagccgcugacguuacgugggaggaagaggccgaacagaccggagugagccauaaccugaugauuacagucgacgaugacggcaccaugcgcaucaaggaugacgagacagagaauauucucaccgugcugcuuaaaacggcgcugcugaucgucucuggcaucuuuccguacuccauuccugcuacccuccugguguggcacacauggcagaagcagacccaaagaagcgggguucuuugggaugugcccucuccucccgaaacacagaaagccgagcuggaagagggagucuaucggaucaagcagcagggcauucucgggaaaacccaagugggaguuggcgugcagaaggagggggucuuccauacaauguggcacgugacgcgcggagccgugcugacccacaacggcaagagacucgaaccgaauugggcuuccguuaaaaaggaccugaucagcuacggcgggggauggcggcuuucugcccaguggcaaaaaggcgaggaaguccaggugauugcgguggagccugggaagaaccccaaaaauuuucagacaaugccuggaaccuuccagaccacaacgggcgaaaucggggcuauugcccuggauuucaagcccggaaccuccggcagccccaucaucaaccgcgagggcaaggucguggggcuguauggaaauggcguugugaccaagaacgggggauacgucuccggcauugcccaaaccaaugcugagccugacgggccgacacccgaacucgaggaagagauguuuaagaaaagaaaccugaccaucauggaucuucauccuggcagcggaaagacgcggaaauaucugcccgccauugugcgcgaagcuaucaagagacggcucagaacacugauucucgccccuacccgcguuguggcggccgagauggaggaagcucugaagggccuucccauccgguaccagaccacagccaccaaaucugagcacacagggagagaaaucgucgaccugaugugccaugcuaccuucacgaugcgccugcucagcccugugcggguuccgaauuauaaccugauuaucauggaugaggcccacuuuacagaccccgccuccauugcugcgagaggauacaucucuacccgcgugggcaugggggaagccgcugccauuuucaugacagccaccccucccggaacggcugaugccuuuccucagagcaaugcgcccauccaggacgaggagcgggacaucccggaaagauccuggaacucuggcaaugaguggauuaccgauuucgcugggaagacagucugguuugugccuagcaucaaagccggcaacgacauugccaacugucuucgcaagaauggcaaaaaggugauccaacugucccggaagaccuucgauacagaauaccagaaaaccaagcucaacgacugggauuuugucguuacaaccgacauuucugagaugggagcuaauuucaaagccgauagagugaucgacccccggcgcugccugaagcccgugauucugacggaugggccugagagagucauccucgcgggacccaugccugugacagccgcuagcgccgcucagcggcgcggcagaguugggcggaacccgcagaaagaaaaugaccaauauaucuuuaccggacagccccuuaacaaugaugaggaccaugcccacuggaccgaagcuaagaugcugcuggacaacauuaauacaccugagggcaucauucccgcccucuucgaaccugagagagagaaguccgcggccaucgauggggaauaccgccugaaaggcgagagccggaagaccuucguggaacuuaugagacgcggagaccugcccgucuggcucgcucacaaaguggccucugagggcauuaaguauacagaucggaaauggugcuuugacgggcagagaaacaaucagauccuggaagagaacauggauguugagaucuggacgaaggaaggagagaaacgcaagcugcggccgagauggcucgacgcucgcaccuacuccgauccucuugcccugaaggaguucaaagacuuugccgcuggcagaaagagcauugcgcuggaucucgugacagagaucgggcggguccccucucaucuggcccaccgcaccagaaaugcucuugacaaccuggugaugcuccauacauccgaacacggaggccgggccuaucgccacgccgucgaggagcugccugaaaccauggagacgcugcuccuucugggccugaugauucuccugaccgggggagcuacacuuuuccugaucagcggcaaagggauuggaaagaccuccaucggccucaucugugugauugccucuagcgggaugcuguggauggcggaaaucccccugcaauggauugccuccgcuaucguucucgaguuuuucaugauggugcuucugauuccugagcccgaaaaacagagaacaccgcaggauaaucaacuggccuacguggucaucggcauucucacccuggcugccaucaucgcggccaacgagaugggccuucuggaaacgacaaagcgggaccucggcaugagcaaggagccugggguugugucucccaccuccuaucuggauguggaccugcaucccgcuagcgccuggacacucuacgcugucgccaccaccgugauuacaccuaugcuuagacacacgaucgaaaauucuaccgcuaacguuagccuggccgcgauugccaaccaggcugugguccugaugggacucgacaaaggcuggccgaucuccaagauggaucugggggugccccuucuggcccucggaugcuacucucaggucaauccucugacacugaccgcugccgugcuccuucugauuacacauuaugccaucaucggccccgggcugcaggcgaaagcuacccgcgaggcccaaaagcggacggcugccggaauuaugaaaaacccuacaguugacggcaucauuaccaucgaucucgaccccgugauuuacgauagcaaguuugagaagcagcugggccaggucaugcuucuggugcucugugccguucagcugcugcucaugagaaccuccugggcucuuugcgaagcccugacacuggcgaccgggccuaucacaacgcucugggagggaucuccgggcaaauucuggaauaccacaaucgccgugagcauggcuaacauuuuucgcggguccuaucuggcccgggcuggacuugccuucagcaucaugaagucugucggcaccgggaaaagaggaacaggcucccaaggcgaaacccugggggagaaguggaaaaagaagcucaaucagcugagccggaaagaauuugaccuguacaagaaauccggaauuacggagguggaucgcaccgaggcgaaggaaggccucaaaagaggggagacaacccaccaugccgugucucggggaagcgcuaaacuucagugguucguugaacgcaacauggucauccccgagggcagagugauugaccugggguguggacggggcggcugguccuauuacugcgccgggcugaaaaaggugacagaaguccgcggauauaccaagggcgggccuggacacgaggagcccguuccuaugucuacauacggcuggaauaucgugaaacucaugagcgggaaggauguguuuuaccugcccccggaaaaaugugacacccuucugugcgauauuggagaguccagcccuucucccacggucgaagaguccagaacaauccgggugcucaagaugguugagcccuggcugaaaaacaaucaguucuguaucaaggugcugaacccuuauaugcccgcugucauugaacaccucgagcgccuucaaagaaagcauggcggcaugcuggugcggaauccucugagcagaaacucuacccacgaaauguacuggaucuccaaugggaccggaaacauuguuagcucugugaauauggucagcaaacuccugcuuaaccgcuucacaaugacgcaucggagaccgaccaucgagaaggacguggaucugggcgccgggacacgccacgugaacgcugaacccgagaccccuaauauggacgucauuggagagcggaucaaaagaaucaaggaagaacacaacuccacauggcauuaugacgaugaaaaucccuacaaaaccugggccuaucacggcucuuacgagguuaaggcgacagggagcgccuccagcaugauuaacggaguggugaagcuccugaccaaaccuugggacgucgugcccaugguuacgcagauggcuaugaccgauacaaccccguuuggccagcaacgcguguucaaggaaaaagucgacacacggaccccuagacccaugccuggcacgcgcaaggugauggagaucacagccgaguggcuguggcggacccucgggagaaauaaacgcccccggcugugcacaagagaagaguuuaccaagaagguucgcacgaacgcugccaugggagccguguucaccgaagagaaucagugggauuccgcgaaagcugccgucgaagacgaggaguuuuggaaacuuguggauagagaacgggagcugcauaaacucggcaagugugggucuugcguuuauaacaugaugggaaaacgcgaaaagaaacugggcgaguucgggaaggccaagggcagcagagcuauuugguacauguggcuuggagcccgguaccuggaguuugaagcucucggcuuccugaaugaggaccacugguuuuccagagaaaacucuuauagcgggguggagggagaaggccugcauaaacucggguacauccugcgggauauuuccaagaucccuggaggcgccauguaugcggacgauacagccgggugggacacccgcaucacagaggacgaucuucacaaugaggagaagauuacccagcagauggaccccgagcacagacugcucgcuaacgccaucuucaagcugacauaccaaaauaaagucgugaagguccagcggccgaccccuacgggcacagugauggauauuaucucucgcaaggaccagagaggaagcggccagguugggaccuauggacuuaacaccuuuacaaauauggaagcucaacuggugcggcagauggagggcgaagggguccucuccaaagccgaucuggagaacccccaucugcccgagaagaaaauuacccaguggcucgaaacaaagggaguggagcgccugaaaagaauggcgaucagcggcgacgauugcgugguuaagccuaucgacgaucgguucgccaacgcccuucuggcccucaaugacauggggaaggugcgcaaagauauuccgcaguggcaacccucuaagggcuggcacgacuggcagcaggucccuuuuuguucccaucacuuccacgaacugaucaugaaagauggaagaaaacuugugguucccugccggccucaggacgagcugauuggccgcgcuagaaucagccaaggggccggauggucucuccgggaaacggcuugucugggcaaagccuacgcgcagauguggucccugauguauuuccaucgcagagaccuccggcuggccagcaacgcuauuugcucugccgugcccguccacugggugccuaccuccagaacaaccuggagcauccaugcccaccaucaguggaugacaaccgaggauaugcuuacggucuggaaucgcguguggauugaggacaaccccuggauggaagauaagaccccgguuacaaccugggagaaugugccuuaccuggggaagcgggaagaccaaugguguggaucccucaucggccugacaagcagagcuaccugggcccagaacauccccacggcgauucagcagguccgcucucuuaucgggaaugaggaguuucuggauuacaugccuagcaugaaacgguucagaaaggaagaggaacucgagggcgcuauuugguga

SEQ ID NO: 20392 - RNA, 9873 nt, Artificial Sequence
  derived and/or modified CDS sequence (opt5) from DENV-3__KX380841__SS-prME
accagccugugccucaugaugauccugcccgcggcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcauuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugcccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucgggggagugcucaacagccugggcaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugccggcgcuugggagaauggaguguguggcaucagaagcaccacacgcauggaaaaccuucucuggaaacagaucgccaaugagcugaacuauauucugugggaaaauaacaucaagcucaccguuguggucggggacacgauuggagugcuggagcagggcaaacggacccuuacaccucagcccauggagcugaaguacucuuggaaaaccugggggaaggccaagaucguuacagcugaaacccaaaacuccagcuucauuaucgauggaccuaauacacccgagugcccgucugcguccagagccuggaacgugugggaagucgaggacuauggcuuuggcguguucaccacgaauaucuggcucaaacugcgcgaaguguacacacagaugugugaccaccggcugaugagcgcugccgucaaggaugagagagccguucacgcugacaugggguacuggauugagucccagaaaaacggaucuuggaaacuugaaaaagccagccucaucgaggugaagaccugcaccuggccuaagucccauacacuguggucuaauggcgugcuggaaagcgauaugauuauccccaaaucccucgcggggccuauuagccagcacaacuaucgccccggauaccauacccaaacggcuggcccuuggcaccuggggaaacuugagcuggacuuuaauuauugcgagggaacaaccgucgugaucacagaaaacuguggcacccggggccccucucucagaacaaccacgguuuccgggaaacugauccacgaguggugcugucgcagcugcacccugccgccucuucgguacaugggagaagauggcuguugguaugggauggagauuagacccaucucugaaaaggaggagaauauggugaaaucccucgucagcgccggaucuggcaagguggacaacuucacaauggggguucugugccuggccauucucuuugaagaggugaugcggggaaaguucggcaaaaagcauaugaucgcuggcgucuucuuuaccuucgugcugcuucugagcgggcagauuacauggcgcgauauggcccacacccucaucaugauuggauccaaugcgagcgacagaaugggcauggggguuacguaccuggcucugaucgccacauuuaaaauccagcccuuccuugcccugggauuuuuccuccggaagcugaccucuagagaaaaccuccugcuuggcguggggcuggcuauggccacaacccuccaacugccugaggauauugaacagauggcuaauggaaucgcccugggccuuauggcgcugaaacucauuacccaguuugagacauaucagcuguggacggcccucaucucccugaccuguagcaacacaauuuucacccuuacagucgcuuggcgcaccgccacgcugauccucgcuggcgugucccugcugccggugugccaaucuagcuccaugcggaagacagacuggcuucccaugaccgucgccgccauggggguuccuccccugccucucuuuaucuucucucugaaggauacccucaaaagacgcagcuggccccugaaugagggagugauggcugugggccuugucuccauucuggcgucuagccugcucagaaacgacgugccuauggccgggccccugguugcuggaggccuucugaucgccuguuacgugauuacagggaccuccgccgaucucacagucgaaaaggcugccgacgugacgugggaggaagaggcggaacagaccggaguuagccauaaccugaugaucacaguggacgaugacggcaccaugcggauuaaagaugacgagacagagaauauccucaccguccugcuuaagacggcucugcugaucgugucuggcauuuuuccguacuccaucccugccacccuccuggucuggcacacauggcagaaacagacccaacgcagcggggugcuuugggauguucccucuccucccgaaacacagaaggccgagcuggaagagggaguguauagaauuaaacagcagggcauccucgggaagacccaagucggagugggcguucagaaggacgggguguuccauacaauguggcacgucacgcggggagcugugcugacccacaacggcaaacgccucgagccgaauugggccuccgugaagaaagaucugauuagcuacggcgggggauggagacuuucugcgcaguggcaaaagggcgaagagguucaggucaucgcuguggaaccugggaaaaaccccaagaauuuucagacaaugccuggaaccuuccagaccacaacgggcgagauuggggccaucgcccuggacuucaagcccggaaccuccggcagccccaucauuaaccgggaaggcaaaguggucgggcuguauggaaauggcgugguuacaaagaacgggggauacguguccggcaucgcucaaaccaaugccgagccugaugggccgacacccgagcucgaagaggaaauguuuaaaaagcgcaaccugaccauuauggaccuucauccuggcagcggaaaaacgagaaaguaucugcccgcuaucguccgggaggccauuaagcgcagacuccggacacugauccucgcgccuaccagagugguugccgcugaaauggaggaggcccugaaaggccuucccauccgcuaccagaccacagcuaccaagucugaacacacagggcgggagauuguggaucugaugugccaugccaccuucacgaugagacugcucagcccuguccgcgugccgaauuauaaccugaucauuauggacgaagcccacuuuacagaucccgcuuccaucgcggcccggggauacauuucuaccagaguuggcaugggggaggcugccgccaucuucaugacagcuaccccucccggaacggccgacgcguuuccucagagcaaugcucccauccaggacgaggaacgcgauauuccggagcgguccuggaacucuggcaaugaauggaucaccgacuucgccgggaaaacagugugguuugucccuagcauuaaggccggcaacgauaucgcuaacugucuucgcaaaaauggaaagaaggugauucaacuguccagaaaaaccuucgacacagaguaccagaagaccaaacucaacgauugggacuuuguggucacaaccgauaucucugaaaugggcgccaauuucaaggcggaccggguuauugaucccagacggugccugaaacccgugauccugacggacgggccugagcgcgugauccucgccggacccaugccugucacagcugccagcgcugcccagagacggggccgcguggggagaaacccgcagaaggagaaugaucaauauauuuuuaccggacagccccuuaacaaugacgaagaccaugcucacuggaccgaggccaagaugcugcuggauaacaucaauacaccugaaggcauuauccccgcccucuucgagccugaacgggagaaauccgccgcuauugacggggaguacagacugaagggcgaaagccgcaaaaccuucguugagcuuaugcggagaggagaucugcccguguggcucgcccacaaggucgcuucugaaggcaucaaauauacagaccgcaaguggugcuuugaugggcagcggaacaaucagauccuggaggaaaacauggacguggagauuuggacgaaagagggagaaaagaagaaacugagaccgcgcuggcucgaugcccggaccuacuccgacccucuugcccugaaggaguucaaagauuuugcugcgggcagaaagagcaucgcccuggaccucguuacagaaauugggcgcgugcccucucaucuggcucacagaacccggaaugcccuugauaaccuggucaugcuccauacauccgagcacggaggccgcgccuauagacacgcuguggaagaacucccugagaccauggaaacgcugcuccuucugggccugaugauccuccugaccgggggagccaugcuuuuccugauuagcggcaaagggaucggaaagacauccaucggccucauuugugucaucgcgucuagcgggaugcuguggauggccgagauuccccugcaauggaucgcuuccgccauugugcucgaauuuuucaugaugguucuucugaucccugagcccgagaagcagcggaccccgcaggacaaucaacuggcuuacguggugauuggaauccucacaauggccgcgaucauugccgcuaacgaaaugggccugcuugagaccacgaaacgcgaucugggcaugagcaaggaaccuggggucguuucucccacauccuaucucgacguggaccugcaucccgccagcgcuuggacccuguacgccguggcuacaaccgucaucaccccuaugcucagacacacaauugaaaauucuacggccaacgugagccuugcggccaucgcuaaccaggccguugugcugaugggacuggauaaaggcuggccgauuuccaagauggaccucggggucccccugcuugcucugggaugcuacucucaggugaauccucucacccugacagccgccguccugcuccuugugacccauuaugcgaucaucggccccgggcugcaggcuaaagccacacgggaagcucaaaagagaaccgccgccggaauuaugaagaacccuacgguugauggcaucauuacaaucgaccuggaucccgugauuuacgacagcaaauuugagaagcagcucggccaggucaugcugcuugugcugugugcuguucagcuccugcugaugcgcaccuccugggcccucugcgaggcgcuuacccuggccacagggccuaucaccacacugugggaaggaucuccgggcaaauucuggaauacgaccaucgcugugagcauggccaacauuuuucggggguccuaucucgcuggagccggccuggcguucagcaucaugaagucugucgggacaggaaaaagaggcaccggcucccaaggggagacacuuggagaaaaguggaagaaaaagcugaaucagcucagccgcaaagaguuugaucuguacaagaaauccggcauuaccgaaguggaccggacggaggccaaggaggggcugaaaagaggagaaaccacacaccaugcugugucucggggcagcgccaagcuccagugguucguugagcgcaacauggucauccccgaagggagagugauugaucuuggauguggccggggcgggugguccuauuacugcgcuggacugaagaaagugaccgagguccgcggcuauacaaaagggggaccuggccacgaggagcccguuccuaugucuaccuacggguggaauaucgugaaacugaugagcggaaaggacguguuuuaccugcccccggagaaaugugauacacugcuuugcgacauuggcgaauccagcccuucucccaccgucgaggaauccagaacgauccgggugcugaagaugguugagcccuggcucaagaacaaucaguucuguaucaaagugcugaacccuuauaugcccgccgucauugagcaccuggaacgccuccaaagaaagcauggcgggaugcuugugcggaauccucugagccgcaacucuacacacgagauguacuggaucuccaauggaaccggcaacauuguuagcucugugaauauggucagcagacugcuccugaaccgguucaccaugacacauagacgcccgacgaucgaaaaagauguggaccuuggggcuggaacccggcacgugaacgccgagcccgaaacaccuaauauggacgucauuggcgagagaaucaagcgcaucaaagaggaacacaacuccaccuggcauuaugaugacgagaaucccuacaagacaugggcguaucacgggucuuacgaaguuaaggccaccggaagcgcuuccagcaugauuaacggcguggugaaacugcucacaaagccuugggaugucgugcccaugguuacccagauggccaugacggacaccacaccguuuggccagcaacggguguucaaagagaaggucgauaccagaacaccucgccccaugccugggacccggaaagugauggaaaucacggcugaguggcuguggagaacacugggacgcaauaagcggcccagacucugcacccgcgaggaauuuacaaagaaaguucggaccaacgccgccaugggcgcgguguucacggaggaaaaucagugggacuccgcuaaggccgccgucgaggaugaagaguuuuggaaacugguggacagagagcgcgaacuucauaagcuggggaaauguggaucuugcguuuauaacaugaugggcaagagagagaaaaagcucggggaguucggcaaggcuaaaggaagccgggccauuugguacauguggcugggcgcucgcuaccuugaguuugaggcccugggguuccucaaugaagaucacugguuuuccagagagaacucuuauagcggaguggaaggcgaggggcugcauaagcugggauacauccuccgggacauuuccaaaaucccuggcggggcgauguaugccgaugacaccgcuggcugggacacaagaaucaccgaagaugaccugcacaaugaggagaagauuacacagcagauggaucccgaacaccggcuucuggccaacgcuaucuucaaacucaccuaccaaaauaaggucgugaagguccagcgcccgacaccuaccggaacggugauggacauuaucucuagaaaagaucagcggggcagcgggcagguuggaacauauggccugaacaccuuuaccaauauggaggcccaacuugugcgccagauggaaggggagggaguccuguccaagacagaccucgaaaacccccaucugcccgagaaaaagauuacccaguggcuggagacaaaaggcguggaaagacucaagcggauggcgaucagcggggaugacugcgugguuaagccuaucgaugaccgcuucgccaacgcucugcuugcccugaaugauaugggcaaagugagaaaggacauuccgcaguggcaacccucuaaaggauggcacgauuggcagcaggucccuuuuuguucccaucacuuccacgagcucaucaugaaggacggccggaaacuggugguucccugccgcccucaggacgaacuuauugggagagcucggaucagccaaggagccggcuggucucugcgcgagacggcuugucucgggaaggccuacgcgcagauguggucccugauguauuuccauagacgggaucugcgccucgccagcaacgcuauuugcucugccgugcccguccacugggugccuaccuccagaacaaccuggagcauccaugcccaccaucaguggaugacaaccgaagacaugcugacggucuggaaucggguguggauugaggauaaccccuggauggaggacaagaccccgaucacaaccugggaaaauguuccuuaccuuggaaaaagagaggaucaaugguguggcucccugaucgggcucacaagccgcgcuaccugggcccagaacauucccacggcgauccaacaggugcggucucugauuggcaaugaagaguuucuugacuacaugccuagcaugaagagauuccgcaaagaggaagaguccgaaggagcuaucugguga

SEQ ID NO: 20393 - RNA, 9873 nt, Artificial Sequence
  derived and/or modified CDS sequence (opt5) from DENV-3__KX380842__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcauuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugcccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucggcggggugcucaacagccuggggaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugugggcgccugggagaauggaguuuguggcaucagaagcaccacacgcauggaaaaccuucucuggaaacagaucgcuaaugagcugaacuauauucugugggaaaauaacaucaagcucaccguggucgugggggacacgauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgucugggaaguggaggacuauggcuuuggcguguucaccacgaauaucuggcucaaacugcgcgaagucuacacacagaugugugaccaccggcugaugagcgccgcuguuaaggaugagagagccgugcacgccgacaugggguacuggauugagucccagaaaaacggaucuuggaaacuugaaaaagcuagccucaucgaggugaagaccugcaccuggccuaagucccauacacuguggucuaauggcguccuggaaagcgauaugauuauccccaaaucccucgccgggccuauuagccagcacaacuaucgccccggauaccauacccaaacggcgggcccuuggcaccuggggaaacuugagcuggacuuuaauuauugcgagggaacaaccgugguuaucacagaaaacuguggcacccggggccccucucucagaacaaccacgguguccgggaaacugauccacgaguggugcugucgcagcugcacccugccgccucuucgguacaugggagaagauggcuguugguaugggauggagauuagacccaucucugaaaaggaggagaauauggucaaaucccucgugagcgcuggaucuggcaagguugacaacuucacaaugggggugcugugccuggccauucucuuugaagaggucaugcggggaaaguucggcaaaaagcauaugaucgccggcguguucuuuaccuucguucugcuucugagcgggcagauuacauggcgcgauauggcucacacccucaucaugauuggauccaaugccagcgacagaaugggcaugggggugacguaccuggcgcugaucgcuacauuuaaaauccagcccuuccuugcccugggauuuuuccuccggaagcugaccucuagagaaaaccuccugcuuggcgucgggcuggccauggcuacaacccuccaacugccugaggauauugaacagauggccaauggaaucgcucugggccuuauggcccugaaacucauuacccaguuugagacauaucagcuguggacggcgcucaucucccugaccuguagcaacacaauuuucacccuuacaguggccuggcgcaccgcuacgcugauccucgccggcgugucccugcugccggucugccaaucuagcuccaugcggaagacagacuggcuucccaugaccguugcugccaugggggugccuccccugccucucuuuaucuucucucugaaggauacccucaaaagacgcagcuggccccugaaugagggagugauggccgucggccuuguguccaugcuggcuucuagccugcucagaaacgacguuccuauggcggggccccugguggccggaggccuucugauugcuuguuacgucaucacagggaccuccgccgaucucacaguggaaaaggccgcugacguuacgugggaggaagaggccgaacagaccggagugagccauaaccugaugauuacagucgacgaugacggcaccaugcggaucaaagaugacgagacagagaauauucucaccgugcugcuuaagacggcgcugcugaucgucucuggcaucuuuccguacuccauuccugcuacccuccugguguggcacacauggcagaaacagacccaacgcagcgggguucuuugggaugugcccucuccucccgaaacacagaaggccgagcuggaagagggagucuauagaaucaaacagcagggcauucucgggaagacccaagugggaguuggcgugcagaaggacggggucuuccauacaauguggcacgugacgcggggagccgugcugacccacaacggcaaacgccucgagccgaauugggcuuccguuaagaaagaucugaucagcuacggcgggggauggagacuuucugcccaguggcaaaagggcgaagagguccaggugauugcgguggaaccugggaaaaaccccaagaauuuucagacaaugccuggaaccuuccagaccacaacgggcgagaucggggcuauugcccuggacuucaagcccggaaccuccggcagccccaucaucaaccgggaaggcaaagucguggggcuguauggaaauggcguugugacaaagaacgggggauacgucuccggcauugcccaaaccaaugcugagccugaugggccgacacccgagcucgaagaggaaauguuuaaaaagcgcaaccugaccaucauggaccuucauccuggcagcggaaaaacgagaaaguaucugcccgccauugugcgggaggcuaucaagcgcagacuccggacacugauucucgccccuaccagaguuguggcggccgaaauggaggaggcucugaaaggccuucccauccgcuaccagaccacagccaccaagucugaacacacagggcgggagaucgucgaucugaugugccaugcuaccuucacgaugagacugcucagcccugugcgcguuccgaauuauaaccugauuaucauggacgaagcccacuuuacagaucccgccuccauugcugcgcggggauacaucucuaccagagugggcaugggggaggccgcugccauuuucaugacagccaccccucccggaacggcugacgccuuuccucagagcaaugcgcccauccaggacgaggaacgcgauaucccggagcgguccuggaacucuggcaaugaauggauuaccgacuucgcugggaaaacagucugguuugugccuagcaucaaggccggcaacgauauugccaacugucuucgcaaaaauggaaagaaggugauccaacuguccagaaaaaccuucgacacagaguaccagaagaccaaacucaacgauugggacuuugucguuacaaccgauauuucugaaaugggcgcuaauuucaaggccgaccgggugaucgaucccagacggugccugaaacccgugauucugacggacgggccugagcgcgucauccucgcgggacccaugccugugacagccgcuagcgccgcucagagacggggccgcguugggagaaacccgcagaaggagaaugaucaauauaucuuuaccggacagccccuuaacaaugacgaagaccaugcccacuggaccgaggcuaagaugcugcuggauaacauuaauacaccugaaggcaucauucccgcccucuucgagccugaacgggagaaauccgcggccaucgacggggaguacagacugaagggcgaaagccgcaaaaccuucguggagcuuaugcggagaggagaucugcccgucuggcucgcucacaagguggccucugaaggcauuaaauauacagaccgcaaguggugcuuugaugggcagcggaacaaucagauccuggaggaaaacauggacguugagaucuggacgaaagagggagaaaagaagaaacugagaccgcgcuggcucgaugcucggaccuacuccgacccucuugcccugaaggaguucaaagauuuugccgcuggcagaaagagcauugcgcuggaccucgugacagaaaucgggcgcguccccucucaucuggcccacagaacccggaaugcucuugauaaccuggugaugcuccauacauccgagcacggaggccgcgccuauagacacgccgucgaagaacucccugagaccauggaaacgcugcuccuucugggccugaugauucuccugaccgggggagcuaugcuuuuccugaucagcggcaaagggauuggaaagacauccaucggccucaucugugugauugccucuagcgggaugcuguggauggcggagaucccccugcaauggauugccuccgcuaucguucucgaauuuuucaugauggugcuucugauuccugagcccgagaagcagcggaccccgcaggacaaucaacuggccuacguggucaucggcauucucacaauggcugccaucaucgcggccaacgaaaugggccugcuugagaccacgaaacgcgaucugggcaugagcaaggaaccugggguugugucucccacauccuaucucgacguggaccugcaucccgcuagcgccuggacccuguacgcugucgccacaaccgugauuaccccuaugcucagacacacaaucgaaaauucuacggcuaacguuagccuugccgcgauugccaaccaggcugugguccugaugggacuggauaaaggcuggccgaucuccaagauggaccucggggugccccugcuugcccugggaugcuacucucaggucaauccucucacccugacagcugccgugcugcuccuuguuacccauuaugccauuaucggccccgggcugcaggcgaaagcuacacgggaagcccaaaagagaaccgcugccggaaucaugaagaacccuacgguggauggcauuaucacaauugaccuggaucccgucaucuacgacagcaaauuugagaagcagcucggccaggugaugcugcuuguucugugugccgugcagcuccugcugaugcgcaccuccugggcucucugcgaggcccuuacccuggcgacagggccuauuaccacacugugggaaggaucuccgggcaaauucuggaauacgaccaucgccgucagcauggcuaacaucuuucggggguccuaucucgccggagcuggccuggccuucagcauuaugaagucuguggggacaggaaaaagaggcaccggcucccaaggggagacacuuggagaaaaguggaagaaaaagcugaaucagcucagccgcaaagaguuugaucuguacaagaaauccggcaucaccgaaguggaccggacggaggcgaaggaggggcugaaaagaggagaaaccacacaccaugccguuucucggggcagcgcuaagcuccagugguucgucgagcgcaacauggugauucccgaagggagagugaucgaucuuggauguggccggggcgggugguccuauuacugcgccggacugaagaaagucaccgagguucgcggcuauacaaaagggggaccuggccacgaggagcccgugccuaugucuaccuacggguggaauauugugaaacugaugagcggaaaggacgucuuuuaccugcccccggagaaaugugauacacugcuuugcgacaucggcgaauccagcccuucucccaccguggaggaauccagaacgauucggguucugaagaugguggagcccuggcucaagaacaaucaguucuguaucaaaguccugaacccuuauaugcccgcugugaucgagcaccuggaacgccuccaaagaaagcauggcgggaugcuuguucggaauccucugagccgcaacucuacacacgagauguacuggauuuccaauggaaccggcaacaucgugagcucugucaauauggugagcagacugcuccugaaccgguucaccaugacacauagacgcccgacgauugaaaaagauguggaccuuggggccggaacccggcacgucaacgcugagcccgaaacaccuaauauggacguuaucggcgagagaauuaagcgcaucaaagaggaacacaacuccaccuggcauuaugaugacgagaaucccuacaagacaugggccuaucacgggucuuacgaagugaaggcgaccggaagcgccuccagcaugaucaacggcguggucaaacugcucacaaagccuugggaugugguucccauggugacccagauggcuaugacggacaccacaccguuuggccagcaacgggucuucaaagagaagguggauaccagaacaccucgccccaugccugggacccggaaaguuauggaaauuacggccgaguggcuguggagaacacugggacgcaauaagcggcccagacucugcacccgcgaggaauuuacaaagaaagugcggaccaacgcugccaugggcgccgucuucacggaggaaaaucagugggacuccgcgaaggcugccguggaggaugaagaguuuuggaaacugguugacagagagcgcgaacuucauaagcuggggaaauguggaucuugcguguauaacaugaugggcaagagagagaaaaagcucggggaguucggcaaggccaaaggaagccgggcuaucugguacauguggcugggcgcccgcuaccuugaguuugaggcucugggguuccucaaugaagaucacugguuuuccagagagaacucuuauagcggagucgaaggcgaggggcugcauaagcugggauacauucuccgggacaucuccaaaauuccuggcggggccauguaugcggaugacaccgccggcugggacacaagaaucaccgaagaugaccugcacaaugaggagaagaucacacagcagauggaucccgaacaccggcuucuggcuaacgccauuuucaaacucaccuaccaaaauaagguggucaaggugcagcgcccgacaccuaccggaacgguuauggacaucauuucuagaaaagaucagcggggcagcggacaggugggaacauauggccugaacaccuuuaccaauauggaggcucaacuuguccgccagauggaaggggagggagugcuguccaagacagaccucgaaaacccccaucugcccgagaaaaagaucacccaguggcuggagacaaaaggcguggaaagacucaagcggauggccauuagcggggaugacugcguugugaagccuaucgaugaccgcuucgcgaacgcccugcuugcucugaaugauaugggcaaagucagaaaggacaucccgcaguggcaacccucuaaaggauggcacgauuggcaacaggugccuuuuuguucccaucacuuccacgagcucauuaugaaggacggccggaaacugguugugcccugccgcccucaggacgaacuuaucgggagagcccggauuagccaaggagcuggcuggucucugcgcgagacggccugucucgggaaggcuuacgcccagauguggucccugauguauuuccauagacgggaucugcgccucgcgagcaacgccaucugcucugcuauucccguccacugggugccuaccuccagaacaaccuggagcauccaugcccaccaucaguggaugacaaccgaagacaugcugacggucuggaaucggguguggauugaggauaaccccuggauggaggacaagaccccgaucacaaccugggaaaauguuccuuaccuuggaaaaagagaggaucaaugguguggcucccugaucgggcucacaagccgcgccaccugggcucagaacauucccacggccauccaacaggugcggucucugauuggcaaugaagaguuucuugacuacaugccuagcaugaagagauuccgcaaagaggaagaguccgaaggagcgaucugguga

SEQ ID NO: 20394 - RNA, 9873 nt, Artificial Sequence
  derived and/or modified CDS sequence (opt5) from DENV-3__KX380839__SS-prME
accagccugugccucaugaugaugcugcccgccacccuugcuuuccaccugacgucccgggacggcgaaccucggaugauuguggggaagaacgaacgcggaaagucucuccuguuuaagaccgccagcggcauuaauauguguacacuuaucgcgauggaucugggggagaugugcgacgauaccauuacauacaaauguccccucaucaccgaaguggagcccgaagacauugauugcugguguaaccugacauccaccuggguuacguauggaaccugcaaucaggcuggcgagcauagacgggacaagcgcucuguggcccuggccccucacguggggaugggacucgauacaagagcucaaaccuggaugagcgccgagggcgcuuggcggcaggucgaaaaaguggagacaugggccuuccgccaucccggcuuuaccauccuggcgcuuuuccuggcccacuacaucgggacgucccucacacagaagguugugauuuuuauccugcuuaugcuggucaccccuucuaugacaaugagaugugugggaguuggcaaccgggacuucguggaagggcucagcggagcuaccugggucgauguggugcuggagcauggcgggugcgucaccacaauggccaagaauaaacccacgcuggacauugagcuccagaagaccgaagcuacacaacuggccacccuucgcaaacuguguaucgagggaaagauuacaaacguuaccacggauuccagaugcccuacacagggcgaagcgacccucccggaggaacaggaccagaauuauguguguaaacacaccuacguggaucggggcugggggaacggaugcggccuguuugggaagggaagccuugucacaugcgccaaguuccaaugucuggagcucaccgagggcaaagugguucagcacgaaaaucugaaguauacagugaucauuacgguccauaccggggaccagcaccaggugggaaacgagacacaaggcguuaccgcugaaaucacaccccaggccucuaccguggaggcuaucuuucgcuccuacggcacgcuggggcucgaaugcagcccuagaaccggacuggacuucaaugagaugauucuucugacaaugaaaaacaaggccuggaugguccaucggcagugguuuuucgaucucccccugccuuggaccucuggcgccacaaccgagacgcccacauggaauaaaaaggaacuucuggugaccuuuaaaaacgcucacgcgaagaagcaagaggucgugguucucgggucccaggaaggagccaugcacacagcucugaccggcgccaccgagauccagacaagcgggggcacgucuauuuucgccggacaucugaaaugucgccucaagauggacaaacuggaacuuaagggcauguccuaugcuaugugcagcaaugccuucgugcugaaaaaggaggucuccgagacccagcacgggacaauccucauuaagguggaauacaaaggagaggaugcgccguguaagaucccuuuuucuaccgaagacggccaagggaaagcucauaacggaagacugaucacagccaaccccguugugaccaagaaagaggagccugucaauauugaagccgagccgcccuucggcgaaagcaacaucauuaucgggauuggcgauaaggcucugaagaucaauugguacaaaaagggauccagcaucggcaaaauguuugaggccacggcuagaggggccagacgcauggcgauucuuggagacacagccugggauuucggcucugucggcggggugcucaacucccuggggaagaugguucaccagaucuuugggagcgcuuauaccgcccuguucucuggcgucagcuggauuaugaaaaucggaauuggcgugcuccugaccuggaucgggcuuaauuccaagaacacaucuaugagcuuuuccugcauugugaucggaaucauuacccuguaccucggcgcugucgugcaggccgacaugggguguguuaucaauuggaagggaaaagaacugaagugcggcagcgggauuuucgugacaaacgagguccauacguggaccgagcaguauaaauuucaagcggauucuccuaagcggcuggccacagcuaucgccggcgcuugggaaaauggaguguguggcauuagauccaccacacgcauggagaaccuucucuggaaacagaucgccaaugaacugaacuacauccugugggagaauaacauuaagcucaccguuguggucggggacaucauuggaauccuggaacagggcaaacggacgcuuaccccgcagcccauggagcugaaguauagcuggaagacaugggggaaagccaagauugugaccgcugagacacaaaauucuuccuucaucaucgauggaccuaacacccccgaaugcccuaacgcgagcagagccuggaauguuugggagguggaagacuacggcuuuggcgucuucacaaccaacauuuggcucaaacugcgcgagauguauacgcagcugugugaccaccggcuuauguccgcugccgugaaggaugaaagagccgugcacgcugacaugggguacuggaucgagucucagaaaaauggaagcuggaagcucgagaaggccucccugauugaagucaaaacaugcaccuggcccaagucucauacccuguggagcaacggcguucucgaguccgauaugaucauuccgaaaagccuggcggggccuaucucucagcacaauuaccgccccggauaucauacacaaaccgcuggcccuuggcaccuugggaagcuggaacucgacuuuaacuacugcgagggaacgacaguggugaucaccgagaauuguggcacacggggccccucccugagaaccacaaccgucagcgggaaacugauucacgaauggugcugucgcucuugcacgcuuccuccccuccgguauaugggagaggauggcuguugguacgggauggaaaucagaccgauuaacgagaaggaagagaauauggugaagucccugguuagcgccggaucuggcaaaguggacaacuucaccauggggguccugugccucgccauccuguucgaggaagugaugcggggaaaguuuggcaaaaagcauaugauugcuggcguucuuuucacauuugugcugcuccugagcgggcagaucaccuggcgcgauauggccagaacacugauuaugaucggauccaaugcgagcgaccggaugggcaugggggucaccuaucuugcucugaucgccacguucaaaauucagccuuuucucgcccugggauucuuucucagaaagcugacaucucgcgagaaccuucugcucggcguggggcuggcuauggccaccacacugcaacuucccgaagauaucgagcagauggcuaauggaauugcccugggccucauggcgcugaagcucaucacccaguucgaaaccuaccagcugugggccgcucuuguuucccugauguguagcaacacaauuuuuacgcucaccguggccuggcggacagcuacccugauccuggccggcaucucccuucugcccaugugccaaucuagcuccaugagaaaaacagacuggcucccuaugaccgucgccgcuaugggggugccgccccugccucucuucaucuuuucucugaaggauacgcuuaaacgcagaagcuggccccugaaugagggagugauggcggucggccugguuuccauccucgccucuagccugcuucggaacgacgugccuauggcugggccccugguggccggaggccuccugauugccuguuaugucaucacagggaccuccgcugaucucaccguggagaaggccgcggacguuacaugggaagaggaagcugagcagaccggagugagccacaaccugaugauuacagucgacgaugacggcacgaugcgcaucaaagaugacgaaaccgagaauauccuuacagugcugcugaagaccgcccuccugauuguuucuggcaucuucccuuacuccauucccgccacacuucugguguggcauaccuggcagaaacagacgcaaagaagcgggguccucugggaugugccgucuccucccgagacccagaaggcugaacuggaggaaggagucuaccggaucaagcagcagggcauuuuugggaaaacacaagugggaguuggcgugcagaaggagggggucuuccacaccauguggcaugugacacgcggagccguucucacccacaacggcaaaagacuggagccuaauugggcguccgugaagaaagaccuuaucagcuauggcgggggauggcggcugucugcucaguggcaaaagggcgaagagguccaggugauugccguggaacccgggaagaacccgaaaaauuuccagacaaugccuggaaucuuucagacgaccacaggcgagaucggggccauugcucuggauuucaagcccggaaccuccggcagcccuaucauuaaccgcgaaggcaaaguugucgggcucuacggaaauggcguggugaccaagaacgggggauaugucuccggcaucgcccaaacaaaugcugagcccgacgggcccacgccugagcuggaagaggaaauguuuaaaaagagaaaccuuaccauuauggaucugcacccgggcagcggaaagacacggaaauaccuccccgccaucgugcgcgaggcgaucaagagacggcugagaacccucauucuggccccuacacgcguuguggcugccgaaauggaggaggcucuuaaaggccugcccauccgguaucagaccacggccacaaagucugaacauaccgggaaagagauugucgaccugaugugccacgccaccuucacaaugagacuccugagcccugugcgcguucccaauuacaaccuuaucauuauggaugaagcucauuuuaccgacccugcguccaucgccgcucggggauauaucucuacaagagugggcaugggggaggccgccgcuauuuucaugaccgccacgccgcccggaacagcggaggcuuuuccucagagcaaugcccccauccaggaugaggagcgcgacauuccugaacgguccuggaacucuggcaaugacuggaucaccgauuucgccgggaagacagucugguuugugcccagcauuaaggcuggcaacgacaucgccaacugucugcgcaaaaauggaaagaaaguuauucaacucuccagaaagaccuucgauacggaguaccagaaaaccaagcugaacgacugggauuuuguggucacaaccgacaucucugaaaugggcgcgaauuucaaggccgaucgggugaucgacccgagacggugccugaaaccugugauucucacagaugggcccgagcgcgucauccuugcuggacccaugccuguuaccguggccagcgcugcccagagacggggccgcguggggagaaacccccagaaggagaaugaccaauacauuuucacaggacagccucugaacaaugaugaagaccacgcucauuggaccgaggccaaaaugcugcucgacaacaucaauacgccggaaggcauuauccccgcgcuguuugagccugaacgggagaaguccgccgcuaucgauggggaguauagacuuaaaggcgaaagccgcaagacauucgucgagcugaugcggagaggagaccuccccguguggcuggcccacaaaguugcuucugaaggcauuaaguacaccgaucgcaaguggugcuuugacggggagcggaacaaucagauccuggaagagaacauggauguggagauuuggaccaaagaaggagagaagaaaaagcucagaccucgcuggcuugacgcccggacauauuccgauccccuggcccugaaagaguucaaggacuuugcugcgggcagaaagagcaucgcccucgaucuggucaccgagauugggcgcgugccgccucaccuugcucauagaacacggaaugcccuggacaaccucguuaugcugcacacgucugaauacggaggccgcgccuauagacaugcuguggaggagcugcccgaaaccauggagacacuccuucugcugggccucaugauccugcuuaccgggggagucaugcuguuccucaucuccggcaaaggggugggaaagacaagcauuggccugaucugugucguggccuccucugggaugcuguggauggcggauauuccucuccaguggaucgccagcgcuauuguucuugaauuuuucaugauggugcugcugauccccgagccugagaaacaacggacaccccaggacaaucagcucgccuacguggucauuggaauccugacgcuugcugccaucguugcggccaacgaaaugggccugcucgagaccacaaagcgcgaucugggcauguccaaagaaccggggguggugagcccuaccucuuaucuggacgucgaccuccaccccgcuuccgccuggacacuuuacgcuguggccaccacgguuauuacacccaugcugagacacaccaucgagaauagcacagcuaacgugucucuggccgcgauugccaaccaagcugucgugcucaugggacuggauaagggcuggccuaucagcaagauggaccuuggggucccgcugcucgcccugggaugcuacucccaggugaauccccugacccucaccgcugccguucuucugcuggugacacauuaugccauuaucggcccugggcuccaggcgaaagcuacgcgggaagcccagaagagaaccgcugccggaaucaugaaaaaccccacagucgauggcauuaugaccaucgaccuggauccugugauuuacgacucuaaguuugagaaacaacuuggccagguuaugcugcucgugcugugugccguccagcugcuccuuaugcgcacaagcugggcuuucugcgaggcccugacccuggcgacggggcccaucacaacccucugggaaggauccccuggcaaguuuuggaauaccacaauugccgugucuauggcuaacaucuuccgggggagcuaucuggccggagcuggccuugccuuuuccaucaugaaaagcguggggaccggaaaaagaggcacaggcucucagggggagacgcugggagaaaaguggaaaaagaaacucaaucaacugucccgcaaggaguucgaucuguacaaaaagagcggcauuaccgaaguugaccggacagaggcgaaggaggggcucaaaagaggagaaaucacccaccaugccgucucccggggcucugcuaaacuucagugguucguggagcgcaacauggugauuccggaagggagagucaucgaucugggauguggccggggcggguggagcuauuacugcgccggacugaaaaagguuacagaggugcgcggcuauaccaaagggggacccggccacgaagaaccugugcccauguccacguacggguggaauauugucaagcucaucucuggaaaggacguguuuuaccugccucccgagaaaugugauacccuucugugcgacauuggcgaaagcuccccgagcccuacaguugaggaaucuagaaccauccgggugcucaagauggucgagcccuggcugaaaaacaaucaguucuguaucaaggugcugaaccccuauaugccugcuguuauugagcaucucgaacgccuucagagaaaacacggcgggaugcuggugcggaauccccugucccgcaacagcacacacgagauguacuggaucucuaauggaaccggcaacauugucuccagcgugaauaugaucucuagacuccugcuuaaccgguuuacaaugaccuauagacgcccuacgauugaaaaggauguggaccugggggccggaacacggcaugucaacgcugagccggaaacccccaauauggacguuaucggcgagagaauccgccggauuaaggaggaacacagcuccaccuggcauuacgaugacgagaacccuuauaaaacaugggccuaccacgggucuuaugaagugaaggcgacgggaagcgccuccagcaugaucaauggcguggucaaacuccugaccaagcccugggaugugguuccuacagugacccaaauggcuaugacagacaccacacccuucggccagcagagagucuuuaaagagaagguggauacccgcacgccgaagccuaugcccgggacccggaaaguuauggaaauuacagccgaguggcuguggagaacccucggacgcaacaagcggccuagacugugcacacgcgaggaguucaccaaaaaggugcggacgaaugcugccaugggcgccgucuuuacagaggaaaaccaaugggacuccgcgagagcugccguggaggaugaagaguucuggaaacuuguugaccgcgagagagaacugcacaagcucgggaaauguggaucuugcguguacaauaugaugggcaagcgggagaagaaacugggggaauuuggcaaggccaaaggaagccgcgcuaucugguacauguggcuuggcgccagauaucuggaguucgaggcucucggguuucugaacgaagaucauugguucucccgggaaaauucuuacagcggagucgaaggcgaggggcugcacaagcucggauauauucugagagacaucuccaaaauccccggcggggccauguacgcggaugacaccgccggcugggacacacggauuaccgaagaugaccuucauaacgaggagaagaucacgcagcagauggauccugaacaccgccagcuggcuaaugccauuuuuaagcucaccuaucaaaacaaaguggucaaggugcagagacccacaccgaaaggaaccguuauggacaucauuucucggaaggaucagcgcggcagcggacaggugggaacauacggccugaauaccuucacaaacauggaggcucaacuuaucagacagauggaaggggagggaguccuguccaaaaccgaccucgaaaauccucaucugcuggagaagaagaucacgcaguggcucgagacaaaaggcguggaacggcugaagcgcauggccauuagcggggaugacugcgugguuaaacccaucgaugacagauucgcgaacgcccuucuggcucucaacgauaugggcaaggugcggaaagacauuccccaguggcaaccuucuaagggauggcacgauuggcagcaggucccguuuuguucccaccauuuccacgagcugaucaugaaggacggccgcaaacuugugguucccugcagaccucaggacgaacugauugggcgggcccgcaucagccaaggagcuggcuggucucucaaggagaccgccugucuggggaaggcuuaugcccagaugugggcgcugauguacuuucauagacgggaucuccgccuggccuccaaugcuauuugcagcgccgugcccguccacugggugccuaccucuagaacaaccugguccauccacgcccaucaccaguggaugacaacggaagacaugcuuaccgucuggaaccggguguggaucgaggauaaucccuggauggaggacaagacaccuguuaccacaugggaagaugugcccuaccugggaaaaagagaggaccaaugguguggcagccucauugggcugaccucccgcgcuacgugggcccagaacauccuuaccgcgauucagcagguccggagccugaucggcaaugaagaguuccucgauuauaugccgucuaugaagagauuucgcaaggaggaagagagcgaaggagcuauuugguga

SEQ ID NO: 20395 - RNA, 9873 nt, Artificial Sequence
  derived and/or modified CDS sequence (opt5) from DENV-3__KX380840__SS-prME
accagccucugccucaugaugaugcugcccgccacccuugcuuuccaccugacgucccgggacggcgagccucggaugauuguggggaagaacgaacgcggaaagucucuccuguuuaagaccgccagcggcauuaauauguguacacuuaucgcgauggaucugggggagaugugcgacgauaccauuacauacaaauguccccucaucaccgaaguggagcccgaagacauugauugcugguguaaccugacauccaccuggguuacguauggaaccugcaaucaggcuggcgagcauagacgggacaagcgcucuguggcccuggccccucacguggggaugggacucgauacaagagcucaaaccuggaugagcgccgagggcgcuuggcggcaggucgaaaaaguggagacaugggccuuccgccaucccggcuuuaccauccuggcgcuuuuccuggcccacuacaucgggacgucccucacacagaagguugugauuuuuauccugcuuaugcuggucaccccuucuaugacaaugagaugugugggaguuggcaaccgggacuucguggaagggcucagcggagcuaccugggucgauguggugcuggagcauggcgggugcgucaccacaauggccaagaauaaacccacgcuggacauugagcuccagaagaccgaagcuacacaacuggccacccuucgcaaacuguguaucgagggaaagauuacaaacguuaccacggauuccagaugcccuacacagggcgaagcgacccucccggaggaacaggaccagaauuauguguguaaacacaccuacguggaucggggcugggggaacggaugcggccuguuugggaagggaagccuugucacaugcgccaaguuccaaugucuggagcucaccgagggcaaagugguucagcacgaaaaucugaaguauacagugaucauuacgguccauaccggggaccagcaccaggugggaaacgagacacaaggcguuaccgcugaaaucacaccccaggccucuaccguggaggcuaucuuucgcuccuacggcacgcuggggcucgaaugcagcccuagaaccggacuggacuucaaugagaugauucuucugacaaugaaaaacaaggccuggaugguccaucggcagugguuuuucgaucucccccugccuuggaccucuggcgccacaaccgagacgcccacauggaauaaaaaggaacuucuggugaccuuuaaaaacgcucacgcgaagaagcaagaggucgugguucucgggucccaggaaggagccaugcacacagcucugaccggcgccaccgagauccagacaagcgggggcacgucuauuuucgccggacaucugaaaugucgccucaagauggacaaacuggaacuuaagggcauguccuaugcuaugugcagcaaugccuucgugcugaaaaaggaggucuccgagacccagcacgggacaauccucauuaagguggaauacaaaggagaggaugcgccguguaagaucccuuuuucuaccgaagacggccaagggaaagcucauaacggaagacugaucacagccaaccccguugugaccaagaaagaggagccugucaauauugaagccgagccgcccuucggcgaaagcaacaucauuaucgggauuggcgauaaggcucugaagaucaauugguacaaaaagggauccagcaucggcaaaauguuugaggccacggcuagaggggccagacgcauggcgauucuuggagacacagccugggauuucggcucugucggcggggugcucaacucccuggggaagaugguucaccagaucuuugggagcgcuuauaccgcccuguucucuggcgucagcuggauuaugaaaaucggaauuggcgugcuccugaccuggaucgggcuuaauuccaagaacacaucuaugagcuuuuccugcauugugaucggaaucauuacccuguaccucggcgcugucgugcaggccgacaugggguguguuaucaauuggaagggaaaagaacugaagugcggcagcgggauuuucgugacaaacgagguccauacguggaccgagcaguauaaauuucaagcggauucuccuaagcggcuggccacagcuaucgccggcgcuugggaaaauggaguguguggcauuagauccaccacacgcauggagaaccuucucuggaaacagaucgccaaugaacugaacuacauccugugggagaauaacauuaagcucaccguuguggucggggacaucauuggaauccuggaacagggcaaacggacgcuuaccccgcagcccauggagcugaaguauagcuggaagacaugggggaaagccaagauugugaccgcugagacacaaaauucuuccuucaucaucgauggaccuaacacccccgaaugcccuaacgcgcucagagccuggaauguuugggagguggaagacuacggcuuuggcgucuucacaaccaacauuuggcugaaacugcgcgagauguauacgcagcuuugugaccaccggcucaugagcgcugccgugaaggaugaaagagccgugcacgcugacaugggguacuggaucgagucccagaaaaauggaucuuggaagcuggagaaggccagccugauugaagucaaaacaugcaccuggcccaagucccauacccucuggucuaacggcguucuggagagcgauaugaucauuccgaaaucccuugcggggccuaucagccagcacaauuaccgccccggauaucauacacaaaccgcuggcccuuggcaccuggggaagcucgaacuggacuuuaacuacugcgagggaacgacaguggugaucaccgagaauuguggcacacggggccccucucugagaaccacaaccgucuccgggaaacuuauucacgaauggugcugucgcagcugcacgcucccuccccugcgguauaugggagaggauggcuguugguacgggauggaaaucagaccgauuaacgagaaggaagagaauauggugaagucucugguuuccgccggaagcggcaaaguggacaacuucaccauggggguccucugccuggccauccuuuucgaggaagugaugcggggaaaguuuggcaaaaagcauaugauugcuggcguucuguucacauuugugcuccugcugucugggcagaucaccuggcgcgauauggccagaacacuuauuaugaucggaagcaaugcguccgaccggaugggcaugggggucaccuaucuggcucucaucgccacguucaaaauucagccuuuucuggcccucggauucuuucugagaaaacuuacaagccgcgagaaccugcuccugggcguggggcuggcuauggccaccacacuucaacugcccgaagauaucgagcagauggcuaauggaauugcccucggccugauggcgcucaagcugaucacccaguucgaaaccuaccagcuuugggccgcucugguuucucucauguguuccaacacaauuuuuacgcugaccguggccuggcggacagcuacccugauccuugccggcaucagccugcuccccaugugccaauccucuagcaugagaaaaacagacuggcugccuaugaccgucgccgcuaugggggugccgccccucccucuguucaucuuuucccuuaaggauacgcugaaacgcagaucuuggccccugaaugagggagugauggcggucggccucguuagcauccuggccuccucucuucugcggaacgacgugccuauggcugggccccucguggccggaggccugcucauugccuguuaugucaucacagggaccagcgcugaucugaccguggagaaggccgcggacguuacaugggaagaggaagcugagcagaccggagugucccacaaccuuaugauuacagucgacgaugacggcacgaugcgcaucaaagaugacgaaaccgagaauauccugacagugcugcucaagaccgcccugcuuauuguuagcggcaucuucccuuacucuauucccgccacacugcucguguggcauaccuggcagaaacagacgcaaagauccgggguccugugggaugugccgagcccucccgagacccagaaggcugaacucgaggaaggagucuaccggaucaagcagcagggcauuuuugggaaaacacaagugggaguuggcgugcagaaggagggggucuuccacaccauguggcaugugacacgcggagccguucugacccacaacggcaaaagacuugagccuaauugggcgucugugaagaaagaccugaucuccuauggcgggggauggcggcugagcgcucaguggcaaaagggcgaagagguccaggugauugccguggaacccgggaagaacccgaaaaauuuccagacaaugccuggaaucuuucagacgaccacaggcgagaucggggccauugcucucgauuucaagcccggaaccucuggcuccccuaucauuaaccgcgaaggcaaaguugucgggcuguacggaaauggcguggugaccaagaacgggggauaugucagcggcaucgcccaaacaaaugcugagcccgacgggcccacgccugagcuugaagaggaaauguuuaaaaagagaaaccugaccauuauggaucuccacccgggcuccggaaagacacggaaauaccugcccgccaucgugcgcgaggcgaucaagagacggcucagaacccugauucuugccccuacacgcguuguggcugccgaaauggaggaggcucugaaaggccugcccauccgguaucagaccacggccacaaagagcgaacauaccgggaaagagauugucgaccucaugugccacgccaccuucacaaugagacugcuuucuccugugcgcguucccaauuacaaccugaucauuauggaugaagcucauuuuaccgacccugcgagcaucgccgcucggggauauaucuccacaagagugggcaugggggaggccgccgcuauuuucaugaccgccacgccgcccggaacagcggaggcuuuuccucagucuaaugcccccauccaggaugaggagcgcgacauuccugaacggagcuggaacuccggcaaugacuggaucaccgauuucgccgggaagacagucugguuugugcccucuauuaaggcuggcaacgacaucgccaacugucuccgcaaaaauggaaagaaaguuauucaacugagcagaaagaccuucgauacggaguaccagaaaaccaagcugaacgacugggauuuuguggucacaaccgacaucuccgaaaugggcgcgaauuucaaggccgaucgggugaucgacccgagacggugccucaaaccugugauucuuacagaugggcccgagcgcgucauccuggcuggacccaugccuguuaccguggccucugcugcccagagacggggccgcguggggagaaacccccagaaggagaaugaccaauacauuuucacaggacagccucugaacaaugaugaagaccacgcucauuggaccgaggccaaaaugcuccuggacaacaucaauacgccggaaggcauuauccccgcgcuuuuugagccugaacgggaaaagagcgccgcuaucgauggggaguauagacugaaaggcgaaucccgcaagacauucgucgagcucaugcggagaggagaccugcccguguggcuggcccacaaaguugcuagcgaaggcauuaaguacaccgaucgcaaguggugcuuugacggggagcggaacaaucagauccucgaagagaacauggauguggagauuuggaccaaagaaggagagaagaagaaacuuagaccucgcuggcuggacgcccggacauauucugauccccuggcccucaaagaguucaaagacuuugcugcgggcagaaaguccaucgcccuggaucuugucaccgagauugggcgcgugccgccucaccuggcucauagaacacggaaugcccucgacaaccugguuaugcugcacacgagcgaauacggaggccgcgccuauagacaugcuguggaggagcuccccgaaaccauggagacacuucugcugcucggccugaugauccuucugaccgggggagucaugcuguuccugaucucuggcaaaggggugggaaagacauccauuggccugaucugugucguggccagcuccgggaugcucuggauggcggauauuccucuucaguggaucgccucugcuauuguucuggaauuuuucaugauggugcugcucauccccgagccugagaaacaacggacaccccaggacaaucagcuggccuacguggucauuggaauccuuacgcuggcugccaucguugcggccaacgaaaugggccuccuggagaccacaaagcgcgaucugggcaugagcaaagaaccgggggugguguccccuaccagcuaucucgacgucgaccuucaccccgcuucugccuggacacuguacgcuguggccaccacgguuauuacacccaugcugagacacaccaucgaaaauuccacagcuaacgugagccucgccgcgauugccaaccaagcugucgugcugaugggacuugauaagggcuggccuaucucuaagauggaccugggggucccgcuccuggcccugggaugcuacagccaggugaauccccucacccuuaccgcugccguucugcugcucgugacacauuaugccauuaucggcccugggcugcaggcgaaagcuacgcgggaagcccagaagagaaccgcugccggaaucaugaaaaaccccacagucgauggcauuaugaccaucgaccuugauccugugauuuacgacuccaaguuugagaaacaacugggccagguuaugcuccuggugcugugugccguccagcuccuucugaugcgcacaucuugggcuuucugcgaggcccugacccucgcgacggggcccaucacaacccugugggaaggaagcccuggcaaguuuuggaauaccacaauugccguguccauggcuaacaucuuccgggggucuuaucuugccggagcuggccuggccuuuagcaucaugaaguccguggggaccggaaaaagaggcacaggcagccagggggagacgcucggagaaaaguggaaaaagaaacugaaucaacugucucgcaaggaguucgaucucuacaaaaaguccggcauuaccgaaguugaccggacagaggcgaaggaggggcuuaaaagaggagaaaucacccaccaugccgucagccggggcuccgcuaagcugcagugguucguggagcgcaacauggugauuccggaagggagagucaucgaucugggauguggccggggcggguggucuuauuacugcgccggacucaaaaagguuacagaggugcgcggcuauaccaaagggggacccggccacgaggaaccugugcccaugagcacguacggguggaauauugucaagcugaucuccggaaaggacguguuuuaccuuccucccgagaaaugugauacccugcucugcgacauuggcgaaucuagcccguccccuacaguugaggaaagcagaaccauccgggugcugaagauggucgagcccuggcugaaaaacaaucaguucuguaucaaggugcucaaccccuauaugccugcuguuauugagcaucuugaacgccugcagagaaaacacggcgggaugcuggugcggaauccccucucucgcaacuccacacacgagauguacuggaucagcaauggaaccggcaacauugucucuuccgugaauaugaucagcagacugcuucugaaccgguuuacaaugaccuauagacgcccuacgauugaaaaggauguggaccucggggccggaacacggcaugucaacgcugagccggaaacccccaauauggacguuaucggcgagagaauccgccggauuaaggaggaacacucuagcaccuggcauuacgaugacgagaacccuuauaaaacaugggccuaccacggguccuaugaagugaaggcgacgggaucugccagcuccaugaucaauggcguggucaaacugcugaccaagcccugggaugugguuccuacagugacccaaauggcuaugacagacaccacacccuucggccagcagagagucuuuaaagagaagguggauacccgcacgccgaagccuaugcccgggacccggaaaguuauggaaauuacagccgaguggcucuggagaacccugggacgcaacaagcggccuagacuuugcacacgcgaggaguucaccaaaaaggugcggacgaaugcugccaugggcgccgucuuuacagaggaaaaccaaugggacagcgcgagagcugccguggaggaugaagaguucuggaaacugguugaccgcgagagagaacuccacaagcuggggaaauguggauccugcguguacaauaugaugggcaagcgggagaagaaacuuggggaauuuggcaaggccaaaggaucucgcgcuaucugguacauguggcugggcgccagauaucucgaguucgaggcucugggguuucugaacgaagaucauugguucagccgggaaaauuccuacucuggagucgaaggcgaggggcuccacaagcugggauauauucuuagagacaucagcaaaauccccggcggggccauguacgcggaugacaccgccggcugggacacacggauuaccgaagaugaccugcauaacgaggagaagaucacgcagcagauggauccugaacaccgccagcucgcuaaugccauuuuuaagcugaccuaucaaaacaaaguggucaaggugcagagacccacaccgaaaggaaccguuauggacaucauuucccggaaggaucagcgcggcucuggacaggugggaacauacggccuuaauaccuucacaaacauggaggcucaacugaucagacagauggaaggggagggaguccucagcaaaaccgaccuggaaaauccucaucugcucgagaagaagaucacgcaguggcuggagacaaaaggcguggaacggcuuaagcgcauggccauuuccggggaugacugcgugguuaaacccaucgaugacagauucgcgaacgcccugcucgcucugaacgauaugggcaaggugcggaaagacauuccccaguggcaaccuagcaagggauggcacgauuggcagcaggucccguuuuguucucaccauuuccacgagcuuaucaugaaggacggccgcaaacuggugguucccugcagaccucaggacgaacucauugggcgggcccgcaucucccaaggagcuggcuggagccugaaggagaccgccugucuggggaaggcuuaugcccagaugugggcgcucauguacuuucauagacgggaucugcgccuugccucuaaugcuauuugcuccgccgugcccguccacugggugccuaccagcagaacaaccuggucuauccacgcccaucaccaguggaugacaacggaagacaugcugaccgucuggaaccggguguggaucgaggauaaucccuggauggaggacaagacaccuguuaccacaugggaagaugugcccuaccucggaaaaagagaggaccaaugguguggcucccugauugggcuuaccagccgcgcuacgugggcccagaacauccugaccgcgauucagcagguccggucccucaucggcaaugaagaguuccuggauuauaugccgagcaugaagagauuucgcaaggaggaagagucugaaggagcuauuugguga

SEQ ID NO: 20396 - RNA, 9873 nt, Artificial Sequence
  derived and/or modified CDS sequence (opt5) from DENV-3__JF808121__SS-prME
accagccugugccucaugaugauccugcccgccgcucuugccuuccaccugaccuccagagacggagaaccucggaugauuguggggaagaacgaacgcggaaagucucuccuguuuaagacggcguccggcaccaauauguguacccuuaucgcuauggaucugggggaaaugugcgacgauaccgugaccuacaaauguccgcacauuaccgaaguugaacccgaagacaucgauugcugguguaaccucaccuccaccugggugacguauggaaccugcaaucaggccggcgaaagacggcgcgacaagagaucuguggcccuggcuccucacgucgggaugggacuggauacacggacccagacauggaugagcgccgagggcgcuuggcgccagguggaaaaaguugagaccugggcccucagacaucccggcuucacgauucuggcgcuuuuucuggcccacuacaucgggacaucccucacccagaagguggucaucuucauucugcuuaugcuggugacaccuucuaugaccaugcgguguguuggagugggcaaccgcgacuuugucgaagggcucagcggagcuaccuggguggaugugguccuggagcauggcgggugcguuacaacgauggccaagaauaaacccacccuggacaucgagcuccagaagacagaagcuacccagcuggccacacuuagaaaacuguguauugagggaaagaucaccaacauuacgacagauucccggugcccuacccagggcgaagcggugcucccggaggaacaggaccagaauuauguguguaaacacaccuacgucgaucgcggcugggggaacggaugcggccuguucgggaagggaagccuugugacaugcgccaaguuucaaugucuggagcucaucgagggcaaaguugugcaguaugaaaaucugaaguacaccgucauuaucacagugcacacgggggaccagcaucagguuggaaacgagacccaaggcgugacagcugaaaucacaccccaggccucuacaaccgaggcuauucugccugaauauggcacgcucgggcuggagugcucccccagaaccggacuugacuucaaugagaugauccugcucacaaugaaaaacaaggccuggaugguccaccggcagugguuuuucgaucugccucuucccuggaccagcggcgccacaaccgaaacgccgacauggaaucgcaaagagcugcucgugaccuuuaagaacgcucaugcgaaaaagcaagaagucgugguucuggggucucaggagggagccaugcacacagcucugaccggcgccaccgaaauucaaaauuccgggggcacaagcaucuucucuggacaccucaaguguagacugaaaauggacaaacuugagcugaaaggcauguccuacgccaugugcacgaacaccuuugugcucaagaaagaggucagcgaaacacagcaugggaccauucugaucaagguggaguacaagggagaagaugcuccuuguaaaauccccuucuccacagaggacggccaagggaaggcccacaacggacggcugauuaccgcgaauccuguugugacgaaaaaggaggaacccgucaacaucgaggcugaacccccuuucggcgagucuaauauugugaucgggacaggcgauaacgcccuuaaaauuaauugguauaagaagggaagcuccaucggcaaaauguuugaagccaccgcuagaggggcccgccggauggcuauccucggagacaccgccugggauuucggcagcgucgggggaguucugaacucucugggcaagaugguccaucagauuuuuggguccgcguacacagcccucuucagcggcgugucuugggugaugaaaaucggaauuggcguccugcuuaccuggaucgggcugaauagcaagaacacauccaugucuuuuagcugcauugcuaucggaauuaucacgcucuaucugggcgccgugguucaggcugacauggggugugugaucaauuggaaaggaaaggagcugaagugcggcuccgggauuuucgucaccaacgaggugcacacauggaccgaacaguacaaauuucaagccgauagcccgaagagacuugcgacagccaucgcuggcgccugggagaauggaguuuguggcauucgcucuaccacgcggauggaaaaccuccuguggaaacagaucgcuaaugagcugaacuauauucucugggaaaauaacaucaagcugaccguggucgugggggacaucauuggaguucuugagcagggcaaaagaacacugacaccccagccuauggagcucaaguacuccuggaaaacaugggggaaggccaagaucgugaccgccgaaacacaaaacagcucuuucauuaucgauggacccaauaccccugagugccccuccgcuagccgcgcguggaacgucugggaaguggaggacuauggcuuuggcguguucacgacaaauauuuggcugaaacugcgggaagucuacacccagcuuugugaccauagacucauguccgccgcuguuaaggaugagcgcgccgugcacgccgacaugggguacuggaucgagucucagaaaaacggaagcuggaagcuggaaaaggcuucccugaucgaggugaagaccugcacauggccgaagucucacacccucuggagcaauggcguccuggaauccgauaugauuaucccuaaaagccuugccgggcccauuucucagcauaaccaccggccuggauaucauacgcaaacagcgggccccuggcaccuggggaagcucgagcuggacuuuaauuacugcgagggaaccacagugguuaucaccgaaaacuguggcacaagaggcccuucccugcgcaccacgaccgugagcgggaaacuuauucacgaguggugcugucggucuugcacacugcccccgcugagauauaugggagaagauggcuguugguacgggauggagauccggccuaucuccgaaaaggaggagaauauggucaaaagccuggugucugcuggaagcggcaagguugacaacuucaccaugggggugcucugccuggccauucuuuuugaagaggucaugcgcggaaaguucggcaaaaagcauaugaucgccggcguguucuuuacauucguucugcuccuguccgggcagauuaccuggagagauauggcucacacgcugacaaugaucggaagcaaugccucugaccggaugggcaugggggugaccuaucuugcgcugauugcuacauuuaaaauccagcccuuccucgcccugggauuuuuccucagaaagcugaccucccgcgaaaaccuucugcucggcgucgggcuggccauggcuaccacacugcaacuucccgaggauauugaacagauggccaauggaaucgcucugggccucauggcccugaaacucaucacgcaguuugagaccuaccagcuguggauugcgcuuaucagccugacauguuccaacaccauguucacacucaccguggccuggcggacggcuacacugauucuggccggcgugucucuucugccugucugccaaagcuccucuaugagaaagaccgacuggcucccgauggcuguugccgccaugggggugcccccucugccccucuuuaucuucagccugaaggauacccuuaaacgcagauccuggccucugaaugagggagugauggcugucggccuggugucuauucucgcgagcucccugcuucggaacgacguucccauggccgggccucugguggcuggaggccuccugaucgccuguuaugucaucacagggaccagcgccgaucucacaguggaaaaggcugccgacauuacgugggaggaagaggcggaacagaccggaguuucucauaaccugaugaucacaguggacgaugacggcaccaugcgcauuaaagaugacgagacagagaauauccuuaccguccugcugaagacggcucuccugauuguguccggcgucuuucccuacagcaucccggccacccuucugguguggcacacauggcagaaacagacccaaagaucugggguucucugggaugugccuucucccccugaaacacagaaggccgagcuggaagagggagucuaccggaucaaacagcagggcauuuucgggaagacccaagugggaguuggcgugcagaaggagggggucuuucauacaauguggcacgugacgcgcggagcugugcucaccuauaacggcaaaagacuggaacccaauugggccagcguuaagaaagaccuuaucagcuacggcgggggauggcggcuguccgcgcaguggcaaaagggcgaggaaguccaggugauugcuguggagccggggaaaaacccuaagaauuuccagacaaugcccggaaccuuccagaccacaacgggcgaaaucggggccauugcccuggauuuuaagccuggaaccagcggcucccccaucauuaaccgcgagggcaaagucguggggcucuauggaaauggcguugugacaaagaacgggggauacgucagcggcaucgcucaaaccaaugccgagcccgacgggccuacaccggaacuggaggaagagauguucaaaaagagaaaccuuaccaucauggaucugcaccccggcucuggaaaaacgcggaaguaucucccugcuauugugcgcgaagccaucaagagacggcugagaacacucauucuggcgcccacccgcguuguggccgcugagauggaggaagcccuuaaaggccugccuauccgguaccagaccacagcuaccaagagcgagcauacagggagagaaauugucgaccugaugugccacgccaccuuuacgaugcgccuccugucccccgugcggguuccuaauuauaaccuuaucaucauggaugaggcccauuucacagacccggcuucuauugcggccagaggauacaucagcacccgcgugggcaugggggaagcugccgccauuuuuaugacagcuacacccccuggaacggccgaugcguucccccaguccaaugcuccuauccaggacgaggagcgggacauucccgaaagaucuuggaacagcggcaaugaguggaucaccgauuuugccgggaaaacagucugguucgugccguccaucaaggccggcaacgacauugcuaacugucugcgcaaaaauggaaagaaggugauccaacucucucggaaaaccuuugauacagaauaccagaagaccaaacugaacgacugggauuucgucguuacaaccgacauuagcgagaugggcgccaauuuuaaggcggauagagugaucgacccucggcgcugccugaaacccgugauucucacggaugggcccgagagagucauccuugccggaccuaugcccgugacagcugccuccgcugcccagcggcgcggcagaguugggcggaacccucagaaggaaaaugaccaauauauuuucaccggacagccgcugaacaaugaugaggaccacgcucauuggaccgaagccaagaugcugcucgacaacaucaauacacccgagggcaucauuccugcgcuguucgaacccgagagagagaaaagcgccgcuaucgauggggaauaccgccuuaagggcgagucucggaaaaccuuuguggaacugaugagacgcggagaccucccugucuggcuggcccacaagguggcuuccgagggcauuaaauauacagaucggaaguggugcuucgacgggcagagaaacaaucagauccuggaagagaacauggauguugagauuuggacgaaagaaggagagaagaagaaacuccgcccccgguggcuugacgccagaaccuacagcgauccgcuggcccugaaggaauuuaaagacuucgcugcgggccgcaagucuaucgcccucgaucuggugacagagaucgggagagucccuucccaccuugcucaucggacccgcaaugcccuggacaaccucgugaugcugcacacaagcgaacauggaggcagagccuaucggcacgcugucgaggagcugcccgaaaccauggagacgcuccuucugcugggccucaugauucugcuuaccgggggagccaugcuguuucucaucuccggcaaagggauuggaaagacaucuaucggccugauuugugugaucgcgagcuccgggaugcuguggauggccgaaaucccucuccaauggauugcuagcgccaucguucuugaguucuuuaugauggugcugcugauucccgagccugaaaagcagcgcacaccccaggauaaucaacucgcuuacguggucaucggcauucucacacuugccgcgaucauugccgcuaacgagaugggacugcucgaaaccacgaaaagagaccugggcaugucuaaggagccggggguuguguccccuacaagcuaucuggauguggaccuccaccccgccucugcuuggacccuuuacgccgucgcuacaaccgugaucacccccaugcugcggcauacaaucgaaaauagcacggccaacguuucccuggcggccauugcuaaccaggccgugguccucaugggacuggacaaaggcuggccuaucucuaagauggaucuuggggugccgcugcucgcucugggaugcuacagccaggucaauccccugacccucacagccgccgugcuucugcugauuacccacuaugcgaucauuggcccugggcuccaggcuaaagccacaagagaggcucaaaagcgcaccgccgccggaaucaugaagaaccccacgguugacggcaucaugacaauugaucuggacccugugaucuacgauuccaaauucgagaagcagcuuggccaggucaugcugcucgugcugugugcuguucagcugcuccuuaugcggaccucuugggcccugugcgaagcgcugacccucgccacagggcccauuaccacacugugggagggaagcccuggcaaauuuuggaauacgaccaucgcuguguccauggccaacauuuucagagggagcuaucuugcuggagccggccuggcguuuucuaucaugaaguccgucgggacaggaaaacgcggcaccggcagccaaggggaaacacucggagagaaguggaagaaaaagcugaaucagcugucccggaaagaguucgaccucuacaagaaaucuggcaucaccgagguggauagaacggaggccaaggaagggcuuaaacggggagagauuacccaucacgcugugagccgcggcuccgccaagcugcagugguuuguugaaagaaacauggucaucccggaggggcgggugauugaccugggauguggccgcggcggguggucuuauuacugcgcuggacucaagaaagugacagaagucagaggcuauaccaaagggggacccggccaugaggagccuguucccaugagcacauacggguggaauaucgugaaacugauguccggaaaggauguguucuaccuuccucccgaaaaaugugacacccugcucugcgauauuggcgagagcucuccguccccuacagucgaagagagccggaccauccgcgugcugaagaugguugagcccuggcugaagaacaaucaguucuguauuaaagugcucaaccccuauaugccuacggucaucgaacaccuugagagacugcaacggaagcacggcgggaugcuggugcgcaauccccucucuagaaacuccacacaugaaauguacuggaucagcaauggaaccggcaacauuguugccucugugaauauggucagccggcugcuucugaacagauuuaccaugaaacaccgccggccuacaaucgagaaggacguggaucucggggcuggaacgagacaugugaacgccgaaccggagacccccaauauggacgucauuggcgagcgcaucaaacggauuaaggaagaacacaacuccacauggcacuaugacgaugaaaauccuuacaagaccugggcguaucaugggucuuacgagguuaaagccacaggaagcgcuuccagcaugaucaacggcguggugaagcugcugaccaaacccugggacgucgugccuaugguuacacagauggccaugaccgauacgacccccuucggccagcaaagaguguuuaaggaaaaagucgacacacgcaccccgcgguccaugccugggacaagacgcgugaugggaaucaccgcugaguggcucuggaagacgcugggccggaauaagaaacccagacuuugcccucgcgaggaguucacaaagaaaguucggaccaacgccgccaugggggcgguguuuacagaggaaaaucagugggauucugcuaaggccgccgucgaggacgaagauuucuggaaacugguggacagagagcgcgagcuccacaagcugggaaaauguggcagcugcguuuauaacaugauggggaagagagaaaagaaacuuggcgaguuuggaaaggcuaaaggcucccgggccauuugguacauguggcugggggcucgcuaccucgaguucgaggcccugggauuucugaaugaggaucauugguucucuagagaaaacagcuauuccggcguggagggggaaggacuccacaagcugggcuacauccuucgggacauuucuaaaauccccgggggcgcgauguaugccgaugacaccgcuggaugggacacgagaauuaccgaggaugaccugcauaaugaagagaagaucacacagcagauggauccugagcaccggcaacucgccaacgcuaucuuuaagcugaccuaccagaauaaagucgugaagguccagcgccccacaccgaccggcacagugauggacauuaucagcagaaaagaucagcggggguccggacaaguuggcaccuaugggcuuaacacguucacaaauauggaagcccagcugauucgccagauggagggagaaggcgugcucagcaaggcggaccuggagaacccucaucugcccgagaagaagaucacccaguggcucgagaccaagggggucgagagacugaaacggauggccauuucuggcgaugacugcguggugaagcccaucgaugaccgcuuugcuaacgcccuucuggcucucaaugauaugggaaaaguuagaaaggacaucccucaauggcagccguccaaaggcuggcaugauuggcaacaggugcccuucuguagccaccauuuccacgaacugauuaugaaggacgggcggaaacuugucgugccuugccgcccccaagacgagcugaucggcagagcccggauuucucagggcuccggguggagccuccgcgaaacagcuugucugggaaaagccuacgcgcagauguggucucugauguauuuucacagacgggaucuccgccuggccuccaacgcuaucugcagcgccguuccugugcauuggguccccaccuccagaaugacauggagcauucacgcccaucaccaauggaugacgaccgaggacaugcuuacaguguggaaucgggucuggaucgaagauaacccuuggauggaggacaagacccccgugacaaccugggagaauguuccguaccugggcaaaagagaagaucaguggugugggucucucauuggccugacgagccgcgcuaccugggcccagaacaucccuacagcgauccagcaagugcggucccuuauuggaaaugaggaguuccuggacuacaugcccucuaugaagagauuucgcaaagaggaggaaagcgagggcgcuaucugguga

SEQ ID NO: 20397 - RNA, 9873 nt, Artificial Sequence
  derived and/or modified CDS sequence (opt5) from DENV-3__JF808120__SS-prME
acaagccucugccucaugaugauucugcccgccgcucuugccuuccaccugacguccagagacggagagccucggaugauuguggggaagaaugaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaagguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaagcccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcucauugagggcaaaguugugcaguaugaaaaucugaaguacacagucaucaucaccgugcacacaggggaccagcaucagguuggaaacgagacgcaaggcgugaccgcugaaauuacaccccaggccucuaccacagaggcuauccugccugaauauggcacccucgggcuggagugcucccccagaacgggacuugacuucaaugagaugauucugcucaccaugaaaaacaaggccuggaugguccaccggcagugguuuuucgaucugccucuucccuggacaagcggcgccaccacagaaaccccgacguggaaucgcaaagagcugcucgugacauuuaagaacgcucaugcgaaaaagcaagaagucgugguucuggggucucaggagggagccaugcacaccgcucugacaggcgccaccgaaauccagaauagcgggggcaccagcauuuucgccggacaccucaaguguagacugaaaauggacaaacuugagcugaaaggcaugucuuacgcuaugugcacaaacacguuugugcucaagaaagaggucuccgaaacccagcaugggacaauccugaucaagguggaguacaagggagaagaugccccuuguaaaauucccuucagcaccgaggacggccaagggaaggcgcacaacggacggcugaucacagcuaauccuguugugaccaaaaaggaggaacccgucaacauugaggccgaacccccuuucggcgaguccaauaucgugauugggacgggcgauaacgcccuuaaaaucaauugguauaagaagggaucuagcaucggcaaaauguuugaagcuacagccagaggggcucgccggauggccauucucggagacaccgcgugggauuucggcuccgucgggggaguucugaacagccugggcaagaugguccaucagaucuuugggucugccuacaccgcucucuucuccggcgugagcugggugaugaaaauuggaaucggcguccugcuuacauggauugggcucaauucuaagaacaccagcauguccuuuucuugcaucgccauuggaaucaucacacucuaucugggcgcugugguucaggccgacauggggugugugauuaauuggaaaggaaaggagcugaagugcggcagcgggaucuucgucacgaacgaggugcacaccuggacagaacaguacaaauuucaagcggauuccccgaagagacuugccaccgcuauugccggcgcuugggagaauggaguuuguggcauccgcagcacaacccggauggaaaaccuccuguggaaacagauugccaaugagcugaacuauauccucugggaaaauaacaucaagcugacgguggucgugggggacauuaucggaguucuuaaacagggcaagagaacccugacaccccagccuauggagcucaaauacucuuggaagaccugggggaaggccaaaauugugacagcugagacccaaaacuccagcuucaucauugauggacccaauacaccugaaugccccucugcgucccgcgccuggaacgucugggagguggaagacuauggcuuuggcguguucaccacgaauaucuggcugaagcugcgggaggucuacacacagcuuugugaccauagacucaugagcgcugccguuaaagaugaacgcgccgugcacgcugacaugggguacuggaucgagucccagaagaacggaucuuggaaacuggagaaggccagccugauugaagugaagaccugcaccuggccgaaaucccacacacucuggucuaauggcguccuggagagcgauaugaucauuccuaagucccuugcggggcccaucagccagcauaaccaccggccuggauaucauacccaaacggcuggccccuggcaccuggggaaacucgaacuggacuuuaauuacugcgagggaacaaccgugguuauuacagagaacuguggcaccagaggcccuucucugcgcacaaccacgguguccgggaaacuuauccacgaauggugcugucggagcugcacccugcccccgcugagauauaugggagaggauggcuguugguacgggauggaaauccggccuauuucugagaaagaagagaauauggucaagucccuggugagcgccggaucuggcaagguugacaacuucacaaugggggugcucugccuggccauccuuuuugaggaagucaugcgcggaaaauucggcaagaaacauaugauugcuggcguguucuuuaccuucguucugcuccugagcgggcagaucacauggagagauauggcccacacccugauuaugaucggauccaaugcgagcgaccggaugggcaugggggugacguaucuugcucugauugccacauuuaagauccagcccuuccucgcccugggauuuuuccucagaaaacugaccucucgcgagaaccuucugcucggcgucgggcuggcuauggccacaacccugcaacuucccgaagauaucgagcagauggcuaauggaauugcccugggccucauggcgcugaagcucaucacccaguuugaaacauaccagcuguggacggcccuuauuucccugaccuguagcaacacaauguucacccucacaguggcuuggcggaccgccacgcugauccuggcuggcgugucccuucugccugucugccaaucuagcuccaugagaaagacagacuggcucccgauggccguugccgcuaugggggugcccccucugccccucuuuauuuucaaucugaaagauacccuuaagcgcagaucuuggccucugaacgagggagugauggcggucggccuggugagcauccucgccuccucucugcuucggaacgacguucccauggcugggccucugguggccggaggccuccugaucgccuguuaugucauuaccgggacaagcgcugaucucaccguggagaaagccgcggacaucacaugggaagaggaagcugagcagacgggaguuucccauaaucugaugauuaccguggacgaugacggcacaaugcgcaucaaggaugacgaaaccgagaacauucuuacaguccugcugaaaaccgcccuccugaucgugagcggcgucuuucccuacucuaucccggccacgcuucugguguggcacaccuggcagaagcagacacaaagauccgggguucucugggaugugccuucucccccugagacccagaaagcugaacuggaggaaggagucuaccggauuaagcagcagggcauccucgggaagacacaagugggaguuggcgugcagaaagagggggucuuccauaccauguggcacgugacacgcggagccgugcugacguauaauggcaagagacuugagcccaacugggcguccguuaaaaaggaccugauuuccuacggcgggggauggcggcugagcgcucaguggcaaaaaggcgaagagguccaggugaucgccguggaaccggggaagaauccuaagaacuuucagaccaugcccggaacauuccagaccaccacaggcgagauuggggccaucgcucucgauuucaaaccuggaacgucuggcucccccauuaucaaucgcgaaggcaaggucguggggcuguauggaaacggcguugugaccaaaaaugggggauacgucagcggcaucgcccaaacaaacgcugagcccgacgggccuaccccggagcuugaagaggaaauguuuaagaaaagaaaucugacaauuauggaucuccaccccggcuccggaaagacccggaaguaucugccugccaucgugcgcgaggcgauuaaaagacggcucagaacgcugauccuugcccccacacgcguuguggcugccgaaauggaggaggcucugaagggccugccuauucgguaccagaccaccgccacaaaaagcgaacauaccgggagagagaucaucgaccucaugugccacgccacauucaccaugcgccugcuuucucccguccgggugccuaacuauaaucugauuaucauggaugaagcucauuuuacggacccggcgagcauugccgcuagaggauacaucuccacacgcguuggcaugggggaggccgccgcuauuuucaugaccgccacacccccuggaaccgcggaugcuuuuccccagucuaacgccccuauccaggacgaggaacgggacauccccgagagaagcuggaacuccggcaacgaauggauuacggauuucgccgggaagaccgugugguuugucccgucuaucaaagcuggcaacgacauugccaauugucuccgcaagaacggaaagaaagugauccaacugagccggaagacauucgauaccgaguaccagaaaacaaagcugaaugacugggauuuuguggucaccacagacauuuccgaaaugggcgcgaacuucaaagccgauagaguuaucgacccucggcgcugccucaagcccgugauucuuaccgaugggcccgagagagugauccuggcuggaccuaugcccgucacggccgcuucugccgcucagcggcgcggcagaguggggcggaauccucagaaggagaacgaccaauauaucuuuacaggacagccgcugaauaacgaugaagaccacgcccauuggaccgaggcgaaaaugcuccuggacaauauuaacacccccgaaggcaucauuccugcccuuuucgagcccgaaagagaaaagagcgcugccaucgauggggaguaccgccugaaaggcgaaucccggaagacauucguugagcucaugagacgcggagaccugccuguguggcuggcucacaaagucgccagcgaaggcauuaaguauaccgaucggaaauggugcuuugacgggcagagaaauaaccagauccucgaggaaaauauggauguggagaucuggacaaaggagggagaaaagaagaaacuucgcccccgguggcuggacgccagaacguacucugauccgcuggcucucaaagaguucaaagacuuugcggccggccgcaaauccauugcucuggaucuuguuaccgaaaucgggagagugccuagccaccuggcccaucggacacgcaacgcccucgacaaucuggucaugcugcacaccucugagcauggaggcagagcuuaucggcacgccguggaggaacuccccgagacaauggaaacccuucugcugcucggccugaugauucuucugacagggggagcgaugcuguuccugaucuccggcaaggggauuggaaagaccagcaucggccugaucugugucauugccuccucugggaugcucuggauggcugagaucccucuucaauggauugccagcgcuaucgugcuggaauuuuucaugaugguucugcucauucccgagccugagaaacagcgcacaccccaggauaaccaacuggccuacguggugaucggcauucuuacccuggcggccaucaucgcugccaaugaaaugggccuccuggagacaaccaagagagaccugggcauguccaaagaaccgggggucguuagcccuacgucuuaucucgauguggaccuucaccccgcuuccgccuggacacuguacgcuguggccaccacagucauuacccccaugcugcggcauaccaucgagaacagcacagcgaacgugucucucgccgcuauugccaaucaggcuguugugcugaugggacuugacaagggcuggccuaucagcaaaauggaucugggggucccgcuccuggcccugggaugcuacucccaggugaacccccucacgcuuaccgccgcgguccugcugcucauuacacacuaugcuaucaucggcccugggcugcaggccaaggcuaccagagaagcccaaaagcgcacagccgcuggaauuaugaaaaaucccaccguggacggcaucaugacgauugaucuugacccuguuaucuacgauucuaaguuugagaaacagcugggccaggugaugcuccugguccugugugccgugcagcuccuucugaugcggacaagcugggcgcugugcgaggcccucacccuggcuaccgggcccauuacaacccuuugggaaggauccccuggcaaguucuggaacacaacgaucgccguuucuauggcuaauaucuuuagagggagcuaucuggccggagcgggccucgccuucuccauuaugaaaagcguggggaccggaaagcgcggcacaggcucucaaggggagacccugggagaaaaguggaaaaagaaacugaaccagcucucccggaaggaguuugaccuuuacaaaaagagcggcaucacagaagucgauagaaccgaggcuaaagaggggcugaagcggggagaaauuacgcaucacgccgugucccgcggcucugcuaagcugcagugguucguggagagaaauaugguuaucccggaagggcgggucauugaccucggauguggccgcggcggguggagcuauuacugcgccggacugaaaaaggugaccgaggugagaggcuauacaaaagggggacccggccaugaggaaccuguccccaugaccacauacggguggaacaucguuaaacuuauguccggaaaagauguguuuuaccugccucccgagaagugugacacccuccugugcgauauuggcgaaucuagcccguccccuacaguggaggaaagccggaccauccgcguccugaagaugguggagcccuggcucaaaaauaaccaguucuguaucaagguucuuaaucccuauaugccuacggugauugagcaccuggaaagacugcaacggaaacacggcgggaugcucguccgcaacccccugucuagaaauuccacacaugagauguacuggaucagcaacggaaccggcaauauuguggcuucuguuaacauggugucccggcuucugcucaacagauucaccaugacacaccgccggccuacgaucgaaaaggacgucgaucugggggccggaaccagacaugugaaugcggagccggaaacacccaacauggacgugauuggcgagcgcaucaaacggaucaaggaggaacacaauagcaccuggcacuaugacgaugagaacccuuacaagacaugggccuaucaugggucuuacgaagucaaagcuaccggaagcgccuccucuaugauuaauggcguugugaagcugcucacaaaacccugggacguggucccuauggugacccagauggcuaugacggauaccacacccuuuggccagcaaagaguuuucaaggagaaaguggacacccgcacaccgcggagcaugccugggaccagacgcgucaugggaaucacggccgaauggcuguggcggacacuuggcagaaacaagaagccccgccugugcacccgggaggaguuuaccaagaaggugagaaccaaugccgcgaugggggcuguuuucacggaagagaaccagugggauuccgccaaagccgcuguggaagacgaggauuuuuggaagcucgucgaccgcgaaagagagcugcacaaacuuggaaaguguggcagcugcguguauaauaugauggggaaacgggagaagaagcugggcgaguucggaaaagccaagggcucccgcgcuauuugguacauguggcucggggccagauaccuggaguuugaagcgcugggauuccucaacgaggaucauugguuuucucgggagaauagcuauuccggcguugaaggggagggacugcacaaacuuggcuacauccugagagacauuucuaagaucccugggggcgccauguaugcugaugacaccgccggaugggacacacggaucaccgaagaugaccuccauaacgaggagaaaaucacacagcagauggaucccgaacaccgccaacuggcuaaugccaucuucaaacuuaccuaccagaacaagguggucaaagugcagagaccuacacccaccggcacggucauggacauuaucagccggaaggaucagcgcggguccggacaagugggcacauaugggcugaauaccuuuaccaacauggaggcgcagcucauuagacagauggaaggagagggcguucugucuaaagccgaccuggaaaacccgcaccucccugagaagaaaaucacacaguggcuggaaaccaaggggguggagcggcuuaagcgcauggcuaucagcggcgaugacugcgucgugaaacccauugaugacagauucgccaaugcucugcucgcccugaacgauaugggaaaggugcggaaagacaucccccaauggcagccuuccaagggcuggcaugauuggcagcagguuccguuuuguagccaccauuuccacgagcuuauuaugaaagacgggcgcaagcuggugguccccugcagaccucaagacgaacucaucggacgggcucgcauuucucagggcuccggguggagccugagagagacagccugucugggaaaggcguacgcccagauguggucucucauguauuuccaccggcgcgaucugagacuugcuuccaaugccaucugcagcgccgugcccguucauugggugccuacgucucggaccacaugguccauucacgcucaucaccaauggaugaccacagaagacaugcugaccgucuggaacagaguguggaucgaggauaaucccuggauggaagacaaaacgccugucaccacaugggagaacgugcccuaccucggcaagcgcgaggaucaguggugugggagccugaucggccuuaccucccgggccacaugggcgcagaauauuccgaccgcuauccagcaaguuagaagccugauuggaaacgaagaguuucucgacuacaugccuucuaugaaacgcuuccggaaggaagaggagagcgaaggcgccaucugguga

SEQ ID NO: 20398 - RNA, 9873 nt, Artificial Sequence
  derived and/or modified CDS sequence (opt5) from DENV-3__JF808119__SS-prME
accagccugugccucaugaugauccugcccacagcucuugcuuuccaccugacgucccgggacggcgagccucggaugauuguggggaagaacgaacgcggaaagucucuccuguuuaagaccgccagcggcaucaauauguguacacuuauugcgauggaucugggggagaugugcgacgauaccgugacauacaaguguccgcauaucaccgaaguugagcccgaagacauugauugcugguguaaccucacauccaccugggugacguauggaaccugcaaucaggcuggcgagcacagacgggacaagcgcucuguggcccuggccccucauguggggaugggacuggauacaagaacccagacauggaugagcgcugagggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccagcuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagaugcucccuguaaaauuccuuucagcacagaggacggccaagggaaggcccauaacggaagacugaucaccgcgaaucccguugugacgaaaaaggaugagcccgucaacauugaagcugagccuccguucggcgaauccaauaucgugauugggaucggcgacaacgcccugaaaaucaauugguauaagaagggaucuagcauuggcaaaauguuugaggccacagcuagaggggcgagacgcauggcuauccuuggagauaccgccugggacuucggcuccgucgggggaguucucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugauauggggugugugaucaauuggaaaggaaaggaacugaagugcggcagcgggauuuucgucacgaacgaggugcauaccuggacagagcaguacaaauuucaagccgacucccccaagcggcuggcgaccgccaucgcuggcgccugggaaaauggaguuuguggcauuagaagcacaacccgcauggagaaccuucucuggaaacagguggcuaaugaacugaacuauauccugugggagaauaacaucaagcucacggucgugguuggggauauuaucggagugcuggaacagggcaaacggacccuuacaccucagcccauggagcugaaguacucuuggaaaaccugggggaaggccaagauugucacagccgagacccaaaacuccagcuucaucauugacggaccuaauacacccgaaugcccgucugcuuccagagcguggaacgugugggagguggaagacuauggcuuuggcgucuucaccacgaauaucuggcucaaacugcgcgagguuuacacacagcugugugaucaccggcuuaugagcgccgcugugaaggacgaaagagccgugcacgccgauaugggguacuggaucgagucccagaaaaacggaucuuggaagcucgagaaagcuagccugauugaagucaagaccugcaccuggccuaagucccauacacuguggucuaauggcgugcucgagagcgacaugaucauucccaaaucccuggccgggccuaucagccagcacaaccaucgccccggauaucacacccaaacggcgggcccuuggcaccuugggaagcuggaacucgauuuuaauuacugcgagggaacaaccguugugauuacagagaacuguggcacccggggccccucucugagaacaaccacggucuccgggaaacugauccaugaauggugcugucgcagcugcacccuuccgccucuccgguauaugggagaggacggcuguugguacgggauggaaaucagacccauuucugagaaggaagagaauauggugaaaucccugguuagcgcuggaucuggcaagguggauaacuucacaauggggguccugugccucgccauccuguuugaggaagugaugcggggaaaguucggcaaaaagcacaugauugccggcguuuucuuuauguucgugcuucugcucagcgggcagaucaccuggcgcgacauggcucauacacugauuaugaucggauccaaugccagcgauagaaugggcaugggggucaccuaucuggcgcuuauugcuacguuuaaaauccagcccuuccuggcccucggauuuuuccugcggaagcucacaucuagagagaaccugcuucugggcguggggcucgccauggcuaccacacugcaacugccugaagacaucgagcagauggccaauggaauugcucuuggccugauggcccucaaacugaucacccaguuugaaaccuaccagcucuggacagcgcugauuucccuuacguguagcaacaccauguucacacugaccguggccuggcgcacagcuacccucauccuggccggcgucucccugcuuccgguuugccaaucuagcuccaugcggaagacggauuggcugcccauggcuguggccgccaugggggugccuccccucccucuguuuauuuucucucucaaggacacacugaaaagacgcagcuggccccuuaaugagggagucauggcugugggccugguuuccauccuggcgucuagccuccugagaaacgaugugccuauggccgggccccuugucgcuggaggccugcucaucgccuguuaugugauuaccgggaccuccgccgaccugacaguugagaaggcugccgacaucaccugggaagaggaagcggagcagacaggagugagccacaaccucaugauuacggucgaugacgauggcaccaugcggaucaaagacgaugaaacagagaauauucugaccgugcuucugaagacagcucugcucaucgucucuggcguguuuccguacuccaucccugccacccugcuuguuuggcauacguggcagaaacagacccaacgcagcggggugcugugggacguccccucuccucccgagacacagaaggccgaacucgaggaaggaguguacagaauuaaacagcagggcaucuucgggaagacccaaguuggagugggcguccagaaggaggggguguuucacacaauguggcacgugacccggggagcuguucugacauauaacggcaaacgccucgagccgaauugggccuccgucaagaaagaucugauuagcuacggcgggggauggagacuuucugcgcaguggcaaaagggcgaagagguccaggugaucgcugucgaaccugggaaaaaccccaagaauuuccagacgaugccuggaaccuuccagacaaccaccggcgagauuggggccaucgcccuggacuuuaagcccggaacauccggcagccccauuaucaaccgggaaggcaaagugguugggcuguauggaaauggcguggucacgaagaacgggggauacguguccggcaucgcucaaaccaaugccgagccugaugggccgacacccgagcucgaagaggaaauguucaaaaagcgcaaccugaccauuauggaccuucauccuggcagcggaaaaacaagaaaguaucugcccgcuaucguucgggaggccauuaagcgcagacuccggacccugauccucgcgccuacgagaguggucgccgcugaaauggaggaggcccugaaaggccuucccauucgcuaccagacaaccgcuaccaagucugaacacacagggcgggagaucguggaucugaugugccaugccaccuuuacaaugagacugcucagcccuguucgcgugccgaauuauaaccugaucauuauggacgaagcccacuucaccgaucccgcuuccaucgcggcccggggauacauuucuacgagagucggcaugggggaggcugccgccaucuuuaugacagcuaccccucccggaacagccgacgcguucccucagagcaaugcucccauucaggacgaggaacgcgauaucccggagcgguccuggaacucuggcaaugaauggaucaccgacuuugccgggaaaacggugugguucgugccuagcauuaaggccggcaacgauaucgcuaacugucuucgcaaaaauggaaagaaggucauucaacuguccagaaaaaccuuugacacagaguaccagaagaccaaacucaacgauugggacuucguugugacaaccgauaucucugaaaugggcgccaauuuuaaggcggaccgggugauugaucccagacggugccugaaacccgucauccugacagacgggccugagcgcgugauucucgccggacccaugccuguuaccgcugccagcgcugcccagagacggggccgcguggggagaaacccgcagaaggagaaugaucaauauaucuucacgggacagccccuuaacaaugacgaagaccaugcucacuggacagaggccaagaugcugcuggauaacaucaauaccccugaaggcauuauccccgcccucuucgagccugaacgggagaaauccgccgcuauugacggggaguacagacugaagggcgaaagccgcaaaaccuuugucgagcuuaugcggagaggagaucugcccguguggcucgcccacaagguugcuucugaaggcaucaaauauacagaccgcaaguggugcuucgaugggcagcggaacaaucagauucuggaggaaaacauggacguggagaucuggaccaaagagggagaaaagaagaaacugagaccgcgcuggcucgaugcccggacauacuccgacccucuugcccugaaggaguuuaaagauuucgcugcgggcagaaagagcaucgcccuggaccucgucacggaaauugggcgcgugcccucucaucuggcucacagaacccggaaugcccuugauaaccuggucaugcuccauacauccgagcacggaggccgcgccuauagacacgcuguggaagaacugccugagaccauggaaacacugcuccuucugggccugaugauccuccugaccgggggagccaugcuuuuucugauuagcggcaaagggaucggaaagacguccauuggccucaucuguguuaucgcgucuagcgggaugcuguggauggccgagauuccccugcaauggaucgcuuccgccauugugcucgaguucuuuaugauggugcuucugaucccugagcccgagaagcagcggaccccgcaggacaaucaacuggcuuacgucguuauuggaauccucacacuggccgcgauuaucgccgcuaacgaaaugggccuucuggagaccacaaaacgcgaucucggcaugagcaaggaaccugggguggugucucccaccuccuaucuggacgucgaccugcaucccgccagcgcuuggacgcucuacgccguggcuacaaccguuaucacaccuaugcuuagacacaccauugaaaauucuaccgccaacgugagccuggcggccaucgcuaaccaggccgucgugcugaugggacucgauaaaggcuggccgauuuccaagauggaccugggggucccccuucuggcucucggaugcuacucucaggugaauccucugacacugacggccgccguucuccuucugaucacccauuaugcgauuaucggccccgggcugcaggcuaaagccacacgggaagcucaaaagagaaccgccgccggaaucaugaagaacccuacaguggauggcauuaugaccaucgaccucgaucccgucauuuacgacagcaaauucgagaagcagcugggccaggugaugcuucugguucucugugcugugcagcugcugcucaugcgcacguccugggcccuuugcgaggcgcugacacuggccaccgggccuaucaccacacucugggaaggaucuccgggcaaauuuuggaauaccacaauugcugucagcauggccaacaucuuccggggguccuaucuggcuggagccggccuugcguuuagcaucaugaagucuguggggacgggaaaaagaggcaccggcucccaaggggagacacugggagaaaaguggaagaaaaagcucaaucagcugagccgcaaagaguucgaucuguacaagaaauccggcauuaccgaaguggaccggacagaggccaaggaggggcucaaaagaggagaaaccacgcaccaugcuguuucucggggcagcgccaaacuucagugguuugucgagcgcaacauggugauccccgaagggagagugauugaucugggauguggccggggcgggugguccuauuacugcgcuggacugaagaaagucaccgagguucgcggcuauacaaaagggggaccuggccacgaggaacccgugccuaugucuaccuacggguggaauaucauuaaacucaugagcggaaaggacguguucuaccugcccccggagaaaugugauacacuucugugcgacaucggcgaauccagcccuucucccaccgucgaggaauccagaacaauucgggugcucaagaugguugagcccuggcugaagaacaaucaguucuguaucaaaauccugaacccuuauaugcccaccgugauugagcaccucgaacgccuucaaagaaagcauggcgggaugcugguccggaauccucugagccgcaacucuacgcacgagauguacuggaucuccaauggaacaggcaacauuguggccagcguuaauauggugucuagacuccugcuuaaccgguuuaccaugacccauagacgcccgacaaucgaaaaagaugucgaccugggggcuggaacgcggcacgugaacgccgagcccgaaaccccuaauauggacgugauuggcgagagaaucaagcgcaucaaagaggaacacaacagcacauggcauuaugaugacgagaaucccuacaagaccugggcguaucacggguccuacgaagucaaggccacaggaucugcuagcuccaugauuaacggcguugugaaacuccugaccaagccuugggaugugguccccauggugacacagauggccaugaccgacacgaccccguucggccagcaacggguuuuuaaagagaagguggauacaagaaccccucgcagcaugcccgggacacggagagucaugggaaucaccgcugaauggcuguggcgcacgcucggccggaauaaaaagccuagacugugcacacgcgaggaguucaccaagaaagugcggacaaacgccgccaugggggcgguuuuuaccgaagagaaucagugggacuccgcuaaggccgccguggaagaugaggacuucuggaaacuugucgauagagaacgcgagcugcauaagcucggaaaauguggcucuugcguguauaacaugauggggaagagagagaaaaagcugggcgaauuuggaaaggcuaaaggcagccgggccauuugguacauguggcuuggggcucgcuaccuggaguucgaagcccucggauuucugaaugaggaccacugguucuccagagagaacucuuauagcggcguugaaggggagggacugcauaagcucggcuacauccugcgggauauuuccaaaauccccgggggcgcgauguaugccgacgacacggcuggaugggauaccagaaucacagaagacgaucuucacaaugaggaaaagauuacccagcagauggacccugagcaccggcaacuggccaacgcuaucuuuaaacucacauaccagaauaagguggucaaggugcagcgccccaccccgacaggcaccgucauggauauuaucucuagaaaagaccagcgggggagcggacaagugggcacguaugggcugaacacauucaccaauauggaggcccagcuuauucgccagauggaaggagagggcguucuguccaaggcggaucucgaaaacccucaucugcccgagaaaaagaucacccaguggcuggaaacaaaagggguggagagacucaagcggauggccaucagcggcgaggacugcguccugaagcccauugaugaccgcuuugauaacgcccuucuggcccucaaugacaugggaaaagugagaaaggauaucccucaauggcagccgucuaaaggcuggcacgacuggcaacaggugcccuucuguucccaucacuuccacgaacugauuaugaaggacgggcggaaacuuguugugccuugccgcccccaagaugagcugaucggacgggcucggauuagccagggcgccggguggucucuccgcgaaaccgcuugucugggaaaggccuacgcgcagauguggucccugauguauuuucauagacgggaccuccgccuggccagcaacgcuaucugcucugccgucccugugcacuggguucccacauccagaacgaccuggagcauucaugcccuucaccaauggaugacaaccgaggauaugaucacaguguggaaucgggucuggaucgaagacaacccuuggauggaggauaagacccccgugacgaccugggaggacgucccguaccugggcaaaagagaagaucaguggugugggucccucauuggccugacaagccgcgcuaccugggcccagaauaucccuacagcgauucagcaagugcggucucuuaucggaaacgaggaguuccuggacuacaugcccagcaugaagagauuucgcaaagaggaggaauccgagggcgcuauuugguga

SEQ ID NO: 20399 - RNA, 9873 nt, Artificial Sequence
  derived and/or modified CDS sequence (opt5) from DENV-3__JF808118__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccauccuuagaaaacuguguauugagggaaagaucaccaacauuacaaccgauucccggugcccuacgcagggcgaagcggugcucccggaggaacaggaccagaauuauguguguaaacacacauacgucgaucgcggcugggggaacggaugcggccuguucgggaagggaagccuugugaccugcgccaaguuucaaugucuggagcccaucgagggcaaaguugugcaguaugaaaaucucaaguacaccgucaucauuacagugcacaccggggaccagcaucagguuggaaacgagacacaaggcgugacggcugaaaucaccccucaggccucuacaaccgaggcuauucugcccgaauauggcacacuggggcucgagugcuccccuagaaccggacuggacuucaaugagaugauccuucugacgaugaaaaacaaggccuggaugguccaccggcagugguuuuucgaucucccccugccguggaccagcggcgccacaaccgaaacaccuaccuggaaucgcaaagagcuucuggugacguuuaagaacgcucaugcgaaaaagcaagaagucgugguucucgggucucaggagggagccaugcacacagcucugaccggcgccacagaaauucagaauuccgggggcaccagcaucuucgccggacaccugaaguguagacucaaaauggacaagcuggagcuuaaaggcaugucuuacgcuaugugcaccaacacauuugugcugaagaaagaggucuccgaaacgcagcaugggaccauccucauuaagguggaguacaagggagaagaugcccccuguaaaaucccuuucagcacagaggacggccaagggaaggcgcacaacggacggcugauuaccgcuaaucccguugugacaaaaaaggaggaacccgucaacaucgaggccgaaccuccguucggcgaguccaauauugugaucgggaucggcgauaacgcccugaaaauuaauugguauaagaagggaucuagcaucggcaaaauguuugaagcuaccgccagaggggcucgccggauggccauucuuggagacacggcgugggauuucggcuccguggggggaguucucaacagccugggcaagaugguccaucagaucuuugggucugccuacacagcucuguucuccggcgugagcugggugaugaaaauuggaaucggcguccuccugaccuggauugggcuuaauucuaagaacaccagcauguccuuuucuugcaucgccaucggaauuaucacacuguaucucggcgcugugguucaggccgacauggggugugugauuaauuggaaaggaaaggagcugaagugcggcagcgggaucuucgucaccaacgaggugcacacauggacggaacaguacaaauuucaagcggauucccccaagagacuggccaccgcuauugccggcgcuugggagaauggaguuuguggcauccgcagcacaacccggauggaaaaccuucucuggaaacagaucgccaaugagcugaacuauauucugugggaaaauaacaucaagcucacaguggucgugggggacauuaucggaguucuggagcagggcaaaagaacccuuacgccucagcccauggagcugaaguacucuuggaaaaccugggggaaggccaagauugugacagcugaaacccaaaacuccagcuucaucaucgauggaccuaauacacccgagugcccgucugcgucccgcgccuggaacgucugggaaguggaggacuauggcuuuggcguguucaccacaaauauuuggcucaaacugcgggaagucuacacccagcugugugaccauagacuuaugagcgcugccguuaaggaugagcgcgccgugcacgcugacaugggguacuggaucgagucccagaaaaacggaucuuggaagcucgaaaaagccagccugauugaggugaagacgugcacauggccuaagucccacacccuguggucuaauggcguccucgaaagcgauaugaucauucccaaaucccuggcggggccuaucagccagcauaaccaccggcccggauaucauacccaaacagcuggcccuuggcaccuugggaagcuggagcucgacuuuaauuacugcgagggaaccacggugguuaucacagaaaacuguggcaccagaggccccucucugcgcacaaccacaguguccgggaaacugauucacgaguggugcugucggagcugcacccuuccgccucucagauauaugggagaagauggcuguugguacgggauggagauccggcccauuucugaaaaggaggagaauauggucaaaucccuggugagcgccggaucuggcaagguugacaacuucacgaugggggugcugugccucgccauccuguuugaagaggucaugcgcggaaaguucggcaaaaagcauaugauugcuggcguguucuuuaccuucguucuucugcucagcgggcagaucacauggagagauauggcccacacccugauuaugaucggauccaaugcgagcgaccggaugggcaugggggugacauaucuggcucuuaucgccaccuuuaaaauucagcccuuccuggcccucggauuuuuccugagaaagcucacgucucgcgaaaaccugcuucugggcgucgggcucgcuauggccacaacccugcaacugccugaggauaucgaacagauggcuaauggaauugcccuuggccugauggcgcucaaacugaucacacaguuugagaccuaccagcucuggaccgcccugauuucccuuacauguagcaacacgauguucacccugacaguggcuuggcggaccgccacacucauccuggcuggcgugucccugcuuccggucugccaaucuagcuccaugagaaagaccgacuggcugcccauggccguugccgcuaugggggugccuccccucccucuguuuaucuucucucucaaggauacgcugaaacgcagaagcuggccccuuaaugagggagugauggcggucggccugguguccauucuggccucuagccuccugcggaacgacguuccuauggcugggccccuuguggccggaggccugcucaucgccuguuaugucauuacagggaccuccgcugaucugaccguggaaaaggccgcggacaucacaugggaggaagaggcugaacagaccggaguuagccauaaccucaugauuacaguggacgaugacggcacgaugcgcaucaaagaugacgagaccgagaauauccugacaguccuucugaagaccgcccugcucauugugucuggcgucuuuccguacuccaucccugccacacugcuuguguggcacaccuggcagaaacagacgcaaagaagcgggguucugugggaugugcccucuccucccgaaacccagaaggcugagcucgaagagggagucuaccggauuaaacagcagggcaucuucgggaagacacaagugggaguuggcgugcagaaggagggggucuuucauaccauguggcacgugacacgcggagccgugcugaccuauaacggcaaaagacucgaaccgaauugggcguccguuaagaaagaccugauuagcuacggcgggggauggcggcuuucugcucaguggcaaaagggcgaggaaguccaggugaucgccguggagccugggaaaaaccccaagaauuuccagacaaugccuggaacguuccagaccacaaccggcgaaauuggggccaucgcucuggauuuuaagcccggaaccuccggcagccccaucauuaaccgcgagggcaaagucguggggcuguauggaaauggcguugugacaaagaacgggggauacgucuccggcaucgcccaaacgaaugcugagccugacgggccgacccccgaacucgaggaagagauguucaaaaagagaaaccugacaauuauggaucuucacccuggcagcggaaaaacccggaaguaucugcccgccaucgugcgcgaagcgauuaagagacggcucagaacacugauccucgccccuacccgcguuguggcugccgagauggaggaagcucugaaaggccuucccauccgguaccagacgacagccaccaagucugagcauaccgggagagaaauugucgaccugaugugccacgccacauuuaccaugcgccugcucagcccugugcggguuccgaauuauaaccugaucauuauggaugaggcucauuucacagaccccgcguccaucgccgcuagaggauacauuucuacccgcgugggcaugggggaagccgccgcuaucuuuaugacggccacaccucccggaaccgcggaugcuuucccucagagcaaugcccccauccaggacgaggagcgggacauuccggaaagauccuggaacucuggcaaugaguggaucacagauuuugccgggaaaaccgucugguucgugccuagcauuaaggcuggcaacgacaucgccaacugucuucgcaaaaauggaaagaaggugauucaacugucccggaaaacguuugauaccgaauaccagaagacaaaacucaacgacugggauuucgucguuaccacagacaucucugagaugggcgcgaauuuuaaggccgauagagugauugacccccggcgcugccugaaacccgugauccugaccgaugggccugagagagucauccucgcuggacccaugccugugacagccgcuagcgccgcucagcggcgcggcagaguugggcggaacccgcagaaggaaaaugaccaauauauuuucaccggacagccccuuaacaaugaugaggaccacgcccauuggacggaagcgaagaugcugcuggacaacaucaauacaccugagggcauuauccccgcccucuucgaaccugagagagagaaauccgcugccauugauggggaauaccgccugaagggcgagagccggaaaaccuuuguggaacuuaugagacgcggagaccugcccgucuggcucgcucacaagguggccucugagggcaucaaauauaccgaucggaaguggugcuucgacgggcagagaaacaaucagauccuggaagagaacauggauguugagauuuggacaaaagaaggagagaagaagaaacugcgcccgcgguggcucgacgccagaaccuacuccgauccucuugcucugaaggaauuuaaagacuucgcggccggccgcaagagcaucgcucuggaucucgugacagagauugggagaguccccucucaccuggcccaucggacgcgcaaugcccuugacaaccuggugaugcuccacaccuccgaacauggaggcagagcuuaucggcacgccgucgaggagcugccugaaacaauggagacccugcuccuucugggccugaugauccuccugacagggggagcgaugcuuuuucugauuagcggcaaagggaucggaaagaccuccaucggccucauuugugugaucgccucuagcgggaugcuguggauggcugaaauuccccugcaauggaucgccuccgcuauuguucucgaguucuuuaugauggugcuucugaucccugagcccgaaaagcagcgcacgccgcaggauaaucaacuggccuacguggucauuggaauccucacccuggcggccaucauugcugccaacgagaugggccuucuggaaacaaccaaaagagaccucggcaugagcaaggagccugggguugugucucccacauccuaucuggauguggaccugcaccccgcuagcgccuggacccucuacgcugucgccacgacagugaucaccccuaugcuucggcauacaauugaaaauucuaccgcgaacguuagccuggccgcuaucgccaaccaggcugugguccugaugggacucgacaaaggcuggccgauuuccaagauggaucugggggugccccuucuggcccucggaugcuacucucaggucaauccucugacccugacagccgcggugcuccuucugaucacgcacuaugcuaucauuggccccgggcugcaggccaaagcuaccagagaggcccaaaagcgcacagccgcuggaaucaugaagaacccuaccguugacggcauuaugacaaucgaucucgaccccgugauuuacgauagcaaauucgagaagcagcugggccaggucaugcuucuggugcucugugccguucagcugcugcucaugcggaccuccugggcgcuuugcgaagcccugacgcuggcuacagggccuaucaccacccucugggagggaucuccgggcaaauuuuggaauacaaccaucgccgugagcauggcuaacauuuucagaggguccuaucuggccggagcgggccuugccuuuagcaucaugaagucugucgggacaggaaaacgcggcacgggcucccaaggggaaacccugggagagaaguggaagaaaaagcucaaucagcugagccggaaagaauucgaccuguacaagaaauccggcauuacagagguggauagaaccgaggcuaaggaagggcucaaacggggagagacaacccaucacgccgugucucgcggcagcgcuaagcuucagugguuuguugaaagaaacauggucauccccgaggggcgggugauugaccugggauguggccgcggcgggugguccuauuacugcgccggacugaagaaagugacggaagucagaggcuauaccaaggggggaccuggccaugaggagcccguuccuaugucuacauacggguggaauaucgugaaacucaugagcggaaaggauguguucuaccugcccccggaaaaaugugacacccuucugugcgauauuggcgaguccagcccuucucccacagucgaagagucccggaccauccgcgugcucaagaugguugagcccuggcugaagaacaaucaguucuguaucaaagugcugaacccuuauaugcccacagucauugaacaccucgagagacuucaacggaagcacggcgggaugcuggugcgcaauccucugagcagaaacucuacccaugaaauguacuggaucuccaauggaacgggcaacauuguugcuagcgugaauauggucucucggcuccugcuuaacagauuuacaaugacccaccgccggccgaccaucgagaaagacguggaucugggggccggaacaagacaugugaacgcggaacccgagacgccuaauauggacgucauuggcgagcgcaucaagcggaucaaagaagagcacaacagcaccuggcacuaugacgaugaaaaucccuacaagacaugggccuaucauggguccuacgagguuaaggcuaccggaucugccagcuccaugauuaacggcguggugaaacuccugacaaagccuugggacgucgugcccaugguuacccagauggcuaugacagauaccacgccguucggccagcaaagaguguuuaaagaaaaggucgacacccgcacaccucggagcaugcccgggaccagacgcgugaugggaaucacagccgaguggcuguggcggacccucggcagaaauaaaaagccucgccugugcacgcgggaggaauucacaaagaaaguuagaaccaacgccgcgaugggggcuguguuuacagaggaaaaucagugggauuccgccaaggccgcugucgaggacgaagauuucuggaaacuuguggaccgcgagagagagcugcacaagcucggaaaauguggcucuugcguuuauaacaugauggggaagcgggaaaaaaagcugggcgaguuuggaaaggccaaaggcagccgcgcuauuugguacauguggcuuggggccagauaccuggaauucgaggcgcucggauuucugaaugaggaucauugguucucccgggaaaacucuuauagcggcguggagggggaaggacugcacaagcucggcuacauccugagagacauuuccaaaauccccgggggcgccauguaugcugaugacaccgccggaugggacacgcggaucaccgaggaugaccuucauaaugaagagaagauuacacagcagauggauccugagcaccgccaacuggcuaacgccaucuuuaaacucaccuaccagaauaaggucgugaagguccagagacccacaccgaccggcacagugauggacauuaucucucggaaagaucagcgcgggagcggacaaguuggcaccuaugggcugaacacguucacaaauauggaagcgcagcuuauuagacagauggagggagaaggcgugcuguccaaggccgaccucgagaacccucaccugcccgaaaaaaagaucacccaguggcuggagaccaaaggggucgagcggcucaagcgcauggcuaucagcggcgaugacugcguggugaagcccauugaugacagauuugccaacgcucugcuugcccugaaugauaugggaaaaguucggaaggacaucccucaauggcagccgucuaaaggcuggcaugauuggcagcaggugcccuucuguucccaccauuuccacgaacucauuaugaaggacgggcgcaaacuggucgugccuugcagaccccaagacgagcuuaucggacgggcucgcauuagccagggcgccggguggucucugagagaaacagcgugucucggaaaggccuacgcucagauguggucccugauguauuuucaccggcgcgaucugagacucgccagcaacgccaucugcucugcuguuccugugcauuggguccccaccucccggacaacguggagcauucacgcccaucaccaauggaugaccacagaggacaugcugaccguguggaauagagucuggaucgaagauaacccuuggauggaggacaagacacccgugaccacgugggagaauguuccguaccuuggcaaacgcgaagaucaguggugugggucccugaucggccucaccagccgggcgacaugggcucagaacauuccuaccgccauccagcaagugagaucucugauuggaaaugaggaauuccuugacuacaugcccagcaugaagcgcuuucggaaagaggaggaauccgagggcgccaucugguga

SEQ ID NO: 20400 - RNA, 9873 nt, Artificial Sequence
  derived and/or modified CDS sequence (opt5) from DENV-3__JF808127__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucucucacaaugcgguguguuggagugggcaaccgcgacuuugucgaagggcugagcggagcuaccuggguggaugugguccuggagcauggcgggugcguuaccacaauggccaagaauaaacccacgcucgacauugagcugcagaagaccgaagcuacacaacuugccacccugagaaaacucuguaucgagggaaagauuacaaacaucaccacggauucccggugcccuacacagggcgaagcggugcugccggaggaacaggaccagaauuauguguguaaacacaccuacgucgaucgcggcugggggaacggaugcggccuuuucgggaagggaagccuggugaccugcgccaaguuucaaugucucgagcccauugagggcaaaguugugcaguaugaaaaucugaaguacacagucaucaucaccgugcacacaggggaccagcaucagguuggaaacgagacgcaaggcgugaccgcugaaauuacaccucaggccucuaccacagaggcuauccugcccgaauauggcacccucgggcuggagugcuccccuagaacgggacuugacuucaaugagaugauucugcucaccaugaaaaacaaggccuggaugguccaccggcagugguuuuucgaucugccccuuccguggacaagcggcgccaccacagaaaccccuacguggaaucgcaaagagcugcucgugacauuuaagaacgcucaugcgaaaaagcaagaagucgugguucuggggucucaggagggagccaugcacaccgcucugacaggcgccaccgaaauccagaauuccgggggcaccagcauuuucgccggacaccucaaguguagacugaaaauggacaagcuugagcugaaaggcaugucuuacgcuaugugcacaaacacguuugugcucaagaaagaggucuccgaaacccagcaugggacaauccugaucaagguggaguacaagggagaagaugcccccuguaaaauuccuuucagcaccgaggacggccaagggaaggcgcacaacggacggcugaucacagcuaaucccguugugaccaaaaaggaggaacccgucaacauugaggccgaaccuccguucggcgaguccaauaucgugauugggacgggcgauaacgcccuuaaaaucaauugguauaagaagggaucuagcaucggcaaaauguuugaagcuacagccagaggggcucgccggauggccauucucggagacaccgcgugggauuucggcuccguggggggaguucugaacagccugggcaagaugguccaucagaucuuugggucugccuacaccgcucucuucuccggcgugagcugggugaugaaaauuggaaucggcguccugcuuacauggauugggcugaauucuaagaacaccagcauguccuuuucuugcaucgccauuggaaucaucacacucuaucugggcgcugugguucaggccgacauggggugugugauuaauuggaaaggaaaggagcugaagugcggcagcgggaucuucgucacgaacgaggugcacaccuggacagaacaguacaaauuucaagcggauucccccaagagacuugccaccgcuauugccggcgcuugggagaauggaguuuguggcauccgcagcacaacccggauggaaaaccuccuguggaaacagauugccaaugagcugaacuauauccucugggaaaauaacaucaagcugacgguggucgugggggacauuaucggaguucuugagcagggcaaaagaacccugacaccucagcccauggagcucaaguacucuuggaaaaccugggggaaggccaagauugugacagcugaaacccaaaacuccagcuucaucauugauggaccuaauacacccgagugcccgucugcgucccgcgccuggaacgucugggaaguggaggacuauggcuuuggcguguucaccacgaauaucuggcugaaacugcgggaagucuacacacagcuuugugaccauagacucaugagcgcugccguuaaggaugagcgcgccgugcacgcugacaugggguacuggaucgagucccagaaaaacggaucuuggaagcuggaaaaagccagccugauugaggugaagaccugcaccuggccuaagucccacacacucuggucuaauggcguccuggaaagcgauaugaucauucccaaaucccuugcggggccuaucagccagcauaaccaccggcccggauaucauacccaaacggcuggcccuuggcaccuggggaagcucgagcuggacuuuaauuacugcgagggaacaaccgugguuauuacagaaaacuguggcaccagaggccccucucugcgcacaaccacgguguccgggaaacuuauccacgaguggugcugucggagcugcacccucccgccucugagauauaugggagaagauggcuguugguacgggauggagauccggcccauuucugaaaaggaggagaauauggucaaaucccuggugagcgccggaucuggcaagguugacaacuucacaaugggggugcucugccuggccauccuuuuugaagaggucaugcgcggaaaguucggcaaaaagcauaugauugcuggcguguucuuuaccuucguucugcuccugagcgggcagaucacauggagagauauggcccacacccugauuaugaucggauccaaugcgagcgaccggaugggcaugggggugacguaucuugcucugauugccacauuuaaaauccagcccuuccucgcccugggauuuuuccucagaaagcugaccucucgcgaaaaccuucugcucggcgucgggcuggcuauggccacaacccugcaacuuccugaggauaucgaacagauggcuaauggaauugcccugggccucauggcgcugaaacucaucacccaguuugagacauaccagcuguggacggcccuuauuucccugaccuguagcaacacaauguucacccucacaguggcuuggcggaccgccacgcugauccuggcuggcgugucccuucugccggucugccaaucuagcuccaugagaaagacagacuggcuccccauggccguugccgcuaugggggugccuccccugccucucuuuauuuucucucugaaggauacccuuaaacgcagaagcuggccccugaaugagggagugauggcggucggccugguguccauccucgccucuagccugcuucggaacgacguuccuauggcugggccccugguggccggaggccuccugaucgccuguuaugucauuaccgggacauccgcugaucucaccguggaaaaggccgcggacaucacaugggaggaagaggcugaacagacgggaguuagccauaaccugaugauuaccguggacgaugacggcacaaugcgcaucaaagaugacgagaccgagaauauucuuacaguccugcugaagaccgcccuccugaucgugucuggcgucuuuccguacuccaucccugccacgcuucugguguggcacaccuggcagaaacagacacaaagaagcgggguucucugggaugugcccucuccucccgaaacccagaaggcugagcuggaagagggagucuaccggauuaaacagcagggcaucuucgggaagacacaagugggaguuggcgugcagaaggagggggucuuucauaccauguggcacgugacacgcggagccgugcucacguauaacggcaaaagacuggaaccgaauugggcguccguuaagaaagaccuuauuagcuacggcgggggauggcggcugucugcucaguggcaaaagggcgaggaaguccaggugaucgccguggagccugggaaaaaccccaagaauuuccagaccaugccuggaacauuccagaccaccacaggcgaaauuggggccaucgcucuggauuuuaagcccggaacguccggcagccccauuaucaaccgcgagggcaaagucguggggcucuauggaaauggcguugugaccaagaacgggggauacgucuccggcaucgcccaaacaaaugcugagccugacgggccgacccccgaacuggaggaagagauguucaaaaagagaaaccuuacaauuauggaucugcacccuggcagcggaaaaacccggaaguaucuccccgccaucgugcgcgaagcgauuaagagacggcugagaacgcucauccuggccccuacacgcguuguggcugccgagauggaggaagcucuuaaaggccugcccauucgguaccagaccaccgccacaaagucugagcauaccgggagagaaaucgucgaccugaugugccacgccacauuuaccaugcgccuccugagcccugugcggguuccgaauuauaaccuuaucauuauggaugaggcucauuucacggaccccgcguccaucgccgcuagaggauacauuucuacacgcgugggcaugggggaagccgccgcuaucuuuaugaccgccacaccucccggaaccgcggaugcuuucccucagagcaaugcccccauucaggacgaggagcgggacaucccggaaagauccuggaacucuggcaaugaguggaucacggauuuugccgggaaaaccgucugguucgugccuagcauuaaggcuggcaacgacaucgccaacugucugcgcaaaaauggaaagaaggugauucaacucucccggaaaacauuugauaccgaauaccagaagacaaaacugaacgacugggauuucgucguuaccacagacaucucugagaugggcgcgaauuuuaaggccgauagagugauugacccccggcgcugccugaaacccgugauccucaccgaugggccugagagagucauucuugcugaacccaugccugugacggccgcuagcgccgcucagcggcgcggaagaguuggccggaacccgcagaaggagaaugaccaauauaucuucacagggcagccccugaacaaugaugaagaccacgcccauuggaccgaggcgaagaugcugcucgacaacaucaauaccccugaaggaauuauccccgcccuguucgagccugagagagaaaaauccgcugccauugauggcgaguaccgccuuaagggggaaagccggaaaacauuuguggagcugaugagacgcggcgaccuccccgucuggcuggcucacaagguggccucugaaggaaucaaauauaccgaucggaaguggugcuucgacggccagagaaacaaucagauucuggaggagaacauggauguugaaaucuggacaaaagagggggaaaagaagaaacuccgcccgcgguggcuugacgccagaacguacuccgauccucuggcucugaaggaguuuaaagacuucgcggccggacgcaagagcaucgcucucgaucuggugaccgaaauuggcagaguccccucucaccuugcccaucggacacgcaaugcccuggacaaccucgugaugcugcacaccuccgagcaugggggaagagcuuaucggcacgccgucgaggaacugccugagacaauggaaacccuccuucugcugggccucaugauccugcuuacgggcggggcgaugcuguuucucauuagcggaaaaggcaucgggaagaccuccauuggacugaucugugugaucgccucuagcggcaugcuguggauggcugagauuccccuccaauggaucgccuccgcuauuguucuugaguucuuuaugauggugcugcugaucccugaacccgagaagcagcgcacaccgcaggauaaucaacucgccuacguggucauugggauccugacccuugcggccauuaucgcugccaacgaaaugggacugcucgagacaaccaaaagagaccugggcaugagcaaggaaccuggcguugugucucccacguccuaucuggauguggaccuccaccccgcuagcgccuggacacuuuacgcugucgccaccacagugaucaccccuaugcugcggcauaccauugagaauucuacagcgaacguuagccuggccgcuaucgccaaccaggcugugguccucauggggcuggacaaaggauggccgauuuccaagauggaucuuggcgugccccugcucgcccuggggugcuacucucaggucaauccucugacgcucaccgccgcggugcuucugcugaucacacacuaugcuauuaucggacccggccuccaggccaaagcuaccagagaggcccaaaagcgcacagccgcugggaucaugaagaacccuaccguugacggaauuaugacgaucgaucuggaccccgugauuuacgauagcaaauucgaaaagcagcuuggccaggucaugcugcucgugcugugugccguucagcugcuccuuaugcggacauccugggcgcugugcgaggcccugacccucgcuaccggcccuaucacaacccugugggaagggucuccgggaaaauuuuggaauacaacgauugccgugagcauggcuaacaucuucagaggcuccuaucuugccggggcgggacuggccuuuagcaucaugaagucugucggcaccgggaaacgcggaacaggcucccaaggcgagacccucggggaaaaguggaagaaaaagcugaaucagcugagccggaaagaguucgaccucaacaagaaauccggaauuacagagguggauagaaccgaagcuaaggagggccuuaaacggggggaaaucacgcaucacgccgugucucgcggaagcgcuaagcugcagugguuuguugagagaaauauggucauucccgaaggccgggugaucgaccugggguguggacgcggcggcugguccuacuauugcgccgggcucaagaaagugaccgaggucagaggauacacaaagggcgggccuggacaugaggaacccguuccuaugucuaccuauggcuggaacauugugaaacugaugagcgggaaggauguguucuaccuucccccggagaaaugugacacacugcucugcgauaucggagaauccagcccuucucccaccgucgaggagucccggacaauucgcgugcugaagaugguugaacccuggcugaagaauaaccaguucuguaucaaagugcucaauccuuacaugcccaccgucaucgagcaccuugaaagacugcaacggaagcacggcggcaugcuggugcgcaacccucucagcagaaauucuacgcaugagauguauuggauuuccaacgggacaggaaauaucguugcuagcgugaaaauggucucucggcugcuucugaacagauuuaccaugacccaccgccggccgacaauugaaaaggacguggaucucggcgccgggacgagacaugugaacgcggagcccgagaccccuaauauggacgucaucggagaacgcauuaaacggaucaaggaggaacacaacagcacauggcacuacgacgaugagaaucccuauaagaccugggccuaccauggcuccuaugaaguuaaagcuacagggucugccagcuccaugaucaacggaguggugaagcugcugaccaaaccuugggacgucgugcccaugguuacacagauggcuaugaccgauacgaccccguucggccagcaaagaguguuuaaggagaaagucgacacacgcaccccucggagcaugcccggcacaagacgcgugauggggauuaccgccgaguggcucuggcggacgcugggaagaaauaagaagccuaaacuuugcacacgcgaagaguucaccaagaaaguucggacaaacgccgcgaugggcgcuguguuuaccgaagagaaucagugggauuccgccaaggccgcugucgaagacgaggauuucuggaaacugguggacagagagcgcgaacuccacaagcuggggaaauguggaucuugcguuuacaacaugaugggcaagagagagaagaaacuuggggaauuuggcaaggccaaaggaagccgggcuaucugguauauguggcugggcgcccgcuaccucgaguucgaggcgcugggguuucugaaugaagaucauugguucuccagagagaacucuuacagcggaguggaaggcgaggggcuccacaagcugggauauauucuucgggacaucuccaaaauucccggcggggccauguacgcugaugacacggccggcugggacaccagaaucacagaagaugaccugcauaaugaggagaagaucacccagcagauggauccugaacaccggcaacucgcuaacgccauuuuuaagcugacauaucagaauaaagucgugaagguccagcgccccaccccgacaggaaccgugauggacaucauuucuagaaaagaucagcggggcagcgggcaaguuggaacguacggccuuaacacauucaccaauauggaggcgcagcugauccgccagauggaaggggagggagugcucuccaaggccgaccuggaaaacccucaccugcccgagaaaaagauuacccaguggcucgagacaaagggcgucgaaagacugaaacggauggcuaucagcggggaugacugcguggugaagcccaucgaugaccgcuuugccaacgcucuucuggcccucaaugauaugggcaaaguuagaaaggacauuccucaauggcagccgucuaaaggauggcaugauuggcagcaggugcccuucuguucccaccauuuccacgagcugaucaugaaggacggccggaagcuugucgugccuugccgcccccaagacgaacugauugggagagcucggaucagccagggagccggcuggucucuccgcgagaccgcgugucuggggaaagccuaugcucagauguggucccugauguacuuucacagacgggaucuccgccuggccagcaacgccauuugcucugcuguuccugugcauuggguccccacauccagaacgaccuggagcauccacgcccaucaccaauggaugacaaccgaagacaugcuuacaguguggaaucgggucuggauugaggauaacccuuggauggaggacaagacccccgugacgaccugggaaaauguuccguaucugggaaaaagagaggaucagugguguggcucccucaucgggcugacaagccgcgcgaccugggcucagaacaucccuacagccauucagcaagugcggucucuuaucggcaaugaagaguuccuggacuacaugcccagcaugaagagauuucgcaaagaggaagaguccgaaggagccauuugguga

SEQ ID NO: 20401 - RNA, 9873 nt, Artificial Sequence
  derived and/or modified CDS sequence (opt5) from DENV-3__JF808124__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcaccuucgggcuggagugcuccccuagaacgggacucgacuuuaaugagaugauucugcuuaccaugaaaaacaaggccuggaugguccaccggcagugguucuuugaucugccccucccguggacaagcggcgccaccacagaaaccccuacguggaaucgcaaagagcugcuugugacauucaagaacgcucaugcgaaaaagcaagaagucgugguucuggggucucaggagggagccaugcacaccgcucucacaggcgccaccgaaauccagaauuccgggggcaccagcauuuuugccggacaccugaaguguagacugaaaauggacaagcucgagcugaaaggcaugucuuacgcuaugugcacaaacacguucgugcuuaagaaagaggucuccgaaacccagcaugggacaauccugaucaagguggaguacaagggagaagaugcccccuguaaaauuccuuucagcaccgaggacggccaagggaaggcgcacaacggacggcucaucacagcuaaucccguugugaccaaaaaggaggaacuggucaacauugaggccgaacccccuuuuggcgaguccaauaucgugauugggaucggcgauaacgcccugaaaaucaauugguauaagaagggaucuagcauuggcaaaauguucgaagcuacggccagaggggcucgccggauggccauccuuggagacacagcgugggauuuuggcuccguggggggaguucucaacagccugggcaagaugguccaucagauuuucgggucugccuacaccgcucuguuuuccggcgugagcugggugaugaaaaucggaauuggcguccuccugaccuggaucgggcuuaauucuaagaacacaagcauguccuucucuugcauugccaucggaaucauuacccuguaucucggcgcugugguucaggccgacauggggugugugaucaauuggaaaggaaaggagcugaagugcggcagcgggauuuuugucacaaacgaggugcacacguggaccgaacaguacaaauuccaagcggauuccccgaagagacuggccacagcuaucgccggcgcuugggagaauggaguuuguggcauucgcagcaccacacggauggaaaaccuucucuggaaacagguggccaaugagcugaacuauauccugugggaaaauaacaucaagcucaccgucgugguuggggacauuaucggagugcuggagcagggcaaaagaacgcuuaccccccagccuauggagcugaaguacucuuggaaaacaugggggaaggccaagauugucaccgcugaaacacaaaacuccagcuuuaucauugauggacccaauaccccugagugccccucugcgucccgcgccuggaacgugugggaaguggaggacuauggcuucggcgucuuuacaaccaauaucuggcucaaacugcgggaaguuuacacgcagcugugugaccauagacuuaugagcgcugccgugaaggaugagcgcgccgugcacgcugacaugggguacuggaucgagucccagaaaaacggaucuuggaagcucgaaaaagccagccugauugaggucaagacaugcaccuggccgaagucccacacccuguggucuaauggcgugcucgaaagcgauaugaucauuccuaaaucccuggcggggcccaucagccagcauaaccaccggccuggauaucauacacaaaccgcuggccccuggcaccuugggaagcuggagcucgacuucaauuacugcgagggaacgacaguugugauuaccgaaaacuguggcacaagaggcccuucucugcgcaccacaaccgucuccgggaaacugauccacgaguggugcugucggagcugcacgcuucccccgcucagauauaugggagaagauggcuguugguacgggauggagauccggccuauuucugaaaaggaggagaauauggugaaaucccugguuagcgccggaucuggcaagguggacaacuuuaccauggggguccugugccucgccauccuguucgaagaggugaugcgcggaaaguucggcaaaaagcauaugauugcuggcguucuuuuuacaugugugcugcuccugagcgggcagaucaccuggagagauauggcccacacacugauuaugaucggauccaaugcgagcgaccggaugggcaugggggucaccuaucuugcucugauugccacguucaaaauccagcccuuucucgcccugggauucuuucucagaaagcugacaucucgcgaaaaccuucugcucggcguggggcuggcuauggccaccacacugcaacuucccgaggauaucgaacagaugggaaauggcauugcucugggccucauggcccugaaacucaucacccaguucgagaccuaccagcuguggacagcgcuuauuucccugacgugcagcaacaccauguuuacacucaccguggccuggcggacagcuacccugauccuggccggggucucccuucugccuguuugucaaucuagcuccaugagaaagacggacuggcucccgauggcuguggccgccaugggagugcccccucugccccucuucauuuuuucucugaaggauacacuuaaacgcagaagcuggccucugaaugagggcgucauggcuguggggcugguuuccauccucgcgucuagccugcuucggaacgacgugcccauggccggaccucuggucgcuggcgggcuccugaucgccugcuaugugauuaccggaaccuccgccgaucucacaguugaaaaggcugccgacaucaccugggaggaagaggcggaacagacaggcgugagccauaaccugaugauuacggucgacgaugacggcaccaugcgcaucaaagaugacgagacagagaauauucuuaccgugcugcugaagacagcucuccugauccuuucuggggucuuccccuacuccaucccggccacccugcucguguggcacacguggcagaaacagacccaaagaagcggaguucugugggaugugccuucucccccugaaacacagaaggccgagcucgaagagggcgucuaccggauuaaacagcaggggaucuuuggaaagacccaagugggcguuggggugcagaaggagggagucuuccauacaauguggcacgugacccgcggcgcugugcugacauauaacggcaaaagacuugaacccaauugggccuccguuaagaaagaccugauuagcuacgggggaggcuggcggcugucugcgcaguggcaaaagggggaggaaguccaggugaucgcuguggagccgggaaaaaacccuaagaauuuucagacgaugcccggcaccuuccagacaaccaccggggaaauuggagccaucgcccucgauuucaagccuggcacauccggcagccccauuaucaaccgcgaggggaaagucgugggacuguauggcaaugggguugugacgaagaacggaggcuacgucuccgggaucgcucaaaccaaugccgagcccgacggcccuacaccggaacuugaggaagagauguuuaaaaagagaaaccugaccauuauggaucuccaccccggaagcggcaaaacacggaaguaucugccugcuaucgugcgcgaagccauuaagagacggcucagaacccugauccuugcgcccacgcgcguuguggccgcugagauggaggaagcccugaaagggcugccuauucgguaccagacaaccgcuaccaagucugagcauacaggaagagaaaucgucgaccucaugugucacgccaccuucacaaugcgccugcuuagccccgugcggguuccuaauuauaaccugaucauuauggaugaggcccauuuuaccgacccggcuuccaucggcgcgagaggguacauuucuacgcgcgugggaaugggcgaagccgcugccaucuucaugacagccacccccccugggacagcugaugccuuuccccagagcaaugcgccuauucaggacgaggagcgggacauccccgaaagauccuggaacucuggcaaugaguggaucaccgauuucgcuggaaaaacggucugguuugugccgagcauuaaggccggcaacgacaucgccaacugccuccgcaaaaaugggaagaaggugauucaacugucccggaaaaccuucgauacagaauaccagaagaccaaacugaacgacugggauuuugucguuacaaccgacaucucugagaugggagcuaauuucaaggccgauagagugauugacccucggcgcugccucaaacccgugauccuuacagauggccccgagagagucauucuggcggggccuaugcccgugaccgccgcuagcgccgcucagcggcgcggaagaguuggccggaacccucagaaggaaaaugaccaauauaucuuuacggggcagccgcugaacaaugaugaggaccacgcccauuggacagaagcuaagaugcuccuggacaacaucaauacccccgagggcauuaucccugcccuuuucgaacccgagagagagaaauccgcggccauugauggagaauaccgccugaagggcgagagccggaaaaccuucguggaacucaugagacgcggggaccugccugucuggcuggcucacaagguggccucugagggaaucauuuauacagaucggaaaugguguuuugacggccagagaaacaaucagauccucgaagagaacauggauguugagaucuggaccaaggaaggggagaaaaagaagcuucgcccccgguggcuggacgcuagaacauacuccgauccgcuggcccucaaagaauucaaggacuuugccgcuggacgcaaaagcauugcgcuggaucuugugacggagaucggcagagucccuucucaccuggcccaucggacccgcaaugcucucgacaaccuggugaugcugcacacauccgaacauggcgggagagccuaucggcacgccgucgaggagcuccccgaaaccauggagacacuucugcugcucggacugaugauucuucugaccggcggggcuaugcucuuccugaucagcggaaagggcauugggaaaacguccaucggacugaucugcgugauugccucuagcggcauguccuggauggcggaaaucccucuccaauggauugccagcgcuaucguucuugaguuuuucaugauggugcugcugauucccgagccugaaaagcagcgcaccccccaggauaaucaacucgccuacguggucaucggcauucugacacuugcugccaucaucgcggccaacgagauggggcugcucgaaaccacaaagagagaccugggaaugucuaaagagccgggcguuguguccccuaccagcuaucuggauguggaccuccaccccgcuucugccuggacgcuuuacgcugucgccacaaccgugauuacacccaugcugcggcauaccaucgaaaauagcaccgcuaacguuucccuggccgcgauugccaaccaggcugugguccucauggggcuggacaagggauggccuaucucuaaaauggaucuuggcgugccgcugcucgcccugggguguuacagccaggucaauccccugacacucacggcugccgugcuucugcugauuacccacuaugccaucaucggaccuggccuccaggcgaaggcuacaagagaggcccaaaaacgcaccgcugccggcauuaugaagaaccccacaguugacgggaucaugaccauugaucuggacccugugaucuacgauuccaaguuugagaaacagcuuggacaggucaugcugcucgugcugugcgccguucagcugcuccuuaugcggacgucuugggcucugugugaagcccugacacucgcgaccggccccauuaccacacugugggaggggagcccuggaaaguucuggaauaccacaaucgccguguccauggcuaacaucuuuagaggcagcuaucuugccggggcuggacuggccuucucuauuaugaaauccgucggcacgggcaagcgcgggaccggaagccaaggcgaaacacucggggagaaauggaagaagaaacugaaucagcugucccggaaggaauuugaccucuacaaaaagucuggaaucaccgagguggauagaacagaggcgaaagaaggccuuaagcggggggagauuacccaucacgccgugagccgcggauccgcuaaacugcagugguucguugaaagaaacauggucaucccggagggccgggugauugaccugggcugcgggcgcggaggcuggucuuauuacugugccgggcucaagaaggugacggaagucagaggauauaccaaaggcgggcccggacaugaggagccuguucccaugagcacauacggcuggaauaucgugaagcugauguccggcaaagauguguuuuaccuuccucccgaaaagugcgacacccugcucugugauauuggggagagcucuccguccccuacagucgaagagagccggaccauccgcgugcugaaaaugguugagcccuggcugaagaacaaucaguucugcaucaaggugcucaaccccuauaugccuacagucauugaacaccuugagagacugcaacggaaacacggaggcaugcuggugcgcaauccccucucuagaaacuccacccaugaaauguacuggaucagcaaugggacgggaaacauuguugcuucugugaauauggucagccggcugcuucugaacagauucacaaugacccaccgccggccuaccaucgagaaggacguggaucucggcgccgggacaagacaugugaacgcugaaccggagacgcccaauauggacgucauuggagagcgcaucaaacggaucaaggaagagcacaacuccaccuggcacuaugacgaugaaaauccuuacaaaacaugggccuaucauggcucuuacgagguuaaggcgaccggcagcgccuccagcaugauuaacgggguggugaagcugcugacaaaacccugggacgucgugccuaugguuacccagauggcuaugacagauaccacgcccuuuggacagcaaagaguguucaaggaaaaagucgacacccgcacaccgcgguccaugccuggcaccagacgcgugauggggaucacagccgaguggcucuggcggacccugggaagaaauaagaaaccccgccuuuguacgcgggaggaauuuacaaagaagguuagaaccaacgcugccaugggcgccguguucacagaggaaaaucagugggauucugcgaaagcugccgucgaggacgaagauuuuuggaagcugguggaccgcgagagagagcuccacaaacuggggaagugcggcagcugcguuuauaacaugaugggaaaacgggaaaagaaacuuggcgaguucgggaaggccaagggaucccgcgcuauuugguacauguggcugggcgccagauaccucgaauuugaggcucugggguuccugaaugaggaucauugguuuucucgggaaaacagcuauuccggaguggagggcgaagggcuccacaaacugggcuacauccuuagagacauuucuaagaucccuggaggcgccauguaugcggaugacaccgccgggugggacacgcggaucaccgaggaugaccugcauaaugaagagaaaauuacacagcagauggaucccgagcaccgccaacucgcuaacgccaucuucaagcugaccuaccagaauaaagucgugaagguccagagaccuacacccaccggaacagugauggacauuaucagccggaaggaucagcgcggcuccgggcaaguuggaaccuauggccuuaacacguuuacaaauauggaagcucagcugauuagacagauggagggggaaggcgugcucagcaaagccgaccuggagaacccgcaccugccugaaaagaaaaucacccaguggcucgagaccaagggagucgagcggcugaaacgcauggcgaucucuggcgaugacuguguggugaagcccauugaugacagauucgccaacgcucuucuggcccucaaugauauggggaagguucggaaagacaucccccaauggcagccuuccaagggauggcaugauuggcagcaggugccguuuugcagccaccauuuccacgaacugauuaugaaagacggccgcaagcuugucgugcccuguagaccucaagacgagcugaucgggcgggcucgcauuucucagggagccggcuggucccucagagaaacagcuugccuggggaaagccuacgcgcagauguggagccugauguauuuccaccggcgcgaucucagacuggccucuaacgcuaucuguuccgccguucccgugcauugggucccuaccagccggacaacgugguccauucacgcccaucaccaauggaugaccacagaggacaugcuuaccguguggaauagagucuggaucgaagauaaccccuggauggaggacaagacaccugugaccacgugggagaauguucccuaccugggcaagcgcgaagaucaguggugcggaagccucaucggccugaccucucgggcuacaugggcccagaacauuccgaccgcgauccagcaagugagaagccuuauugggaaugaggaauuucuggacuacaugccuuccaugaaacgcuuccggaaggaggaggaaucugagggagcuaucugguga

SEQ ID NO: 20402 - RNA, 9873 nt, Artificial Sequence
  derived and/or modified CDS sequence (opt5) from DENV-3__JF808126__SS-prME
accagccugugccugaugaugauucugcccgcugcucuugccuuccaccugacgucccgggacggagagccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuucucgaucugccccuuccguggaccagcggcgccacaaccgaaacgccuacauggaaucggaaagagcugcucgugaccuucaagaacgcucacgcgaaaaagcaagaagucgugguucuggggucucaggagggagccaugcacacagcucugaccggcgccaccgaaauucaaaauuccgggggcacaagcaucuuugccggacaucucaagugucgccugaaaauggacaaacuugagcugaaaggcaugucuuacgcuaugugcacgaacaccuucgugcucaagaaagaggucuccgaaacacagcacgggaccauucugaucaagguggaguacaagggagaagaugcccccuguaaaaucccuuuuagcacagaggacggccaagggaaggcgcauaacggaagacugauuaccgcuaaucccguugugacgaaaaaggaggaacccgucaacaucgaggccgaaccuccguucggcgaguccaauauugugaucgggauuggcgauaacgcccuuaaaaucaauugguauaagaagggaucuagcaucggcaaaauguucgaagcuacagccagaggggcuagacgcauggccauucucggagacaccgcgugggauuuuggcuccgucgggggaguucugaacagccugggcaagaugguccaccagaucuucgggucugccuacaccgcucucuuuuccggcgugagcugggugaugaaaauuggaaucggcguccugcuuacauggauugggcucaauucuaagaacaccagcauguccuucucuugcaucgccauuggaaucaucacacucuaucugggcgcugugguucaggccgacauggggugugugauuaauuggaaaggaaaggagcugaagugcggcagcgggaucuuugucacgaacgaggugcauaccuggacagaacaguacaaauuccaagcggauucccccaagcggcuugccaccgcuauugccggcgcuugggagaauggaguuuguggcaucagaagcacaacccgcauggaaaaccuccuguggaaacagauugccaaugagcugaacuauauccucugggaaaauaacaucaagcugacgguggucgugggggacauuaucggaguucuugagcagggcaaacggacccugacaccucagcccauggagcucaaguacucuuggaaaaccugggggaaguccaagauugugacagccgaaacccaaaacagcucuuuuaucauugauggaccuaauacacccgagugcccguccgcuagcagagcguggaacgucugggaaguggaggacuauggcuucggcguguuuaccacgaauaucuggcugaaacugcgcgaagucuacacacagcuuugugaccaccggcucauguccgccgcuguuaaggaugagagagccgugcacgccgacaugggguacuggaucgagucucagaaaaacggaagcuggaagcuggaaaaggcuucccugauugaggugaagaccugcaccuggccuaagucucauacacucuggagcaauggcguccuggaauccgauaugaucauucccaaaagccuugccgggccuaucucucagcacaaccaucgccccggauaucacacccaaacggcgggcccuuggcaccuggggaagcucgagcuggacuucaauuacugcgagggaacaaccgugguuauuacagaaaacuguggcacccggggccccgcucugagaacaaccacgguguccgggaaacuuauccaugaguggugcugucgcagcugcacccucccgccucugcgguauaugggagaagauggcuguugguacgggauggagaucagacccauuucugaaaaggaggagaauauggucaaaucccuggugagcgccggaucuggcaagguugacaacuuuacaaugggggugcucugccuggccauccuuuucgaagaggucaugcggggaaaguuuggcaaaaagcacaugauugcuggcguguucuucaccuuuguucugcuccugagcgggcagaucacauggcgcgauauggcccauacccugauuaugaucggauccaaugcgagcgacagaaugggcaugggggugacguaucuugcucugauugccacauucaaaauccagcccuuucucgcccugggauucuuucuccggaagcugaccucuagagaaaaccuucugcucggcgucgggcuggcuauggccacaacccugcaacuuccugaggauaucgaacagauggcuaauggaauugcccugggccucauggcgcugaaacucaucacccaguucgagacauaccagcuguggacggcccuuauuucccugaccuguagcaacacaauguuuacccucacaguggcuuggcgcaccgccacgcugauccuggcuggcgugucccuucugccggucugccaaucuagcuccaugcggaagacagacuggcuccccauggccguugccgcuaugggggugccuccccugccucucuucaucuuuucucugaaggauacccuuaaaagacgcagcuguccccugaaugagggagugauggcggucggccugguguccauccucgccucuagccugcuuagaaacgacguuccuauggcugggccccugguggccggaggccuccugaucgccugcuaugucauuaccgggacauccgcugaucucaccguggaaaaggccgcggacaucacaugggaggaagaggcugaacagacgggaguuagccacaaccugaugauuaccguggacgaugacggcacaaugcggaucaaagaugacgagaccgagaauauucuuacaguccugcugaagaccgcccuccugaucgugucuggcgucuucccguacuccaucccugccacgcuucugguguggcauaccuggcagaaacagacacaacgcagcgggguucucugggaugugcccucuccucccgaaacccagaaggcugagcuggaagagggagucuacagaauuaaacagcagggcaucuuugggaagacacaagugggaguuggcgugcagaaggagggggucuuccacaccauguggcacgugacacggggagccgugcucacguauaacggcaaacgccuggaaccgaauugggcguccguuaagaaagaccuugucagcuacggcgggggauggagacugucugcucaguggcaaaagggcgaggaaguccaggugauugccgucgagccugggaaaaaccccaagaauuuucagaccaugccuggaacauuccagaccaccacaggcgaaaucggggccauugcucuggauuucaagcccggaacguccggcagccccaucauuaaccgggagggcaaagugguugggcucuauggaaauggcguggucaccaagaacgggggauacguguccggcaucgcccaaacaaaugcugagccugacgggccgacccccgaacuggaggaagagauguuuaaaaagcgcaaccuuacaaucauggaucugcauccuggcagcggaaaaaccagaaaguaucuccccgccauuguucgggaagcgaucaagcgcagacugcggacgcucauucuggccccuacaagaguggucgcugccgagauggaggaagcucuuaaaggccugcccauccgcuaccagaccaccgccacaaagucugagcacaccgggcgggaaauuguggaccugaugugucaugccacauucaccaugagacuccugagcccuguucgcgugcagaauuauaaccuuaucaucauggaugaggcucacuuuacggacccggcguccauugccgcucggggauacaucucuacaagagucggcaugggggaagccgccgcuauuuucaugaccgccacacccccuggaaccgcggaugcuuuuccccagagcaaugccccuauccaagacgaggagcgcgacauucccgaacgguccuggaacucuggcaaugaguggaucacggauuucgccgggaaaaccgugugguuugugccgagcaucaaggcuggcaacgacauugccaacugccugcgcaaaaauggaaagaaggucauccagcucuccagaaaaacauucgauaccgaauaccagaagacaaaacugaacgacugggauuuuguugugaccacagacauuucugagaugggcgcgaauuucaaggccgaucgggugaucgacccuagacggugccugaaacccgucauucucaccgaugggcccgagcgcgugauccuugcuggaccuaugcccguuacggccgcuagcgccgcucagagacggggccgcguggggagaaacccucaaaaggaaaaugaccaguauauuuuuacaggacagccgcugaacaaugaugaggaccaugcccacuggaccgaagcgaagaugcugcucgacaacaucaauacccccgagggcaucauuccugcccuguucgaacccgagcgggagaaauccgcugccaucgauggggaauacagacuuaagggcgagagccgcaaaacauucgucgaacugaugcggagaggagaccucccuguguggcuggcucacaagguugccucugagggcauuaaauauaccgaucgccggugguguuuugacgggcagagaaacaaucaaauccuggaagagaacauggauguggagauuuggacaaaggaaggagagaaaaagaagcuccgcccccgguggcuugacgccagaacguacuccgauccgcuggcucugaaagaguucaaggacuuugcggccggccgcaaaagcaucgcucucgaucuggucaccgagaucgggagagugccuucucaucuugcccaccggacacgcaaugcccuggacaaccucgucaugcugcauaccuccgaacacggaggcagagcuuaucggcacgccguggaggagcugcccgaaacaauggagacccuccuucugcugggccucaugauucugcuuacagggggagcgaugcuguuccucaucagcggcaaggggauuggaaaaaccuccaucggccugauuugcguuaucgccucuagcgggaugcuguggauggcugaaaucccucuccccuggauugccuccgcuaucgugcuugaguuuuucaugauggugcugcugauuccugagcccgaaaagcagcgcacaccgcaggauaaucaacucgccuacgucguuaucggcauucugacccuugcggccaucauugcugccaacgagaugggccugcucgaaacaaccaagagagaccugggcaugagcaaagagccugggguggugucucccacguccuaucuggaugucgaccuccaucccgcuagcgccuggacacuuuacgcuguggccaccacaguuaucaccccuaugcugcggcacaccaucgaaaauucuacagcgaacgugagccuggccgcuauugccaaccaggcugucgugcucaugggacuggacaagggcuggccgaucuccaaaauggaucuuggggucccccugcucgcccugggauguuacucucaggugaauccucugacgcucaccgccgcgguucuucugcugauuacacauuaugcuaucauuggccccgggcuccaggccaaggcuaccagagaggcccaaaaacgcacagccgcuggaaucaugaagaacccuaccguggacggcaucaugacgauugaucuggaccccgucaucuacgauagcaaguuugagaaacagcuuggccaggugaugcugcucguucugugcgccgugcagcugcuccuuaugcggacauccugggcgcugugugaagcccugacccucgcuaccgggccuauuacaacccugugggagggaucuccgggcaaguucuggaauacaacgaucgccgucagcauggcuaacauuuuuagaggguccuaucuugccggagcgggccuggccuucagcaucaugaaaucuguggggaccggaaagcgcggcacaggcucccaaggggaaacccucggagagaaauggaagaagaaacugaaucagcugagccggaaggaauuugaccucuacaaaaaguccggcaucacagagguggauagaaccgaggcuaaagaagggcuuaagcggggagagauuacgcaccaugccguuucucgcggcagcgcuaaacugcagugguucgucgaaagaaacauggugauccccgaggggcgggugauugaccugggaugcggccgcggcgggugguccuauuacugugccggacucaagaaggucaccgaaguuagaggcuauacaaaagggggaccuggccacgaggagcccgugccuaugucuaccuacggguggaauaucgugaagcugaugagcggaaaagaugucuuuuaccuucccccggaaaagugcgacacacugcucugugauauuggcgaguccagcccuucucccaccguggaagagucccggacaauccgcguucugaaaaugguggagcccuggcugaagaacaaucaguucugcauuaagguccucaacccuuauaugcccaccgugaucgaacaccuugagagacugcaacggaaacauggcgggaugcugguucgcaauccucucagcagaaacucuacgcacgaaauguacuggaucuccaauggaacaggcaacauuguggcuagcgucaauauggugucucggcugcuucugaacagauucaccaugacccaucgccggccgacaaucgagaaggacguggaucucggggccggaacgagacacgucaacgcggaacccgagaccccuaauauggacguuauuggcgagcgcaucaaacggauuaaggaagaacacaacagcacauggcauuaugacgaugaaaaucccuacaaaaccugggccuaucacggguccuacgaggugaaggcuacaggaucugccagcuccaugaucaacggcguggucaagcugcugaccaaaccuugggacgugguucccauggugacacagauggcuaugaccgauacgaccccguuuggccagcaaagagucuucaaggaaaaaguggacacacgcaccccucggagcaugcccgggacaagacgcguuaugggaaucaccgccgaguggcucuggcggacgcugggcagaaauaagaaaccucgccuuuguacacgggaggaauuuaccaagaaggugagaacaaacgccgcgaugggggcugucuucaccgaggaaaaucagugggauuccgccaaagccgcuguggaggacgaagauuuuuggaagcugguugaccgcgagagagagcuccauaaacugggaaagugcggcucuugcguguauaacaugauggggaaacgggaaaagaaacuuggcgaguucggaaaggccaagggcagccgcgcuauuugguacauguggcugggggccagauaccucgaauuugaggcgcugggauuccugaaugaggaucacugguuuucccgggaaaacucuuauagcggcgucgagggggaaggacuccauaaacugggcuacauccuuagagacauuuccaagauccccgggggcgccauguaugcugaugacacggccggaugggacacccggauuacagaggaugaccugcacaaugaagagaaaaucacccagcagauggauccugagcaccgccaacucgcuaacgccaucuucaagcugacauaccagaauaaaguggucaaggugcagagacccaccccgacaggcaccguuauggacauuaucucucggaaggaucagcgcgggagcggacaagugggcacguaugggcuuaacacauuuaccaauauggaagcgcagcugauuagacagauggagggagaaggcguccucuccaaagccgaccuggagaacccucaucugcccgaaaagaaaaucacccaguggcucgagacaaaggggguggagcggcugaaacgcauggcuauuagcggcgaugacugugugguuaagcccaucgaugacagauucgccaacgcccuucuggcccucaaugauaugggaaaggugcggaaagacaucccucaauggcagccgucuaagggcuggcacgauuggcagcagguccccuuuugcucccaucacuuccacgaacugauuaugaaagacgggcgcaaacuugugguuccuuguagaccccaagacgagcugaucggacgggcucgcauuagccagggcgccggguggucucucagagaaaccgcgugccugggaaaagccuacgcucagauguggucccugauguauuuccaucggcgcgaucucagacuggccagcaacgccaucuguucugcugugccuguccacugggugcccacaucccggacgaccuggagcauucaugcccaccaucaauggaugacaaccgaggacaugcuuacagucuggaauagaguguggaucgaagauaacccuuggauggaggacaagacccccguuacgaccugggagaaugugccguaccugggcaagcgcgaagaucaguggugcgggucccucauuggccugacaagccgggcgaccugggcucagaacaucccuacagccauccagcaagucagaucucuuauuggaaaugaggaauuucuggacuacaugcccagcaugaaacgcuuccggaaggaggaggaauccgagggcgccaucugguga

SEQ ID NO: 20403 - RNA, 9873 nt, Artificial Sequence
  derived and/or modified CDS sequence (opt5) from DENV-3__JF808125__SS-prME
accagccugugccucaugaugauccugcccgccgcucuugccuuccaccugacaucccgggacggcgagccucggaugauugugggggaaaacgagcgcggaaagucucuccuguuuaaaacggcgagcggcaucaaucggcggacccuuauugcuauggaucugggggaaaugugugaggaaacagagaccuacaagugcccgcacaucacagaggucgaacccgaggacauugauuguuggugcaaccucaccuccacauggguuaccuauggaacguguaaucaggccggcgaacgcagacgggacaaacgcucuguggcccuggcuccucacguggggaugggacuggauaccagaacacagaccuggaugagcgccgagggcgcuuggcggcaggucgagaagguggaaacaugggcccuccgccaucccggcuucaccauccuggcgcuuuuucuggcccacuacaucgggacgucccucacacagaaaguugugauuuucauccugcuuaugcuggucaccccuucuaugacaaugagaugcgugggaguuggcaaccgggacuuuguggaggggcucagcggagcuaccugggucgauguggugcuggaacauggcgggugugucaccacaauggccaagaauaagcccacgcuggacauugagcuccagaaaaccgaagcuacacaacuggccacccuucgcaagcugugcaucgagggaaaaauuacaaacaucaccacggauuccagauguccuacacagggcgaggcgguucucccggaagaacaggaccagaauuaugugugcaagcacaccuacguggaucggggcugggggaacggauguggccuguucgggaaaggaagccuugugacaugcgccaaguuucaaugccuggaacccauugagggcaaggugguucaguaugaaaaucucaaauacacagugaucaucaccguccacacaggggaccagcaucaggugggaaacgagacgcaaggcguuaccgcugagauuacaccucaggccucuaccacagaagcuauccugcccgaguauggcacccuggggcucgaauguuccccucgcacgggacuggauuucaaugagaugauucuucugaccaugaagaacaaagccuggauggugcacagacagugguuuuucgaccucccccugccguggacaagcggcgccaccgcugaaacaccuaccuggaaucggaaggagcuucuggucacguuuaaaaacgcgcaugccaagaaacaagagguggucgugcucgggucucaggaaggagcuaugcacacagcccugaccggcgccacagagauccaaaauuccgggggcaccagcauuuucgcuggacaccugaagugcagacucaagauggacaaacuggaacuuaagggcaugucuuacgccauguguaccaacacauuuguucugaaaaaggagguguccgagacgcagcaugggaccauccucaucaaagucgaauacaagggagaggaugcgcccugcaagauuccuuucagcacagaagacggccaagggaaagcucacaacggacgccugaucaccgccaaucccgugguuacaaagaaagaggaacccgugaacauugaggccgagccuccguucggcgaauccaauaucgucauugggaucggcgauaacgcucugaagaucaauugguauaaaaagggaucuagcauuggcaagauguuugaggccaccgcuagaggggccagacgcauggcgauccuuggagacacggccugggauuucggcuccgucgggggagugcucaacagccugggcaaaaugguucaucagauuuuugggucugcuuacacagcccuguucuccggcgucagcugggugaugaagaucggaauuggcgugcuccugaccuggaucgggcuuaauucuaaaaacaccagcauguccuuuucuuguauugcuaucggaaucauuacacuguaucucggcgccgucgugcaggcggacauggggugcguuaucaauuggaagggaaaagaacugaaguguggcagcgggauuuucgugaccaacgagguccacacauggacggaacaguacaaguuucaagccgauucccccaaacggcuggcuaccgccaucgcuggcgccugggagaauggagugugcggcauuagaagcacaacccgcauggagaaccuucucuggaagcagaucgccaaugaacugaacuauauccugugggagaauaacauuaaacucacaguuguggucggggacaucauuggagugcuggaacagggcaagcggacccuuacgccucagcccauggagcugaaauacucuuggaagaccugggggaaagcuaagaucguuacagcggaaacccaaaacuccagcuucauuaucgauggaccuaauacacccgaguguccgucugccuccagagcuuggaacgugugggaggucgaagacuauggcuuuggcguguucaccacaaauaucuggcucaagcugcgcgagguguacacccagcugugcgaucaucggcuuaugagcgccgccgucaaagacgaaagagcuguucacgccgacaugggguacuggauugagucccagaagaacggaucuuggaaacucgagaaggcgagccugaucgaagugaaaacguguacauggccuaagucccacacccuguggucuaauggcgugcucgagagcgauaugauuauccccaagucccuggcugggccuauuagccagcauaaccaccgccccggauaucauacccaaacagccggcccuuggcaccuugggaaacuggaacucgacuuuaauuacugcgagggaaccacggucgugaucacagaaaacugcggcacccggggccccucucugagaacaaccacaguuuccgggaagcugauccacgagugguguugccggagcuguacccuuccgccucuccgcuauaugggagaggauggcugcugguacgggauggaaauuagacccaucucugagaaagaagagaauauggugaagucccuggucagcgccggaucuggcaaaguggacaacuucacgauggggguucugugucucgcuauucuguuugaagaggugaugcggggaaaguucggcaagaaacauaugaucgccggcgucuucuuuaccuucgugcuucugcucagcgggcagauuacauggagagauauggcgcacacccugaucaugauuggauccaaugcuagcgaccgcaugggcauggggguuacauaucuggcccuuaucgccaccuuuaagauccagcccuuccuggcucucggauuuuuccugcggaaacucacgucuagagagaaccugcuucugggcguggggcucgccauggcuacaacccugcaacugccugaagauauugagcagauggccaauggaaucgcgcuuggccugauggcccucaagcugauuacacaguuugaaaccuaccagcucuggaccgcucugaucucccuuacaugcagcaacacgauguucacccugacagucgccuggcgcaccgcuacacucauucuggccggcgugucccugcuuccggugugucaaucuagcuccaugagaaaaaccgacuggcugcccauggccgucgcugcgauggggguuccuccccucccucuguuuaucuucucucucaaggauacgcugaagcggcgcagcuggccccuuaaugagggagugauggccgugggccuggucuccauccuggcuucuagccuccugagaaacgacgugccuauggccgggccccuuguugccggaggccugcucauugcuugcuaugugaucacagggaccuccgccgaucugaccgucgaaaaagcggcugacauuacaugggaggaggaagccgagcagaccggagugagccauaaccucaugaucacaguugaugacgacggcacgaugcggauuaaggaugacgaaaccgagaauauccugacagugcuucugaaaaccgcccugcucaucgucucuggcguguuuccguacuccauuccugcuacacugcuugucuggcacaccuggcagaagcagacgcaacgcagcggggugcugugggauguucccucuccucccgagacccagaaagccgaacucgaggaaggaguguacagaaucaagcagcagggcauuuucgggaaaacacaagucggagugggcguucagaaggaggggguguuucauaccauguggcacgucacacggggagcggugcugaccuauaacggcaagcgccucgaaccgaauugggcuuccgugaaaaaggaccugaucagcucuggcgggggauggagacuuuccgcccaguggcaaaaaggcgaggagguucaggucauugccguggaaccugggaagaaccccaaaaauuuccagacaaugccuggaacguuccagaccacaaccggcgagaucggggcuauugcccuggauuuuaagcccggaaccagcggcucccccaucaucaaccgggaaggcaagguggucgggcuguacggaaauggcgugguuaccaagaacgggggauaugugagcggcauugcucaaacgaaugccgagccugacgggccgacccccgaacucgaggaggaaauguucaagaaacgcaaccugacaaucauggaucuucacccuggcucuggaaagaccagaaaauaccugcccgcgauuguccgggaggccaucaagagacgccuccggacacugauucucgcuccuaccagagugguugccgcugaaauggaggaagcccugaagggccuucccauccgcuaucagacgacagccaccaaaagcgagcauaccgggcgggagaucguggaccugaugugucacgcuacauuuaccaugagacugcucuccccuguccgcgugccgaauuacaaccugauuaucauggaugaagcgcauuucacagaccccgccucuauugcugcccggggauauaucagcaccagaguuggcaugggggaggccgcugccauuuuuaugacggcgacaccucccggaaccgcugaugccuucccucaguccaaugcccccauccaggacgaagaacgcgauaucccggagcggucuuggaacagcggcaaugaauggauuacagacuuugcugggaagaccgugugguucgucccuuccaucaaagccggcaacgacauugcgaacugccuuagaaagaauggcaaaaaggugauccaacugucucggaagacguuugauaccgaguaccagaaaacaaagcucaacgacugggauuucguggucaccacagacauuagcgaaaugggagccaauuuuaaagcugaucgcguuaucgaccccagacggugucugaagcccgugauucugaccgaugggccugagcgcgugauccucgccggacccaugccugucacagcugccuccgcugcccagagacggggcagaguggggcgcaacccgcagaaagaaaaugaccaauacaucuucaccggacagccccuuaacaaugaugaggaccacgcgcauuggacggaggccaagaugcugcuggauaacauuaauacaccugaaggcaucauucccgcucucuucgagccugaacgggagaaaagcgccgcuaucgacggggaauauagacugaaaggcgaaucucgcaagaccuuuguugagcuuaugcggagaggagaccugcccguguggcucgcccacaaagucgccuccgaaggcauuaaguacaccgaucgcaaauggugcuucgacgggcagcggaacaaucagauccuggaggaaaacauggauguggagaucuggacaaaggaaggagagaaaaagaagcugagaccgcgcuggcucgacgcuagaaccuauagcgauccucuugcgcugaaagaguuuaaggacuucgccgcuggccggaaaucuauugcccuggaucucguuacagaaaucgggcgcgugcccucccaccuggcccauagaacgcggaaugcucuugacaaccuggucaugcuccacaccagcgagcauggaggccgcgccuacagacacgcgguggaggaacugccugagacaauggaaacccugcuccuucugcggcugaugauucuccugacaggcggggccaugcuuuuucugaucuccggaaagggcauugggaaaaccucuaucggacucaucugcgucauugcuagcuccggcaugcuguggauggccgagaucccccugcaauggauugcuagcgccaucgugcucgaguucuuuaugaugguucuucugauuccugagcccgaaaagcagagaacgccgcaggauaaucaacuggcguauguggugaucgggauucucacccuggccgcuaucaucgccgcuaacgagaugggacuucuggagacaaccaagcgcgaccucggcaugucuaaagaaccuggcgucguuucccccacaagcuaccuggauguggaccugcaccccgccucugcuuggacccucuaugccguggcgacgacagucauuaccccuaugcuucggcauacaaucgagaauagcaccgccaacgugucccuggcugccauugcuaaccaggccguugugcugauggggcucgauaagggauggccgaucucuaaaauggaccugggcgucccccuucuggcccucggguguuacagccaggugaauccucugacccugacagcggcuguccuccuucugauuacgcacuacgccaucaucggacccggccugcaggcuaaggccaccagagaagcccaaaaacgcacagcugccgggauuaugaagaacccuaccguggacggaaucaugacaauugaucucgaccccguuaucuaugauuccaaguucgagaaacagcugggccaggugaugcuucugguccucugcgcggugcagcugcugcucaugcggaccucuugggcccuuugugaagcucugacgcuggccacaggcccuauuaccacccucugggaggggagcccgggaaaguuuuggaauacaaccaucgcuguuuccauggccaacaucuucagaggcagcuaccuggcgggggccggacuugcuuuuucuauuaugaaauccgugggcacagggaagcggggaacgggcagccaaggcgagacccugggggaaaaauggaagaagaaacucaaucagcugucccgcaaggaguucgaccuguauaaaaagucuggaaucacagaagucgauagaaccgaggccaaagaaggccucaagagaggggaaauuacacaucacgcugugagccgcggauccgccaaacuucagugguuuguggagagaaacaugguuauccccgaaggccgggucauugaccuggggugcggacgcggcggcuggucuuacuauugugcugggcugaagaaggugaccgaggugagaggauacacgaaaggcgggccuggacaugaggaacccgucccuaugagcaccuauggcuggaauaucguuaagcucauguccgggaaagauguguucuaccugcccccggagaagugcgacacacuucugugugauauuggagaaagcucuccuucccccaccguggaggaaagccggacaauccgcguccucaaaaugguggagcccuggcugaagaacaaucaguucugcaucaagguucugaacccuuacaugcccaccgugauugaacaccucgagagacuucaacggaaacacggcggcaugcuggucagaaauccucugucucgcaacuccacacaugagauguauuggaucagcaaugggaccggaaacauuguggccucuguuaauauggugagccggcuccugcuuaacagauuuacgaugacacaccgccggccgaccaucgaaaaggacgucgaucugggcgcggggaccagacaugugaacgccgagcccgaaacaccuaauauggacgugauuggagagcgcaucaaacggaucaaggaggagcacaacuccacguggcacuacgaugacgagaaucccuauaaaaccugggcuuaccauggcucuuaugaagucaaggccacagggagcgcuuccagcaugauuaacggaguugugaagcuccugaccaaaccuugggacgugguccccauggugacacagauggccaugaccgauacaaccccguucggccagcaaagaguuuuuaaggagaaaguggacacgcgcaccccucgguccaugcccggcacaagacgcgucauggggaucaccgccgaauggcuguggcggacacucggaagaaauaagaaaccucgccuguguaccagagaggaguucacgaagaaggugcggacaaacgcggcuaugggcgccguuuuuaccgaggagaaucagugggauucugccaaagcugccguggaagacgaggauuucuggaaacuugucgaccgcgaaagagagcugcacaaacucgggaagugcggaagcuguguguacaacaugaugggcaaacgggagaagaaacugggggaauuuggcaaggcuaagggauccagagccauuugguauauguggcuuggcgcgcgguaccuggaguucgaagcccucggguuucugaaugaggaucauugguucucucgcgaaaacagcuacuccggaguugagggcgaggggcugcacaaacucggauauauccugagagacauuucuaagauccccggcggggcuauguacgccgaugacacagcuggcugggauacccggaucacggaagacgaccuucauaaugaggagaaaauuacccagcagauggauccugagcaccgccaacuggccaacgcgaucuuuaagcucacauaucagaauaaaguggucaaggugcagagacccaccccgacaggaaccgucauggacauuaucagccggaaggaucagcgcggcuccgggcaagugggaacauacggccugaacaccuucacgaauauggaagcccagcuuauuagacagauggagggggagggaguucugagcaaagcugaccucgaaaacccucaucugcccgagaagaaaaucacacaguggcuggaaaccaagggcguggagcggcucaaacgcauggccaucucuggggaugacugcgucgugaagcccauugaugacagauuugcuaacgcccugcuugcucugaaugauaugggcaaggugcggaaagacaucccucaauggcagccguccaagggauggcaugauuggcagcagguucccuucugcagccaccauuuccacgaacucauuaugaaagacggccgcaagcugguggucccuuguagaccccaagaugagcuuaucgggcgggcccgcauuucucagggagcgggcuggucccugagagagaccgccugccucgggaaggcuuaugcccagauguggagccugauguacuuucaccggagagaccugcgccucgccucuaacgcuaucuguuccgccgugccuguucauugggugcccacaagccggaccacaugguccauucacgcgcaucaccaauggaugacgaccgaagacaugcugacagucuggaauagaguguggaucgaggauaacccuuggauggaagacaagacccccgucacaaccugggagaaugugccguaucuuggaaagcgcgaggaucaguggugcggcagccugaucgggcucacgucucgggcuaccugggcccagaacauuccuacagccauccagcaaguuagaagccugauuggcaaugaagaguuccuugacuacaugcccuccaugaaacgcuuucggaaggaagaggaaucugagggagcuaucugguga

SEQ ID NO: 20404 - RNA, 9873 nt, Artificial Sequence
  derived and/or modified CDS sequence (opt5) from DENV-3__JF808129__SS-prME
accagccugugccucaugaugauucugcccgccgcucuugccuuccaccugacaucccgggacggagagccucggaugauuguggggaagaaugaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaagguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucacgggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagcugugugaccaccggcuuaugagcgcugccguuaaggaugagagagccgugcacgcugacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcggggccuaucagccagcacaaccaucgccccggauaucacacccaaacggcuggcccuuggcaccuugggaagcuggagcucgacuuuaauuacugcgagggaacaaccgugguuauuacagaaaacuguggcacccggggccccucucugagaacaaccacgguguccgggaaacugauccaugaguggugcugucgcagcugcacccuuccgccucuccgguauaugggagaagauggcuguugguacgggauggagaucagacccauuucugaaaaggaggagaauauggucaaaucccuggugagcgccggaucuggcaagguugacaacugcacaaugggggugcugugucucgccauccuguucgaagaugucaugcggggaaaguuuggcaaaaagcacaugauugcuggcguguucuucaccuuuguucuucugcucagcgggcagaucacauggcgcgacauggcccauacccugauuaugaucggauccaaugcgagcgauagaaugggcaugggggugacguaucuggcucuuauugccacauucaaaauccagcccuuucuggcccucggauucuuucugcggaagcucaccucuagagagaaccugcuucugggcgucgggcucgcuauggccacaacccugcaacugccugaagacaucgagcagauggcuaauggaauugcccuuggccugauggcgcucaaacugaucacccaguucgaaacauaccagcucuggacggcccugauuucccuuaccugcagcaacacaauguuuacccugacaguggcuuggcgcaccgccacgcucauccuggcuggcgugucccugcuuccggucugucaaucuagcuccaugcggaagacagauuggcugcccauggccguugccgcuaugggggugccuccccucccucuguucaucuuuucucucaaggacacccugaaaagacgcagcuggccccuuaaugagggagugauggcggucggccugguguccauccuggccucuagccuccugagaaacgauguuccuauggcugggccccuuguggccggaggccugcucaucgccugcuaugucauuaccgggacauccgcugaccugaccguggagaaggccgcggacaucacaugggaagaggaagcugagcagacgggaguuagccacaaccucaugaccacaguggaugacgauggcaccaugcggauuaaagacgaugaaacagagaauauccugaccguccuucugaagacggcccugaccauugugucuggcgucuucccguacuccaucccugccacacuccugguguggcauaccuggcagaaacagacacaacgcagcgggguucuuugggacgugcccucuccucccgagacccagaaggcugaacaggaggaaggagucuacagaaucaaacagcaaggcauuuuugggaagacacaggugggaguuggcgugcagaaggagggggucuuccacacgauguggcacgugacccggggagccgugcugacauauaacggcaaacgccucgagccgaauugggcguccguuaagaaagaucugaucagcuacggcgggggauggagacucucugcucaauggcagaagggcgaagagguccaggugauugccguggaaccugggaaaaaccccaagaauuuucagaccaugccuggaaccuuccaaacaacgaccggcgagaucggggccauugcucuggacuucaagcccggaacauccggcagccccaucauuaaccgggaaggcaaagucguggggcuuuauggaaauggcguugugaccaagaacgggggauacgucuccggcaucgcccagacaaaugcugagccugaugggccgacccccgagcuggaagaggaaauguuuaaaaagcgcaaccugacgaucauggaccuccauccuggcagcggaaaaacaagaaaguaucugcccgccauugugcgggaggcgaucaagcgcagacuucggacccugauucucgccccuaccagaguuguggcugccgaaauggaggaggcucugaaaggccuccccauccgcuaccagacaaccgccacaaagucugaacacaccgggcgggagauugucgaucugaugugucaugccacguucacaaugagacuucugagcccugugcgcguuccgaccuauaaucugaucaucauggacgaagcucacuuuacagaucccgcguccauugccgcucggggauacaucucuaccagagugggcaugggggaggccgccgcuauuuucaugacggccaccccucccggaacagcggacgcuuuuccucagagcaacgcccccauccaagacgaggaacgcgauauuccggagcgguccuggaacucuggcaacgaauggaucaccgacuucgccgggaaaacagucugguuugugccuagcaucaaggcuggcaaugauauugccaacugccuccgcaaaaacggaaagaaggugauccagcuguccagaaaaaccuucgacacagaguaccagaagaccaaacuuaaugauugggacuuugucguuacgacagauauuucugaaaugggcgcgaacuucaaggccgaccgggugaucgaucccagacggugccugaaacccgugauucucaccgacgggccugagcgcgucauccuggcuggacccaugccugugaccgccgcuagcgccgcucagagacggggccgcguugggagaaauccgcaaaaggagaacgaucaguauauuuuuacaggacagccccugaauaacgacgaagaccaugcccacuggaccgaggcgaagaugcuccuugauaauaucaacacaccugaaggcaucauucccgcccuguucgagccugaacgggagaaauccgcugccaucgacggggaguacagacugaagggcgaaagccgcaaaacguucguggagcucaugcggagaggagaucugcccgucuggcuugcucacaagguggccucugaaggcauuaaauauaccgaccgcaagugguguuuugaugggcagcggaauaaccaaauccuggaggaaaauauggacguugagauuuggacaaaagagggagaaaagaagaaacucagaccgcgcuggcuggaugcccggaccuacuccgacccucuggcucucaaggaguucaaagauuuugcggccggcagaaagagcaucgcucuugaccuggugacagaaaucgggcgcguccccucucaucuggcccacagaacccggaacgcccucgauaaucuggugaugcuucauacguccgagcacggaggccgcgcuuauagacacgccgucgaagaacucccugagaccauggaaacacuccugcugcucggccuuaugauucugcugaccgggggagcgaugcuguuccugaucagcggcaaagggauuggaaagacauccaucggccuuauuugcgugaucgccucuagcgggaugcuguggauggcugagaucccccuccaguggauugccuccgcuaucguucuggaauuuuucaugauggugcugcucauuccugagcccgagaagcagcggaccccgcaagacaaccagcuugccuacguggucaucggcauucugacgcuggcggccaucauugcugccaaugaaaugggccuccuggagacaaccaaacgcgaucuuggcaugagcaaggaaccugggguugugucucccacauccuaucuggacguggaccuccaucccgcuagcgccuggacccuguacgcugucgccaccacagugaucacgccuaugcugagacacaccaucgagaacucuacagcgaauguuagccucgccgcuauugccaaccaggcugugguccuuaugggacuggauaaaggcuggccgaucuccaagauggaccugggggugccccuccuggcccuuggauguuacucucaggucaacccucugacccucacagccgcggugcugcugcucauuacccauuaugcuaucauuggccccgggcuucaagccaaagcuacgcgggaagcccagaagagaacagccgcuggaaucaugaagaauccuaccguugauggcaucaugaccauugaccuggaucccgugaucuacgacagcaaauuugagaagcagcugggccaggucaugcuccuggugcuuugcgccguucaacugcuccugaugcgcacauccugggcgcugugugaggcccucacccuugcuacagggccuauuacgacccugugggaaggaucuccgggcaaauucuggaacacaaccaucgccgugagcauggcuaauauuuuucggggguccuaucuggccggagcgggccucgccuucagcaucaugaagucugucgggacaggaaaaagaggcaccggcucccagggggagacgcugggagaaaaguggaagaagaaacuuaaccagcugagccgcaaagaguuugaucucuacaagaaauccggcaucaccgaaguggaccggacagaggcuaaagaggggcugaaaagaggagaaauuacccaccaugccgugucucggggcagcgcuaagcugcagugguucguugagcgcaauauggucauccccgaagggagagugauugaucucggaugcggccggggcgggugguccuauuacugugccggacuuaagaaagugacagagguccgcggcuauaccaaagggggaccuggccacgaggagcccguuccuaugucuacauacggguggaacaucgugaaacugaugagcggaaaggacguguuuuaccugcccccggagaaaugcgauacccuccugugugacauuggcgaauccagcccuucucccacggucgaggaauccagaacaauccgggugcuuaagaugguugagcccuggcugaagaauaaccaauucugcauuaaagugcucaauccuuauaugcccaccgucaucgagcaccuggaacgccugcagagaaagcauggcgggaugcucgugcggaacccucuuagccgcaauucuacccacgagauguacuggaucuccaacggaacaggcaauauuguugcuagcgugaacauggucucuagacugcugcucaaucgguucacgaugacccauagacgcccgacaaucgaaaaagauguggaccugggggccggaacccggcacgugaacgcggagcccgaaacaccuaacauggacgucauuggcgagagaaucaagcgcaccaaagaggaacacaauagcacauggcauuaugaugacgagaaccccuacaagaccugggccuaucacggguccuacgaaguuaaggcuacgggaucugccagcuccaugauuaauggcguggugaaacuucugaccaagccuugggaugucgugcccaugguuacacagauggcuaugaccgacacaaccccguuuggccaacagcggguguucaaagagaaggucgauacgagaacaccucgcagcaugcccgggacccggagagugaugggaaucacagccgaauggcucuggcgcacccugggccggaacaaaaagccuagacuguguacgcgcgaggaguuuaccaagaaaguucggacaaaugccgcgaugggggcuguguucaccgaagagaaccagugggacuccgccaaggccgcugucgaagaugaggacuuuuggaaacucguggauagagaacgcgagcugcauaaacuuggaaaaugcggcucuugcguuuauaauaugauggggaagagagagaaaaagcugggcgaguucggaaaggccaaaggcagccgggcuaucugguacauguggcucggggcccgcuaccuggaguuugaagcgcuuggauuccugaacgaggaccacugguuuuccagagaaaauucuuauagcggcguggaaggggagggacuccauaagcugggcuacauucugcgggauaucuccaaaauucccgggggcgccauguaugcugacgacacagccggaugggauaccagaaucacagaagacgaucuccacaacgaggaaaagauuacccagcaaauggacccugagcaccggcagcuggcuaaugccaucuucaaacuuacguaccagaacaaggucgugaagguccagcgccccacaccgaccggcaccgugauggauaucauuucuagaaaagaccaacgggggagcggacagguuggcacauaugggcugaauaccuuuacaaacauggaggcgcagcucauccgccagauggaaggagagggcgugcuguccaaggccgaucuugaaaauccucaucugcccgagaaaaagauuacgcaauggcucgaaaccaaaggggucgagagacugaagcggauggcuaucagcggcgacgauuguguggugaagcccauugacgaucgcuucgccaacgcucugcucgcccugaacgacaugggaaaaguuagaaaggauaucccucaguggcagccgucuaaaggcuggcacgacuggcagcaagugcccuuuugcucccaucacuuccacgagcuuaucaugaaggacgggcggaaacuggucgugccuugucgcccccaggaugaacucauuggacgggcucggaucagccagggcgccggguggucucugcgcgagacagcgugccuuggaaaggccuacgcucaaauguggucccugauguauuuccauagacgggaccuccgccuggccagcaaugccauuuguucugcuguuccugugcacuggguccccaccuccagaacaaccuggagcauccaugcccaccaucaguggaugacgaccgaagauaugcugacaguguggaaccgggucuggauugaggacaauccuuggauggaagauaagacccccgugacaaccugggagaacguuccguaccucggcaaaagagaggaccaguggugcgggucccugaucggccuuacgagccgcgcgacaugggcucagaauauuccuaccgccauccaacaggugcggucucugaucggaaacgaagaguuucucgauuacaugcccagcaugaagagauuccgcaaagaagaggaguccgaaggcgccauuugguga

SEQ ID NO: 20405 - RNA, 9873 nt, Artificial Sequence
  derived and/or modified CDS sequence (opt5) from DENV-3__JF808123__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaccuggccacccuuagaaaacuguguaucgagggaaagauuacaaacaucaccacggauucccggugcccuacacaaggcgaagcggugcucccggaggaacaggaccagaauuauguguguaaacacaccuacgucgaucgcggcugggggaacggaugcggccuguucgggaagggaagccuugugaccugcgccaaguuucagugucugggccccauugaggggaaaguugugcaauaugagaaucucaaguacacagucaucaucaccgugcauacaggagaccagcaccagguuggcaacgaaacgcagggcgugaccgcugagauuacaccucaagccucuaccacagaagcuauccugcccgaguaugggacccugggacucgaaugcuccccuagaacgggccuggacuucaaugagaugauucuucugaccaugaaaaacaaggccuggaugguccaucggcagugguuuuucgaucucccccugccguggacaagcggggccaccacagagaccccuacguggaaucgcaaagaacuucuggugacauuuaagaacgcucacgcgaaaaagcaggaggucgugguucucggaucucaagaaggcgccaugcacaccgcucugacaggggccaccgagauccagaauuccggcggaaccagcauuuucgccggccaucugaaguguagacucaaaauggacaagcuggaacuuaaagggaugucuuacgcuaugugcacaaacacguuugugcugaagaaagaggucuccgagacccagcacggaacaauccucaucaagguggaauacaagggcgaggaugcccccuguaaaauuccuuucagcaccgaagacgggcagggaaaggcgcauaacggccggcugaucacagcuaaucccguugugaccaaaaaggaggagcccgucaacauugaagccgagccuccguucggggaauccaauaucgugauuggcacgggagauaacgcccugaaaaucaauugguauaagaagggcucuagcaucgggaaaauguuugaggcuacagccagaggagcucgccggauggccauucuuggcgacaccgcgugggauuucggguccgugggaggcguucucaacagccuggggaagaugguccaccaaaucuuuggcucugccuacaccgcucuguucuccggagugagcugggugaugaaaauuggcaucgggguccuccugacauggauuggacuuaauucuaagaacaccagcauguccuuuucuugcaucgccauuggcaucaucacacuguaucucggggcugugguucaggccgacaugggaugugugauuaauuggaaaggcaaggaacugaagugcgggagcggcaucuucgucacgaacgaggugcauaccuggacagagcaguacaaauuucaggcggauucccccaagagacuggccaccgcuauugccggagcuugggaaaauggcguuugugggauccgcagcacaacccggauggagaaccuucucuggaaacaaauugccaaugaacugaacuauauccugugggagaauaacaucaagcucacgguggucgugggagacauuaucggcguucuggaacaggggaaaagaacccuuacaccucagcccauggagcugaaguacucuuggaaaaccuggggaaaggccaagauugugacagcugagacccagaacuccagcuucaucauugauggcccuaauacacccgaaugcccgucugcgucccgcgccuggaacgucugggagguggaagacuauggcuuugggguguucaccacgaauaucuggcucaaacugcgggaggucuacacacaacugugugaccacagacuuaugagcgcugccguuaaggaugaacgcgccgugcacgcugacaugggauacuggaucgagucccagaaaaacggcucuuggaagcucgagaaagccagccugauugaagugaagaccugcaccuggccuaagucccauacacuguggucuaaugggguccucgagagcgauaugaucauucccaaaucccuggcgggaccuaucagccagcacaaccaucggcccggcuaucacacccagacggcugggccuuggcaccuuggaaagcuggaacucgacuuuaauuacugcgagggcacaaccgugguuauuacagagaacuguggcaccagagggcccucucugcgcacaaccacgguguccggaaaacugauccaugaauggugcugucggagcugcacccuuccgccucucagauauaugggcgaggauggguguugguacggaauggaaauccggcccauuucugagaaggaagagaauauggucaaaucccuggugagcgccggcucugggaagguugacaacuucacaaugggagugcugugccucgccauccuguuugaggaagucaugcgcggcaaguucggcaaaaagcacaugauugcugggguguucuuuaccuucguucuucugcucagcggacaaaucacauggagagauauggcccauacccugauuaugaucggcuccaaugcgagcgaccggauggggaugggagugacguaucuggcucuuauugccacauuuaaaauccagcccuuccuggcccucggcuuuuuccugagaaagcucaccucucgcgagaaccugcuucugggggucggacucgcuauggccacaacccugcagcugccugaagauaucgagcaaauggcuaauggcauugcccuuggccugauggcgcucaaacugaucacccaguuugaaacauaccagcucuggacggcccugauuucccuuaccuguagcaacacaauguucacccugacaguggcuuggcggaccgccacgcucauccuggcuggggugucccugcuuccggucugccagucuagcuccaugagaaagacagacuggcugcccauggccguugccgcuaugggagugccuccccucccucuguuuauuuucucucucaaggauacccugaaacgcagaagcuggccccuuaaugagggcgugauggcggucgggcugguguccauccuggccucuagccuccugcggaacgacguuccuauggcuggaccccuuguggccggcgggcugcucaucgccuguuaugucauuaccggaacauccgcugaucugaccguggagaaggccgcggacaucacaugggaagaggaagcugagcaaacgggcguuagccacaaccucaugauuaccguggacgaugacggcacaaugcgcaucaaagaugacgaaaccgagaauauucugacaguccuucugaagaccgcccugcucaucgugucuggggucuuuccguacuccaucccugccacgcugcuuguguggcauaccuggcagaaacagacacagagaagcggaguucugugggaugugcccucuccucccgagacccaaaaggcugaacucgaggaaggcgucuaccggauuaaacagcaggggaucuucggaaagacacaggugggcguuggggugcaaaaggagggagucuuucacaccauguggcacgugacacgcggcgccgugcugacguauaacggcaaaagacucgagccgaauugggcguccguuaagaaagaccugauuagcuacgggggaggcuggcggcuuucugcucaguggcagaagggggaagagguccaagugaucgccguggaaccuggaaaaaaccccaagaauuuccagaccaugccuggcacauuccagaccaccacaggggagauuggagccaucgcucuggauuuuaagcccggcacguccggcagccccauuaucaaccgcgaagggaaagucgugggacuguauggcaaugggguugugaccaagaacggaggcuacgucuccgggaucgcccagacaaaugcugagccugacggcccgacccccgagcucgaagaggaaauguucaaaaagagaaaccugacaauuauggaucuucauccuggaagcggcaaaacccggaaguaucugcccgccaucgugcgcgaggcgauuaagagacggcucagaacgcugauccucgccccuacacgcguuguggcugccgaaauggaggaggcucugaaagggcuucccauucgguaccaaaccaccgccacaaagucugaacacaccggaagagagaucgucgaccugaugugccaugccacauuuaccaugcgccugcucagcccugugcggguuccgaauuauaaccugaucauuauggaugaagcucacuucacggaccccgcguccaucgccgcuagaggcuacauuucuacacgcguggggaugggagaggccgccgcuaucuuuaugaccgccacaccucccggcaccgcggaugcuuucccucagagcaaugcccccauucaggacgaagagcgggacaucccggagagauccuggaacucugggaaugaauggaucacggauuuugccggcaaaaccgucugguucgugccuagcauuaaggcuggaaacgacaucgccaacugucuucgcaaaaauggcaagaaggugauucagcugucccggaaaacauuugauaccgaguaccaaaagacaaaacucaacgacugggauuucgucguuaccacagacaucucugaaaugggggcgaauuuuaaggccgauagagugauugacccccggcgcugccugaaacccgugauccugaccgauggaccugagagagucauucucgcuggccccaugccugugacggccgcuagcgccgcucagcggcgcgggagaguuggacggaacccgcagaaggagaaugaccaguauaucuucacaggccaaccccuuaacaaugaugaagaccaugcccacuggaccgaggcgaagaugcugcuggacaacaucaauaccccugaagggauuauccccgcccucuucgagccugaaagagagaaauccgcugccauugauggcgaguaccgccugaagggagaaagccggaaaacauuuguggagcuuaugagacgcggcgaccugcccgucuggcucgcucacaagguggccucugaagggaucaaauauaccgaucggaaguggugcuucgacggacagagaaacaaucagauucuggaggaaaacauggauguugagaucuggacaaaagagggcgaaaagaagaaacugcgcccgcgguggcucgacgccagaacguacuccgauccucuugcucugaaggaguuuaaagacuucgcggccgggcgcaagagcaucgcucuggaucucgugaccgaaauuggaagaguccccucucaucuggcccaccggacacgcaaugcccuugacaaccuggugaugcuccauaccuccgagcacggcggcagagcuuaucggcacgccgucgaagagcugccugagacaauggaaacccugcuccuucuggggcugaugauccuccugacgggaggcgcgaugcuuuuucugauuagcgggaaaggaaucggcaagaccuccauugggcucaucugugugaucgccucuagcggaaugcuguggauggcugagauuccccugcaguggaucgccuccgcuauuguucucgaauucuuuaugauggugcuucugaucccugagcccgagaagcaacgcacaccgcaggauaaucagcuggccuacguggucauuggcauccucacccuggcggccauuaucgcugccaacgaaaugggccuucuggagacaaccaaaagagaccucgggaugagcaaggaaccuggaguugugucucccacguccuaucuggauguggaccugcaucccgcuagcgccuggacacucuacgcugucgccaccacagugaucaccccuaugcuucggcacaccauugagaauucuacagcgaacguuagccuggccgcuaucgccaaccaagcugugguccugaugggccucgacaaaggguggccgauuuccaagauggaucugggagugccccuucuggcccucggcugcuacucucaggucaauccucugacgcugaccgccgcggugcuccuucugaucacacauuaugcuauuaucgggcccggacugcaggccaaagcuaccagagaagcccagaagcgcacagccgcuggcaucaugaagaacccuaccguugacggcauuaugacgaucgaucucgaccccgugauuuacgauagcaaauucgagaagcaacuggggcaggucaugcuucuggugcucugugccguucagcugcugcucaugcggacauccugggcgcuuugcgaggcccugacccuggcuaccggaccuaucacaacccucugggaaggcucuccggggaaauuuuggaauacaacgauugccgugagcauggcuaacaucuucagaggauccuaucuggccggcgcggggcuugccuuuagcaucaugaagucugucggaaccggcaaacgcggcacagggucccagggagagacccugggcgaaaaguggaagaaaaagcucaaucaacugagccggaaagaguucgaccuguacaagaaauccgggauuacagaaguggauagaaccgaggcuaaggagggacucaaacggggcgaaaucacgcaccaugccgugucucgcgggagcgcuaagcuucagugguuuguugagagaaacauggucauucccgaaggacgggugaucgaccugggcuguggccgcgggggaugguccuauuacugcgccggccugaagaaagugaccgaggucagaggguauacaaagggaggcccugggcacgaagagcccguuccuaugucuaccuacggauggaauauugugaaacucaugagcggcaaggauguguucuaccugcccccggagaaaugugacacacuucugugcgauaucggcgaauccagcccuucucccaccgucgaggaaucccggacaauucgcgugcucaagaugguugagcccuggcugaagaacaaucaguucuguaucaaagugcugaacccuuauaugcccaccgucaucgagcaccucgaaagacuucagcggaagcaugggggaaugcuggugcgcaauccucugagcagaaacucuacgcacgagauguacuggauuuccaauggcacagggaacaucguugcuagcgugaauauggucucucggcuccugcuuaacagauuuaccaugacccaucgccggccgacaauugaaaaagacguggaucugggagccggcacgagacacgugaacgcggagcccgaaaccccuaauauggacgucaucggggagcgcauuaagcggaucaaagaggaacacaacagcacauggcauuaugacgaugagaaucccuacaagaccugggccuaucacggauccuacgaaguuaaggcuacaggcucugccagcuccaugaucaacggcguggugaaacuccugaccaagccuugggacgucgugcccaugguuacacaaauggcuaugaccgauacgaccccguucgggcagcagagaguguuuaaagagaaggucgacacacgcaccccucggagcaugcccggaacaagacgcgugaugggcauuaccgccgaauggcuguggcggacgcucgggagaaauaaaaagccucgccugugcacacgggaggaguucaccaagaaaguuagaacaaacgccgcgaugggagcuguguuuaccgaagagaaucaaugggauuccgccaaggccgcugucgaagacgaggauuucuggaaacuuguggaccgcgaaagagagcugcauaagcucggcaaaugugggucuugcguuuauaacaugaugggcaagcgggagaaaaagcugggagaauuuggcaaggccaaagggagccgcgcuaucugguacauguggcuuggagccagauaccuggaguucgaagcgcucggcuuucugaaugaggaucacugguucucccgggagaacucuuauagcgggguggaaggagagggccugcauaagcucggguacauucugagagacaucuccaaaauucccggcggagccauguaugcugaugacacggccggcugggacacccggaucacagaagaugaccuucacaaugaggaaaagaucacccagcagauggauccugagcaccgccagcuggcuaacgccauuuuuaaacucacauaccaaaauaaggucgugaagguccagagacccaccccgacagggaccgugauggacaucauuucucggaaagaucagcgcggaagcggccagguugggacguauggacugaacacauucaccaauauggaggcgcaacuuaucagacagauggaaggcgagggggugcuguccaaggccgaccucgaaaacccucaucugcccgagaaaaagauuacccaguggcuggaaacaaaaggcgucgagcggcucaagcgcauggcuaucagcggagaugacugcguggugaagcccaucgaugacagauuugccaacgcucugcuugcccugaaugauaugggcaaaguucggaaggacauuccucaguggcaaccgucuaaaggguggcacgauuggcagcaggugcccuucuguucccaucacuuccacgagcucaucaugaaggacggacgcaaacuggucgugccuugcagaccccaggacgaacuuauuggccgggcucgcaucagccaaggggccggauggucucugagagagaccgcgugucucggcaaggccuacgcucagauguggucccugauguauuuucaucggcgcgaucugagacucgccagcaacgccauuugcucugcuguuccugugcacuggguccccacaucccggacgaccuggagcauccaugcccaccaucaguggaugacaaccgaagacaugcugacaguguggaauagagucuggauugaggauaacccuuggauggaagacaagacccccgugacgaccugggagaauguuccguaccuugggaaacgcgaggaucaaugguguggcucccugaucggacucacaagccgggcgaccugggcucagaacaucccuacagccauucagcaggugagaucucugaucggcaaugaagaguuccuugacuacaugcccagcaugaagcgcuuucggaaagaagaggaguccgaaggggccauuugguga

SEQ ID NO: 20406 - RNA, 9873 nt, Artificial Sequence
  derived and/or modified CDS sequence (opt5) from DENV-3__JF808128__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagcgcaccgaagcuacacaacuggccacccuuagaaagcuguguaucgagggaaaaauuacaaacaucaccacggauucccggugcccuacacagggcgaagcggugcucccggaggaacaggaccagaauuauguguguaagcacaccuacgucgaucgcggcugggggaacggaugcggccuguucgggaaaggaagccuugugaccugcgccaaguuucaaugucuggagcccauugagggcaagguugugcaguaugaaaaucucaaauacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaagaacaaagccuggaugguccaucggcagugguuucucgaucugccccuuccguggacaagcggcgccaccacagaaaccccuacguggaaucgcaaggagcugcucgugacauucaaaaacgcucacgcgaagaaacaagaagucgugguucuggggucucaggagggagccaugcacaccgcucugacaggcgccaccgaaauccagaauuccgggggcaccagcauuuuugccggacaucucaaguguagacugaagauggacaaacuugagcugaagggcaugucuuacgcuaugugcacaaacacguucgugcucaaaaaggaggucuccgaaacccagcacgggacaauccugaucaaaguggaguacaagggagaagaugcccccuguaagauuccuuuuagcaccgaggacggccaagggaaagcgcauaacggacggcugaucacagcuaaucccguugugaccaagaaagaggaacccgucaacauugaggccgaaccuccguucggcgaguccaauaucgugauugggaucggcgauaacgcccuuaagaucaauugguauaaaaagggaucuagcauuggcaagauguucgaagcuacggccagaggggcucgccggauggccauccucggagacacagcgugggauuuuggcuccguggggggaguucugaacagccugggcaaaaugguccaccagauuuucgggucugccuacaccgcucucuuuuccggcgugagcugggugaugaagaucggaauuggcguccugcuuaccuggaucgggcugaauucuaaaaacacaagcauguccuucucuugcauugccaucggaaucauuacccucuaucugggcgcugugguucaggccgacauggggugugugaucaauuggaagggaaaagagcugaagugcggcagcgggauuuuugucacaaacgaggugcauacguggaccgaacaguacaaguuccaagcggauucccccaaaagacuugccacagcuaucgccggcgcuugggagaauggaguuuguggcauucgcagcaccacacggauggaaaaccuccuguggaagcagaucgccaaugagcugaacuauauccucugggaaaauaacauuaaacugaccguggucgugggggacaucauuggaguucuugagcagggcaagagaacgcugaccccucagcccauggagcucaaauacucuuggaagacaugggggaaauccaagaucgugaccgccgaaacacaaaacagcucuuuuauuaucgauggaccuaauacccccgagugcccguccgcuagccgcgcguggaacgucugggaaguggaggacuauggcuucggcguguuuacaaccaauaucuggcugaagcugcgggaagucuacacgcagcuuugugaccacagacucauguccgccgcuguuaaagaugagcgcgccgugcacgccgacaugggguacuggauugagucucagaagaacggaagcuggaaacuggaaaaggcuucccugaucgaggugaaaacaugcaccuggccuaagucucauacccucuggagcaauggcguccuggaauccgauaugauuauccccaagagccuugccgggccuauuucucagcacaaccaucggcccggauaucacacacaaaccgcgggcccuuggcaccuggggaaacucgagcuggacuucaauuacugcgagggaacgacagugguuaucaccgaaaacuguggcacaagaggccccgcucugcgcaccacaaccguguccgggaagcuuauccaugaguggugcugucggagcugcacgcucccgccucugagauauaugggagaagauggcuguugguacgggauggagauucggcccaucucugaaaaagaggagaauauggucaagucccuggugagcgccggaucuggcaaaguugacaacuuuaccaugggggugcucugccuggccauucuuuucgaagaggucaugcgcggaaaguuuggcaagaaacacaugaucgcuggcguguucuucacauuuguucugcuccugagcgggcagauuaccuggagagauauggcccauacacugaucaugauuggauccaaugcgagcgaccggaugggcaugggggugaccuaucuugcucugaucgccacguucaagauccagcccuuucucgcccugggauucuuucucagaaaacugacaucucgcgaaaaccuucugcucggcgucgggcuggcuauggccaccacacugcaacuuccugaggauauugaacagauggcuaauggaaucgcccugggccucauggcgcugaagcucauuacccaguucgagaccuaccagcuguggacagcccuuaucucccugacguguagcaacaccauguuuacacucaccguggcuuggcggacagccacccugauucuggcuggcgugucccuucugccggucugccaaucuagcuccaugagaaaaacggacuggcuccccauggccguugccgcuaugggggugccuccccugccucucuucaucuuuucucugaaggauacacuuaagcgcagaagcuggccccugaaugagggagugauggcggucggccugguguccauccucgccucuagccugcuucggaacgacguuccuauggcugggccccugguggccggaggccuccugauugccuguuaugucaucaccgggaccuccgcugaucucacaguggaaaaagccgcggacauuaccugggaggaagaggcugaacagacaggaguuagccacaaccugaugaucacgguggacgaugacggcaccaugcgcauuaaggaugacgagacagagaauauccuuaccguccugcugaaaacagcccuccugaucgugucuggcgucuucccguacuccauuccugccacccuucugguguggcauacguggcagaagcagacccaaagaagcgggguucucugggaugugcccucuccucccgaaacacagaaagcugagcuggaagagggagucuaccggaucaagcagcagggcauuuuugggaaaacccaagugggaguuggcgugcagaaggagggggucuuccacacaauguggcacgugacccgcggagccgugcucacauauaacggcaagagacuggaaccgaauugggcguccguuaaaaaggaccuugucagcuacggcgggggauggcggcugucugcucaguggcaaaaaggcgaggaagugcaggugaucgccgucgagccugggaagaaccccaaaaauuuucagacgaugccuggaaccuuccagacaaccaccggcgaaauuggggccaucgcucuggauuucaagcccggaacauccggcagccccauuaucaaccgcgagggcaaggugguugggcucuauggaaauggcguggucacgaaaaacgggggauacguguccggcaucgcccaaaccaaugcugagccugacgggccgacacccgaacuggaggaagagauguuuaagaaaagaaaccuuaccauuauggaucugcauccuggcagcggaaagacacggaaauaucuccccgccaucguucgcgaagcgauuaagagacggcugagaacccucauccuggccccuacgcgcguggucgcugccgagauggaggaagcucuuaagggccugcccauucgguaccagacaaccgccaccaaaucugagcacacagggagagaaaucguggaccugaugugccaugccaccuucacaaugcgccuccugagcccuguucgggugccgaauuauaaccuuaucauuauggaugaggcucacuuuaccgaccccgcguccaucgccgcuagaggauacauuucuacgcgcgucggcaugggggaagccgccgcuaucuucaugacagccaccccucccggaacagcggaugcuuuuccucagagcaaugcccccauucaggacgaggagcgggacaucccggaaagauccuggaacucuggcaaugaguggaucaccgauuucgccgggaagacggugugguuugugccuagcauuaaagcuggcaacgacaucgccaacugucugcgcaagaauggaaaaaaggucauucaacucucccggaagaccuucgauacagaauaccagaaaaccaagcugaacgacugggauuuuguugugacaaccgacaucucugagaugggcgcgaauuucaaagccgauagagugauugacccccggcgcugccugaagcccgucauccucacagaugggccugagagagugauucuugcuggacccaugccuguuaccgccgcuagcgccgcucagcggcgcggcagaguggggcggaacccgcagaaagaaaaugaccaauauaucuuuacgggacagccccugaacaaugaugaggaccaugcccacuggacagaagcgaagaugcugcucgacaacaucaauaccccugagggcauuauccccgcccuguucgaaccugagagagagaaguccgcugccauugauggggaauaccgccuuaaaggcgagagccggaagaccuucgucgaacugaugagacgcggagaccuccccguguggcuggcucacaaaguugccucugagggcaucaaguauacagaucggagauggugcuuugacgggcagcgcaacaaucagauucuggaagagaacauggauguggagaucuggaccaaagaaggagagaagaaaaagcuccggccgagauggcuugacgcccgcacauacuccgauccucuggcucugaaggaauucaaagacuuugcggccggcagaaagagcaucgcucucgaucuggucacggagauugggcgggugcccucucaucuugcccaccgcaccagaaaugcccuggacaaccucgucaugcugcauacauccgaacacggaggccgggcuuaucgccacgccguggaggagcugccugaaaccauggagacacuccuucugcugggccucaugauccugcuuaccgggggagcgaugcuguuccucauuagcggcaaagggaucggaaagacguccauuggccugaucuguguuaucgccucuagaagcauguccuggauggcugaaauuccccugcaauggaucgccagcgcuauugugcucgaguuuuucaugauggugcuucugaucccugagcccgaaaaacagcggaccccgcaggauaaucaacuggccuacgucguuauugggauccucacacuggcggccauuaucgcugccaacgagaugggacuucuggaaaccacaaagagagaccucggcaugucuaaggagccuggcguggugucccccaccagcuaucuggaugucgaccugcaucccgcuucugccuggacgcucuacgcuguggccacaaccguuaucacaccuaugcuucgccacaccauugaaaauagcaccgcgaacgugucccuggccgcuaucgccaaccaggcugucgugcugauggggcucgacaaaggauggccgauuucuaagauggaucugggcgucccccuucuggcccucgggugcuacagccaggugaauccucugacacugacggccgcgguucuccuucugaucacccauuaugcuauuaucggacccggccugcaggccaaagcuacacgggaggcccaaaagagaaccgccgcugggaucaugaaaaacccuacaguggacggaauuaugaccaucgaucucgaccccgucauuuacgauuccaaguuugagaagcagcugggccaggugaugcuucugguucucugugccgugcagcugcugcucaugcgcacgucuugggcgcuuugcgaagcccugacacuggcuaccggcccuaucaccacacucugggaggggagcccgggaaaauucuggaauaccacaauugccgucuccauggcuaacaucuuucggggcagcuaucuggccggggcgggacuugccuucucuaucaugaaguccgugggcacggggaaaagaggaaccggcagccaaggcgaaacacugggggagaaguggaaaaagaagcucaaucagcugucccggaaagaauuugaccuguacaagaaaucuggaauuaccgagguggaucgcacagaggcuaaggaaggccucaaaagaggggagaucacccaccaugccguuagccggggauccgcuaagcuucagugguucgucgaacgcaacauggugauucccgagggcagagugaucgaccugggguguggacggggcggcuggucuuauuacugcgccgggcugaaaaaggucacggaaguucgcggauauaccaagggcgggccuggacacgaggagcccgugccuaugagcacauacggcuggaauauugugaaacucauguccgggaaggaugucuuuuaccugcccccggaaaaaugugacacccuucugugcgauaucggagagagcucuccuucccccacaguggaagagagcagaaccauucggguucucaagaugguggagcccuggcugaaaaacaaucaguucuguaucaagguccugaacccuuauaugcccacagugaucgaacaccucgagcgccuucaaagaaagcauggcggcaugcugguucggaauccucugucuagaaacuccacccacgaaauguacuggauuagcaaugggacgggaaacaucguggcuucugucaauauggugagccgccuccugcuuaaccgguucacaaugacccauagacgcccgaccauugagaaagacguggaucugggcgccgggacacggcacgucaacgcggaacccgagacgccuaauauggacguuaucggagagagaauuaagcgcaucaaagaagagcacaacuccaccuggcauuaugacgaugaaaaucccuacaagacaugggccuaucacggcucuuacgaggugaaagcuaccgggagcgccuccagcaugaucaacggaguggucaagcuccugacaaagccuugggacgugguucccauggugacccagauggcuaugacagauaccacgccguuuggccagcaacgggucuucaaagaaaagguggacaccagaacaccucgcuccaugcccggcacccggagaguuauggggauuacagccgaguggcuguggcgcacccucggacggaauaaaaagccuagacugugcacgcgcgaggaauuuacaaaaaaggugagaaccaacgccgcgaugggcgcugucuucacagaggaaaaucagugggauucugccaaggccgcuguggaggacgaagauuuuuggaaacuuguugaccgggagcgcgagcugcauaagcucgggaaauguggaagcugcguguauaacaugaugggcaagagagaaaaaaagcugggggaguucggcaaagccaagggaucccgggcuaucugguacauguggcuuggcgccagauaccuggaauuugaggcgcucggguuccugaaugaggaucacugguuuucucgggaaaacagcuauuccggagucgagggcgaagggcugcauaagcucggauacauucugcgcgacaucucuaaaauucccggcggggccauguaugcugaugacaccgccggcugggacacgagaaucaccgaggaugaccuucacaaugaagagaagaucacacagcagauggauccugagcaccggcaacuggcuaacgccauuuucaaacucaccuaccagaauaagguggucaaagugcagcgccccacaccgaccggaacaguuauggacaucauuagcagaaaggaucagcggggcuccgggcaagugggaaccuauggccugaacacguuuacaaauauggaagcgcagcuuauccgccagauggagggggaaggaguccugagcaaggccgaccucgagaacccucaucugcccgaaaaaaagauuacccaguggcuggagaccaaaggcguggagagacucaagcggauggcuaucucuggggaugacugcgugguuaaacccaucgaugaccgcuucgccaacgcucugcuugcccugaaugauaugggcaaggugagaaaggacauuccucaauggcagccguccaaaggauggcacgauuggcagcagguccccuuuuguagccaucacuuccacgaacucaucaugaaggacggccggaaacuggugguuccuugccgcccccaagacgagcuuauugggagagcucggaucucucagggagccggcuggucccugcgcgaaacagcgugucucgggaaggccuacgcucagauguggagccugauguauuuccauagacgggaucugagacucgccucuaacgccauuugcuccgcugugccuguccacugggugcccaccagccgcacaacgugguccauccaugcccaccaucaauggaugaccacagaggacaugcugaccgucuggaaucggguguggauugaagauaacccuuggauggaggacaaaacacccguuaccacgugggagaaugugccguaccuuggaaagagagaagaucagugguguggcagccugaucgggcucaccucucgcgcgacaugggcucagaacaucccuaccgccauucagcaaguccggagccugaucggcaaugaggaauuucuugacuacaugcccuccaugaagagauuccgcaaagaggaggaaucugagggagccauuugguga

SEQ ID NO: 20407 - RNA, 9873 nt, Artificial Sequence
  derived and/or modified CDS sequence (opt5) from DENV-3__JF808122__SS-prME
accagccugugccucaugaugauccugcccgccgcucuugccuuccaccugacauccagagacggagagccucggaugauuguggggaagaaugaacgcggaaaaucucuccuguuuaagacggcgagcggcaucauuaaauguacccuuaucgcuauggaucugggggagaugugcgacgauaccgugaccuacaaguguccgcauauuacagaaguugagcccgaagacaucgauugcugguguaaucucaccuccacaugggugaccuauggaacgugcaaccaggccggcgagagacggcgcgacaaaagaucuguggcccuggcuccucacgucgggaugggacuggauacccggacacagaccuggaugagcgccgagggcgcuuggcgccagguggaaaagguugagacaugggcccucagacaucccggcuucaccauccuggcgcuuuuucuggcccacuacauugggacgucccucacacagaagguggucaucuucauucugcuuaugcuggugaccccuucuaugacaaugcgguguguuggagugggcaaucgcgacuuugucgaagggcucagcggagcuaccuggguggaugugguccuggagcauggcgggugcguuaccacaauggccaaaaacaagcccacgcuggacaucgagcuccagaaaaccgaagcuccucaccuggccacacuuagaaagcuguguauugagggaaaaaucaccaauauuacaaccgauucccggugcccgacgcaaggcgaagcggugcuccccgaggaacaggaccagaacuauguguguaagcacacauacgucgaucgcggcugggggaauggaugcggccuguucgggaagggaagccuugugaccugcgccaaauuucagugucuggagccuaucgagggcaagguugugcaauaugaaaaccucaaauacaccgucaucauuacagugcauaccggggaccagcaccagguuggaaaugagacacagggcgugacggcugaaaucacaccccaggccucuacaaccgaggcuauucugccugaauauggcacacuggggcucgagugcucccccagaaccggacuggacuucaacgagaugauccuucugacgaugaagaauaaagccuggaugguccaucggcagugguuuuucgaucucccgcugccuuggaccagcggcgccacaaccgaaacacccaccuggaaccgcaaggagcuucuggugacguuuaaaaaugcucacgcgaagaagcaggaagucgugguucucgggucucaagagggagccaugcacacagcucugaccggcgccacagaaauucagaacuccgggggcaccagcaucuucgccggacaucugaaauguagacucaagauggacaaacuggagcuuaagggcaugucuuacgcuaugugcaccaauacauuugugcugaaaaaggaggucuccgaaacgcagcacgggaccauccucauuaagguggaguacaaaggagaagaugccccuuguaagauccccuucagcacagaggacggccaggggaaagcgcauaacggacggcugauuaccgcuaaccccguugugacaaagaaagaggaaccugucaauaucgaggccgaaccgcccuucggcgaguccaacauugugaucgggaccggcgauaaugcccugaagaucaacugguauaagaaaggaucuagcauuggcaagauguuugaagcuacggccagaggggcucgccggauggccauccuuggagacacagcgugggauuucggcuccgucgggggaguucucaauagccugggcaaaaugguccaccaaauuuuugggucugccuacaccgcucuguucuccggcgugagcugggugaugaagaucggaauuggcguccuccugaccuggaucgggcuuaacucuaaaaauacaagcauguccuuuucuugcauugccaucggaaucauuacccuguaucucggcgcugugguucaggccgacauggggugugugaucaacuggaagggaaaggagcugaaaugcggcagcgggauuuucgucacaaaugaggugcauacguggaccgaacaguacaaguuucaggcggauuccccuaaaagacuggccacagcuaucgccggcgcuugggagaacggaguuuguggcauucgcagcaccacacggauggaaaaucuucucuggaagcaaaucgccaacgagcugaauuauauccugugggaaaacaauauuaaacucaccguggucgugggggacaucauuggaguucuggagcagggcaagagaacgcuuacaccccaaccuauggagcugaaauacucuuggaagaccugggggaaggccaaaaucgugaccgcugaaacacagaacuccagcuucauuaucgauggacccaacaccccggagugcccuucugcgucccgcgccuggaaugucugggaaguggaggacuauggcuuuggcguguucacaaccaacaucuggcucaagcugcgggaagucuacacgcaacugugugaccacagacuuaugagcgcugccguuaaagaugagcgcgccgugcacgcugacaugggguacuggauugagucccagaagaauggaucuuggaaacucgaaaaggccagccugaucgaggugaagacaugcaccuggcccaaaucccauacccuguggucuaacggcguccucgaaagcgauaugauuaucccuaagucccuggcggggcccauuagccagcacaaucaucggccuggauaucacacacagaccgcuggccccuggcaccuugggaaacuggagcucgacuuuaacuacugcgagggaacgacagugguuaucaccgaaaauuguggcacaagaggcccgucucugcgcaccacaaccguguccgggaagcugauccaugaguggugcugucggagcugcacgcuuccuccccucagauauaugggagaagauggcuguugguacgggauggagauucggcccaucucugaaaaagaggagaacauggucaagucccuggugagcgccggaucuggcaagguugacaauuucaccaugggggugcugugccucgccauucuguuugaagaggucaugcgcggaaaauucggcaagaaacacaugaucgcuggcguguucuuuacauucguucuucugcucagcgggcaaauuaccuggagagauauggcccauacacugaucaugauuggauccaacgcgagcgaccggaugggcaugggggugaccuaucuggcucuuaucgccacguuuaagauccagccuuuccuggcccucggauuuuuccugagaaaacucacaucucgcgaaaaucugcuucugggcgucgggcucgcuauggccaccacacugcagcugccggaggauauugaacaaauggcuaacggaaucgcccuuggccugauggcgcucaagcugauuacccaguuugagaccuaccagcucuggacagcccugaucucccuuacguguagcaauaccauguucacacugaccguggcuuggcggacagccacccucauucuggcuggcgugucccugcuucccgucugccagucuagcuccaugagaaagacggacuggcugccuauggccguugccgcuaugggggugcccccucucccccuguuuaucuucucucucaaagauacacugaagcgcagaagcuggccucuuaacgagggagugauggcggucggccugguguccauccuggccucuagcuuucuccggaaugacguucccauggcugggccgcugguggccggaggccuucugauugccuguuaugucaucaccgggaccuccgcugaucucacaguggaaaaagccgcggacauuaccugggaggaagaggcugaacaaacaggaguuagccacaaccugaugaucacgguggacgaugacggcaccaugcgcauuaaggaugacgagacagagaacauccucaccguccugcuuaaaacagcccugcugaucgugucuggcgucuucccuuacuccauucccgccacccuccugguguggcauacguggcagaagcagacccagagaagcgggguucuuugggaugugccuucucccccggaaacacaaaaagcugagcuggaagagggagucuaccggaucaagcagcagggcauuuuugggaagacccaggugggaguuggcgugcaaaaagagggggucuuccacacaauguggcacgugacccgcggagccgugcucacauauaauggcaagagacuggaaccuaacugggcguccguuaaaaaggaccucaucagcuacggcgggggauggcggcugucugcucaguggcagaaaggcgaggaaguccaagugauugccguggagcccgggaagaauccuaagaacuuccagacgaugcccggaaccuuucagacaaccaccggcgaaaucggggccauugcucuugauuucaaacccggaacauccggcagcccuaucaucaaucgcgagggcaaggucguggggcuguauggaaacggcguugugacgaaaaaugggggauacgucuccggcauugcccagaccaacgcugagccggacgggcccacaccugaacuggaggaagagauguuuaagaaaagaaaucucaccaucauggaucugcaucccggcagcggaaagacacggaaguaucuuccugccauugugcgcgaagcgaucaaaagacggcugagaacccucauucuggcccccacgcgcguuguggcugccgagauggaggaagcucucaagggccugccuauccgguaccaaacaaccgccaccaaaucugagcacacagggagagaaaucgucgaccuuaugugccaugccaccuucacaaugcgccugcugagcccggugcggguucccaacuauaaucucauuaucauggaugaggcucacuuuaccgacccugcguccauugccgcuagaggauacaucucuacgcgcgugggcaugggggaagccgccgcuauuuucaugacagccacacccccuggaacagcggaugcuuuuccccagagcaacgccccgauccaggacgaggagcgggacaucccugaaagauccuggaacucuggcaacgaguggauuaccgauuucgccgggaagacggucugguuugugcccagcaucaaagcuggcaaugacauugccaacugucugcgcaagaacggaaagaaagugauccagcuuucccggaagaccuucgauacagaauaccagaagaccaagcugaaugacugggauuuugucguuacaaccgacauuucugagaugggcgcgaacuucaaagccgauagagugaucgacccccggcgcugccucaagccugugauucugacagaugggcccgagagagucauccuggcuggaccuaugccggugaccgccgcuagcgccgcucagcggcgcggcagaguugggcggaauccccagaaggaaaacgaccaguauaucuucacgggacaaccucucaauaacgaugaggaccaugcccacuggacagaagcgaaaaugcuucuggacaauauuaacacccccgagggcaucauuccugcccuguuugaacccgagagagagaaguccgcugccaucgauggggaauaccgccucaaaggcgagagccggaagaccuucguggaacugaugagacgcggagaccuuccggucuggcuggcucacaaaguggccucugagggcauuaaguauacagaucggaaauggugcuuugacgggcagagaaauaaccagauccucgaagagaauauggauguugagaucuggaccaaggaaggagagaagaaaaagcugcgcccucgguggcuggacgccagaacauacuccgauccccucgcucuuaaagaguucaaggacuuugcggccggccgcaaaagcauugcucuggaucuggugacggagaucgggagagucccuucucaucucgcccaccggacccgcaacgcccuggacaaucuugugaugcugcauacauccgaacacggaggcagagcuuaucggcacgccgucgaggagcuccccgaaaccauggagacacugcugcuccuuggccugaugauucugcucaccgggggagcgaugcuguuccuuaucagcggcaaggggauuggaaagacguccaucggccugaucugugugauugccucuagcgggauguccuggauggcugaaaucccucuccaguggauugccagcgcuaucguucuggaguuuuucaugauggugcugcucauucccgagccggaaaaacaacgcaccccucaggauaaccagcuugccuacguggucaucggcauucugacacuggcggccaucaucgcugccaaugagaugggccuccuggaaaccacaaagagagaccuuggcaugucuaaagagcccgggguugugucccccaccagcuaucuggauguggaccuccauccugcuucugccuggacgcuguacgcugucgccacaaccgugauuacaccgaugcugcggcacaccaucgaaaacagcaccgcgaauguuucccucgccgcuauugccaaccaagcugugguccuuaugggacuggacaagggcuggcccaucucuaaaauggaucugggggugccucuccuggcccuuggaugcuacagccaggucaacccccugacacucacggccgcggugcugcugcucauuacccauuaugcuaucaucggcccugggcuucaggccaaggcuacaagagaggcccagaagcgcaccgccgcuggaauuaugaaaaaucccacaguugacggcaucaugaccauugaucuggacccugugaucuacgauuccaaguuugagaaacaacugggccaggucaugcuccuggugcuuugugccguucagcugcuccugaugcggacgucuugggcgcugugcgaagcccucacacuugcuaccgggccgauuaccacacugugggagggaagccccggcaaguucuggaacaccacaaucgccguguccauggcuaauaucuuuagagggagcuaucuggccggagcgggccucgccuucucuauuaugaaauccgucgggacgggaaagcgcggcaccggcagccagggggaaacacugggagagaaguggaaaaagaaacuuaaccaacugucccggaaggaauuugaccucuacaaaaagucuggcaucaccgagguggauagaacagaggcuaaagaagggcugaagcggggagagauuacccaccaugccgugagccgcggcuccgcuaagcugcagugguucguugaaagaaauauggucaucccugaggggcgggugauugaccucggauguggccgcggcggguggucuuauuacugcgccggacuuaaaaaggugacggaagucagaggcuauaccaaagggggacccggccacgaggagccuguucccaugagcacauacggguggaacaucgugaagcugauguccggaaaagauguguucuaccugccgccugaaaagugugacacccuccugugcgauauuggcgagagcucucccucccccacagucgaagagagccggaccauccgcgugcuuaagaugguugagccuuggcugaaaaauaaccaguuuuguaucaaggugcucaaucccuauaugccuacagucauugaacaccuggagagacugcagcggaaacauggcgggaugcucgugcgcaacccgcuuucuagaaauuccacccacgaaauguacuggaucagcaacggaacgggcaauauuguugcuucugugaacauggucagccggcugcugcucaauagauucacaaugacccaucgccggcccaccaucgagaaggacguggaucugggggccggaacaagacacgugaacgcggaaccugagacgcccaacauggacgucauuggcgagcgcaucaaacggaucaaggaagaacacaauuccaccuggcauuaugacgaugaaaacccuuacaagacaugggccuaucacgggucuuacgagguuaaagcuaccggaagcgccuccagcaugauuaauggcguggugaaacuucugacaaaacccugggacgucgugccgaugguuacccaaauggcuaugacagauaccacgccuuuuggccagcagagaguguucaaggaaaaagucgacacccgcacaccccgguccaugccugggaccagacgcgugaugggaaucacagccgaguggcucuggcggacccugggcagaaacaagaagccccgccugugcacgcgggaggaauuuaccaagaagguuagaaccaaugccgcgaugggggcuguguucacagaggaaaaccaaugggauucugccaaagccgcugucgaggacgaagauuuuuggaagcucguggaccgcgagagagagcugcauaaacuuggaaaguguggcagcugcguuuauaauaugauggggaaacgggaaaagaagcugggcgaguucggaaaagccaacggcucccgcgcuauuugguacauguggcucggggccagauaccuggaauuugaggcgcuuggauuccugaaggaguaucacugguuuucucgggaaaauagcuacuccggcguggagggggaaggacuccauaaacugggcuauauccugagagauauuucuaagaucccugggggcgccauguacgcugacgauaccgccggaugggacacgcggaucaccgaggacgaucuccacaacgaagagaaaauuacacagcagauggaccccgagcaccgccagcuggcuaaugccaucuucaaacuuaccuaucaaaacaaggucgugaaaguccagagaccgacaccuaccggcacagugauggauauuaucagccggaaggaccagcgcggguccggacagguuggcaccuacgggcugaauacguuuacaaacauggaagcgcaacucauuagacagauggagggagaaggcgugcugagcaaagccgaucuugagaauccccaucugcccgaaaagaaaaucacccaguggcucgagaccaagggggucgagcggcugaagcgcauggcuaucucuggcgacgauugcguggugaaaccuauugacgauagauucgccaacgcucugcucgcccugaacgacacaggaaagguucggaaagauaucccgcaguggcaacccuccaagggcuggcacgacuggcaacaggugccuuucuguagccaucacuuucacgaacuuauuaugaaagaugggcgcaagcuggucgugcccugcagaccucaggacgagcucaucggacgggcucgcauuucucaaggcgccggguggucccugagagaaaccgcgugucuuggaaaggccuaugcucagauguggagccugauguacuuccaucggcgcgaccucagacuggccucuaaugccaucugcuccgcuguucccgugcacugggucccuacaagccggacgaccugguccauucaugcccaccaucaguggaugacaaccgaggauaugcugacaguguggaacagagucuggaucgaagacaaucccuggauggaggauaaaaccccggugacgaccugggagaacguuccuuaccucggcaagcgcgaagaccaauggugugggagccugaucggccuuacaucucgggcgaccugggcucagaauauucccacagccauccaacaggugagaagccugauuggaaacgaggaauuucucgauuauaugccuuccaugaaacgcuuccggaaggaggaggaaucugagggcgccaucugguga

SEQ ID NO: 20408 - RNA, 9873 nt, Artificial Sequence
  derived and/or modified CDS sequence (opt5) from DENV-3__GQ466079__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccuucuuuaucauugauggaccuaauacacccgagugcccgagcgcgucuagagccuggaacgucugggaaguggaggacuauggcuucggcguguuuaccacgaauaucuggcucaaacugcgcgaagucuacacacagcugugugaccaccggcuuauguccgcugccguuaaggaugagagagccgugcacgcugacaugggguacuggaucgagagccagaaaaacggauccuggaagcucgaaaaagccucucugauugaggugaagaccugcaccuggccuaagagccauacacugugguccaauggcguccucgaaucugauaugaucauucccaaaagccuggcggggccuaucucccagcacaaccaucgccccggauaucacacccaaacggcuggcccuuggcaccuugagaaucuggagcucgacuucacauacugcgaagggaccacagugguuauuaccgagaacuguggaacacggggccccagccugagaaccacgaccgugucuggcaagcugauccaugaauggugcugucgcuccugcacacuuccgccucuccgguauaugggggaggauggauguugguacggcauggaaaucagacccauuagcgagaaagaggaaaauauggucaagucucugguguccgccgggagcggaaaaguugacaacuuuaccaugggcauccugugccucgccauucuguucgaggaagugaugcgggggaaguucggaaagaaacacaugaucgcuggcgucuuuuucacauuugugcuucugcucucuggccagauuaccuggcgcgauauggcccauacgcugaucaugauugggagcaaugcguccgacagaaugggaaugggcguuacauaucuggcucuuaucgccaccuucaagauccagcccuuucuggcccucggguucuuucugcggaaacucacaagcagagagaaccugcuucugggagugggccucgcuauggccaccacccugcaacugccugaagauauugagcagauggcuaaugggaucgcccuuggacugauggcgcucaagcugauuacacaguucgagacguaccagcucuggaccgcccugaucucucuuacauguuccaacaccauuuuuacacugaccgucgcuuggcgcacggccacacucauccuggcuggcgugagccugcuuccggugugccaauccucuagcaugcggaaaaccgacuggcugcccaugaccgucgccgccaugggcguuccuccccucccucuguucaucuuuucccucaaggauacacugaagagacgcucuuggccccuuaaugaaggggugauggcugugggacuggucagcauucuggcguccucucuccugagaaacgacgugccuauggccggcccccuuguugcugggggacugcucaucgccuguuaugugauuaccggcacaagcgccgaucugacggucgagaaagcugccgacgugaccugggaagaggaagcggagcagacagggguuucccacaaccucaugaucaccguggacgaugacggaacaaugcggauuaaggaugacgagaccgaaaauauccugacgguccuucugaaaaccgcucugcucaucgugagcggcauuuucccguacucuaucccugccacacugcuugucuggcauaccuggcagaagcagacacaacgcuccggcgugcugugggauguucccagcccucccgagacccagaaagccgaacucgaggaggggguguacagaauuaagcagcagggaauccugggcaaaacacaagucggggugggaguucagaaggaaggcguguuucacacgauguggcacgucaccagaggggcugugcucacacauaacggaaagcgccuggagccgaauugggccucugugaaaaaggaccuuauuuccuauggcggcggguggagacugagcgcgcaguggcaaaaaggagaagagguucaggucaucgcuguggaaccuggcaagaaccccaaaaauuuccagaccaugccugggaccuuccagacaacgaccggagagauuggcgccaucgcccuggauuuuaagcccgggacaucuggaucccccaucauuaaccgggagggcaagguggucggccucuacgggaauggagugguuaccaaaaacggcggguaugugagcggaaucgcucaaacaaaugccgaaccugacggcccgacccccgagcuggaagaggaaauguucaagaaacgcaaccuuacgauuauggaucugcacccuggguccggcaagacaagaaaauaccuccccgcuaucguccgggaggccauuaagcgcagacugcggacccucauccuggcgccuaccagagugguugccgcugagauggaagaggcccuuaagggacugcccauccgcuaucagacaaccgcuacaaaaagcgaacauaccggccgggagauuguggaccugaugugccacgccacguuuacaaugagacuccugucuccuguccgcgugccgaauuacaaccuuaucauuauggaugaagcccauuucaccgaccccgcuagcaucgcggcccggggguauauuuccacaagaguuggaaugggcgaggcugccgccaucuuuaugucugcuaccccucccgggacggccgaugcguucccucagagcaaugcucccauccaggacgaggaacgcgacauuccggagcgguccuggaacucuggaaaugaauggaucaccgauuuugccggcaagacagugugguucgucccuagcauuaaagccgggaacgacaucgcuaacugucugagaaagaauggcaaaaaggugauucaacucucccgcaagaccuuugauacagaguaccagaaaaccaagcugaacgacugggauuucguggucacaaccgacaucucugagaugggagccaauuuuaaagcggaucggguuauugaccccagacggugccugaagcccgugauccucacggauggcccugaacgcgugauccuugccgggcccaugccugucacagcugccagcgcugcccagagacggggacgcgugggcagaaacccgcagaaagagaaugaccaauacauuuucaccgggcagccccugaacaaugaugaagaccacgcucacuggaccgaggccaagaugcugcucgacaacaucaauacaccugaaggaauuauccccgcgcuguucgagccugagcgggaaaaguccgccgcuauugauggcgaguauagacuuaaaggggaaagccgcaagaccuuuguugagcugaugcggagaggcgaccuccccguguggcuggcccauaaagucgcuucugaaggaaucaaguacacagaucgcaaauggugcuucgacggccagcggaacaaucagauccuggaggagaacauggauguggaaauuuggacgaaggagggggagaagaagaagcucagaccgcgcuggcuugacgcccggaccuauuccgauccucuggcccugaaagaguuuaaggacuucgcugcgggaagaaaaagcaucgcccucgaucugguuacagaaauuggccgcgugcccucucaccuugcucauagaacccggaaugcccuggacaaccucgucaugcugcacacauccgagcacgggggacgcgccuacagacaugcuguggaggaacugccugagaccauggaaacgcuccuucugcugggccucaugauccugcuuaccggcggggccaugcuguuucucauuagcggaaagggcaucgggaaaacauccaucggacugauuugugucaucgcgucuagcggcaugcuguggauggccgagauuccccuccaauggaucgcuuccgccauugugcuugaguucuuuaugaugguucugcugaucccugaacccgagaagcagcggaccccgcaggauaaucaacucgcuuauguggugauugggauccugacacuugccgcgaucauugccgcuaacgaaaugggacugcucgagaccacgaagcgcgaccugggcaugagcaaagaaccuggcgucguuucucccacauccuaccuggauguggaccuccaccccgccagcgcuuggacccuuuaugccguggcuacaaccgucaucaccccuaugcugagacauacaauugaaaauucuacggccaacgugagccuggcggccaucgcuaaccaggccguugugcucauggggcuggacaagggauggccgauuuccaaaauggaucuuggcgucccccugcucgcucuggggugcuacucucaggugaauccucugacccucacagccgccguccuucugcugaucacccacuacgcgaucauuggacccggccuccaggcuaaggccacacgggaggcucagaaacggaccgccgccgggaucaugaagaacccuacgguggacggaauuaucacaauugaucuggaccccguuaucuaugauagcaaguucgagaaacagcuuggccaggugaugcugcucguccugugugcugugcagcugcuccuuaugcgcaccuccugggcccugugcgaggcgcugacccucgccacaggcccuaucaccacacugugggaagggucuccgggaaaguuuuggaauacgaccauugcuguuagcauggccaacaucuuccggggcuccuaccuugcuggggccggacuggcguuuagcauuaugaaaucugugggcacagggaagagaggaaccggcucccaaggcgagacacucggggaaaaauggaagaagaaacugaaucagcugagccgcaaggaguucgaccucuauaaaaaguccggaaucaccgaggucgaucggacggaagccaaagagggccuuaagagaggggaaaccacacaucacgcugugucucggggaagcgccaaacugcaguggcugguggagcgcaacaugguuauucccgaaggcagagucaucgaccucggguguggacggggcggcugguccuacuauugcgcugggcugaagaaggugaccgaggugcgcggauacacaaaaggcgggccuggacacgaggaacccgucccuaugucuaccuauggcuggaauauuguuaaacuuaugagcgggaaagauguguuuuaccugcccccggagaagugugacacacuccugugcgauaucggagaauccagcccuucucccaccguggaggaguccagaacgauccggguccugaaaaugguggaacccuggcucaagaacaaucaguucuguauuaagguucuuaacccuuacaugcccgccgugaucgagcaucuggaacgccugcaaagaaaacacggcggcaugcucguccggaauccucugagccgcaacucuacacaugagauguauuggauuuccaaugggaccggaaacaucgugagcucuguuaauauggugagcagacuucugcucaaccgguucaccaugacacacagacgcccgacgauugaaaaggacgucgaucugggcgcugggacccggcacgugaacgccgagcccgagacaccuaauauggacgugaucggagaaagaaucaaacgcauuaaggaggaacauaacuccaccuggcacuacgacgaugagaaucccuauaaaacaugggcguaccauggcucuuaugaagucaaggccaccgggagcgcuuccagcaugaucaacggaguugugaagcugcucacaaaaccuugggacgugguccccauggugacccagauggccaugacggauaccacaccguuuggccagcaacggguuuucaaggagaaaguggacaccagaacaccucgccccaugccuggcacccggaaggucauggagauuacggcugaauggcuguggagaacacuugggcgcaauaaacggcccagacugugcacccgcgaggaauuuacaaagaaggugcggaccaacgccgccaugggagcgguuuucacggaggaaaaucagugggauuccgcuaaagccgccguggaggacgaggaauuuuggaagcucgucgauagagagcgcgaacugcacaaacuuggcaagugugggucuugcguguacaacaugaugggaaaaagagagaagaaacugggcgaguucgggaaggcuaagggcagccgggccaucugguauauguggcucggaucccgcuaccuggaauuugaggcucugggcuuccucaaugaagaccauugguuuucuagagagaacagcuacuccgggguugaaggagagggccugcacaaacuuggguauauucugcgggauaucucuaagaucccuggaggcgccauguacgcggacgauaccgccgggugggacacaagaauuaccgaggacgaucuccacaaugaagagaaaaucacacagcagauggaccccgaacaucggcugcuugcuaacgccauuuucaagcugaccuaucaaaauaaaguggucaaggugcagcgcccgacaccuaccggcacggucauggauaucauuagcagaaaggaccagcggggauccggccagguggggacauacggacucaacaccuuuaccaauauggaggcucaacugguucgccagauggaaggcgagggggugcugagcaaagccgaucucgagaacccccaucugcccgaaaagaaaaucacacaguggcuugagaccaagggagucgaaagacugaaacggauggcgaucucuggcgacgauugcguggugaagccuauugacgaucgcuucgccaacgcucuccuggcccuuaaugacauggggaagguuagaaaagauaucccgcaguggcaacccuccaagggcuggcaugacuggcaacaggugccuuuuuguagccaccacuuccaugagcugauuaugaaagauggacggaagcucgucgugcccugccgcccucaggacgaacugaucggcagagcucggauuucucaaggggccggauggucccugcgcgagacagcuugucucggcaaagccuaugcgcagauguggagccugauguacuuccacagacgggaccuucgccuggccucuaacgcuaucugcuccgccguucccgugcauugggucccuacgagcagaaccacaugguccauucacgcccaucaccaguggaugaccacagaggauaugcucaccguguggaaucgggucuggaucgaagacaaccccuggauggaggauaagacgccggugaccacaugggaaaauguuccuuaucuggggaagagagaggaccaaugguguggaagccuuaucggccugaccucucgcgcuacaugggcccagaacauucccaccgcgauccaacaggugcggagccucauugggaaugaggaauuucuggauuacaugccuuccaugaaaagauuccgcaaggaggaagagucugaaggcgcuaucugguga

SEQ ID NO: 20409 - RNA, 9873 nt, Artificial Sequence
  derived and/or modified CDS sequence (opt5) from DENV-3__FJ898462__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaaccaucgccccggauaucacacacaaaccgcuggcccuuggcaccuugggaagcuggagcucgacuuuaauuacugcgagggaacgacagugguuaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcacaugaucgcuggcguguucuuuacauucguucuucugcucagcgggcagauuaccuggcgcgauauggcccauacacugaucaugauuggauccaaugcgagcgacagaaugggcaugggggugaccuaucuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaccagcucuggacagcccugaucucccuuacguguagcaacaccauguucacacugaccguggcuuggcgcacagccacccucauucuggcuggcgugucccugcuuccggucugccaaucuagcuccaugcggaagacggacuggcugcccauggccguugccgcuaugggggugccuccccucccucuguuuaucuucucucucaaggauacacugaaaagacgcagcuggccccuuaaugagggagugauggcggucggccugguguccauccuggccucuagccuccugagaaacgacguuccuauggcugggccccuuguggccggaggccugcucauugccuguuaugucaucaccgggaccuccgcugaucugacaguggaaaaggccgcggacauuaccugggaggaagaggcugaacagacaggaguuagccacaaccucaugaucacgguggacgaugacggcaccaugcggauuaaagaugacgagacagagaauauccugaccguccuucugaagacagcccugcucaucgugucuggcgucuuuccguacuccauuccugccacccugcuuguguggcauacguggcagaaacagacccaacgcagcgggguucugugggaugugcccucuccucccgaaacacagaaggcugagcucgaagagggagucuacagaaucaaacagcagggcauuuucgggaagacccaagugggaguuggcgugcagaaggagggggucuuucacacaauguggcacgugacccggggagccgugcugacauauaacggcaaacgccucgaaccgaauugggcguccguuaagaaagaccugaucagcuacggcgggggauggagacuuucugcucaguggcaacggggcgaggaaguccaggugauugccguggagccugggaagaaccccaaaaauuuccagacgaugccuggaaccuuccagacaaccaccggcgaaaucggggccauugcucuggauuuuaagcccggaacauccggcagccccaucaucaaccgcgagggcaaggucguggggcuguauggaaauggcguugugacgaaaaacgggggauacgucuccggcauugcccaaaccaaugcugagccugacgggccgacacccgaacucgaggaagagauguucaagaaaagaaaccugaccaucauggaucuucauccuggcagcggaaagacacggaaauaucugcccgccauugugcgcgaagcgaucaagagacggcucagaacccugauucucgccccuacgcgcguuguggcugccgagauggaggaagcucugaagggccuucccauccgguaccagacaaccgccaccaaaucugagcacacagggagagaaaucgucgaccugaugugccaugccaccuuuacaaugcgccugcucagcccugugcggguuccgaauuauaaccugauuaucauggaugaggcucacuucaccgaccccgcguccauugccgcuagaggauacaucucuacgcgcgugggcaugggggaagccgccgcuauuuuuaugacagccaccccucccggaacagcggaugcuuucccucagagcaaugcccccauccaggacgaggagcgggacaucccggaaagauccuggaacucuggcaaugaguggauuaccgauuuugccgggaagacggucugguucgugccuagcaucaaagcuggcaacgacauugccaacugucuucgcaagaauggcaaaaaggugauccaacugucccggaagaccuuugauacagaauaccagaaaaccaagcucaacgacugggauuucgucguuacaaccgacauuucugagaugggagcgaauuuuaaagccgauagagugaucgacccccggcgcugccugaagcccgugauucugacagaugggccugagagagucauccucgcuggacccaugccugugaccgccgcuagcgccgcucagcggcgcggcagaguugggcggaacccgcagaaagaaaaugaccaauauaucuucacgggacagccccuuaacaaugaugaggaccaugcccacuggacagaagcgaagaugcugcuggacaacauuaauaccccugagggcaucauucccgcccucuucgaaccugagagagagaaguccgcugccaucgauggggaauaccgccugaaaggcgagagccggaagaccuuuguggaacuuaugagacgcggagaccugcccgucuggcucgcucacaaaguggccucugagggcauuaaguauacagaucggaaauggugcuucgacgggcagagaaacaaucagauccuggaagagaacauggauguugagaucuggaccaaggaaggagagaaaaagaagcugcgcccgcgguggcucgacgccagaacauacuccgauccucuugcucugaaagaauuuaaggacuucgcggccggccgcaaaagcauugcucuggaucucgugacggagaucgggagaguccccucucaucuggcccaccggacccgcaaugcccuugacaaccuggugaugcuccauacauccgaacacggaggcagagcuuaucggcacgccgucgaggagcugccugaaaccauggagacacugcuccuucugggccugaugauucuccugaccgggggagcgaugcuuuuucugaucagcggcaaggggauuggaaaaacguccaucggccucaucugugugauugccucuagcgggaugcuguggauggcugaaaucccccugcaauggauugccuccgcuaucguucucgaguucuuuaugauggugcuucugauuccugagcccgaaaagcagcgcaccccgcaggauaaucaacuggccuacguggucaucggcauucucacacuggcggccaucaucgcugccaacgagaugggccuucuggaaaccacaaagagagaccucggcaugagcaaagagccugggguugugucucccaccuccuaucuggauguggaccugcaucccgcuagcgccuggacgcucuacgcugucgccacaaccgugauuacaccuaugcuucggcacaccaucgaaaauucuaccgcgaacguuagccuggccgcuauugccaaccaggcugugguccugaugggacucgacaagggcuggccgaucuccaaaauggaucugggggugccccuucuggcccucggaugcuacucucaggucaauccucugacacugacggccgcggugcuccuucugauuacccauuaugcuaucaucggccccgggcugcaggccaaggcuacaagagaggcccaaaaacgcaccgccgcuggaauuaugaagaacccuacaguugacggcaucaugaccauugaucucgaccccgugaucuacgauagcaaguucgagaaacagcugggccaggucaugcuucuggugcucugugccguucagcugcugcucaugcggacguccugggcgcuuugcgaagcccugacacuggcuaccgggccuauuaccacacucugggagggaucuccgggcaaguuuuggaauaccacaaucgccgugagcauggcuaacaucuucagaggguccuaucuggccggagcgggccuugccuuuagcauuaugaaaucugucgggacgggaaagcgcggcaccggcucccaaggggaaacacugggagagaaauggaagaagaaacucaaucagcugagccggaaggaguucgaccuguacaaaaaguccggcaucaccgagguggauagaacagaggcuaaagaagggcucaagcggggagagaccacgcaccaugccgugucucgcggcagcgcuaaacuucagugguuuguugaaagaaacauggucauucccgaggggcgggugaucgaccugggauguggccgcggcgggugguccuauuacugcgccggacugaagaaggugaccgaagucagaggcuauacaaaagggggaccuggccacgaggagcccguuccuaugucuaccuacggguggaauauugugaagcucaugagcggaaaagauguguucuaccugcccccggaaaagugugacacacuucugugcgauaucggcgaguccagcccuucucccauugucgaagagucccggaccauccgcgugcucaaaaugguugagcccuggcugaagaacaaucaguucuguaucaaggugcugaacccuuauaugcccacagucauugaacaccucgagagacuucaacggaaacauggcgggaugcuggugcgcaauccucugagcagaaacucuacccacgaaauguacuggaucuccaauggaacgggcaacauuguugcuagcgugaauauggucucucggcuccugcuuaacagauuuacaaugacccaucgccggccgaccaucgagaaggacguggaucugggggccggaacaagacacgugaacgcggaacccgagacgccuaauauggacgucauuggcgagcgcaucaaacggaucaaggaagaacacaacagcaccuggcauuaugacgaugaaaaucccuacaaaacaugggccuaucacggguccuacgagguuaaggcuaccggaucugccagcuccaugauuaacggcguggugaagcuccugacaaaaccuugggacgucgugcccaugguuacccagauggcuaugacagauaccacgccguucggccagcaaagaguguuuaaggaaaaagucgacacccgcacaccucggagcaugcccgggaccagacgcgugaugggaaucacagccgaguggcuguggcggacccucggcagaaauaagaaaccucgccugugcacgcgggaggaguucacaaagaagguuagaaccaacgccgcgaugggggcuguguuuacagaggaaaaucagugggauuccgccaaagccgcugucgaggacgaagauuucuggaaacuuguggaccgcgagagagagcugcauaaacucggaaaguguggcucuugcguuuauaacaugauggggaaacgggaaaagaaacugggcgaguuuggaaaggccaagggcagccgcgcuauuugguacauguggcuuggggccagauaccuggaguucgaggcgcucggauuucugaaugaggaucacugguucucccgggaaaacucuuauagcggcguggagggggaaggacugcauaaacucggcuacauccugagagacauuuccaagauccccgggggcgccauguaugcugaugacaccgccggaugggacacgcggaucaccgaggaugaccuucacaaugaagagaaaauuacacagcagauggauccugagcaccgccaacuggcuaacgccaucuuuaagcucaccuaccagaauaaagucgugaagguccagagacccacaccgaccggcacagugauggacauuaucucucggaaggaucagcgcgggagcggacaaguuggcaccuaugggcugaacacguucacaaauauggaagcgcagcuuauuagacagauggagggagaaggcgugcuguccaaagccgaccucgagaacccucaucugcccgaaaagaaaaucacccaguggcuggagaccaagggggucgagcggcucaaacgcauggcuaucagcggcgaugacugcguggugaagcccauugaugacagauuugccaacgcucugcuugcccugaaugauaugggaaagguucggaaagacaucccucaauggcagccgucuaagggcuggcacgauuggcaacaggugcccuucuguucccaucacuuccacgaacucauuaugaaagacgggcgcaagcuggucgugccuugcagaccccaagacgagcuuaucggacgggcucgcauuagccagggcgccggguggucucugagagaaacagcgugucucggaaaagccuacgcucagauguggucccugauguauuuucaucggcgcgaucugagacucgccagcaacgccaucugcucugcuguuccugugcacuggguccccaccucccggacaacguggagcauucaugcccaccaucaauggaugaccacagaggacaugcugaccguguggaauagagucuggaucgaagauaacccuuggauggaggacaagacacccgugaccacgugggagaauguuccguaccuuggcaagcgcgaagaucaguggugugggucccugaucggccucaccagccgggcgacaugggcucagaacauuccuaccgccauccagcaagugagaucucugauuggaaaugaggaguuccuugacuacaugcccagcaugaaacgcuuucggaaggaggaggaauccgagggcgccaucugguga

SEQ ID NO: 20410 - RNA, 9873 nt, Artificial Sequence
  derived and/or modified CDS sequence (opt5) from DENV-3__KF955473__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccauccuucgcaaacuguguauugagggaaagaucaccaacauuacaaccgauuccagaugcccuacgcagggcgaagcggugcucccggaggaacaggaccagaauuauguguguaaacacacauacgucgaucggggcugggggaacggaugcggccuguucgggaagggaagccuugugaccugcgccaaguuucaaugucuggagcccaucgagggcaaaguugugcaguaugaaaaucucaaguacaccgucaucauuacagugcauaccggggaccagcaccagguuggaaacgagacacaaggcgugacggcugaaaucaccccucaggccucuacaaccgaggcuauucugcccgaauauggcacacuggggcucgagugcuccccucgcaccggacuggacuucaaugagaugauccuucugacgaugaaaaacaaggccuggaugguccauagacagugguuuuucgaucucccccugccguggaccagcggcgccacaaccgaaacaccuaccuggaaucggaaagagcuucuggugacguuuaagaacgcucacgcgaaaaagcaagaagucgugguucucgggucucaggagggagccaugcacacagcucugaccggcgccacagaaauucaaaauuccgggggcaccagcaucuucgccggacaucugaagugucgccucaaaauggacaagcuggagcuuaaaggcaugucuuacgcuaugugcaccaacacauuugugcugaagaaagaggucuccgaaacgcagcacgggaccauccucauuaagguggaguacaagggagaagaugcccccuguaaaaucccuuucagcacagaggacggccaagggaaggcgcauaacggaagacugauuaccgcuaaucccguugugaccaagaaggaggaacccgucaacaucgaggccgaaccuccguucggcgaguccaauauugugaucgggaucggcgauaacgcccugaaaauuaauugguauaagaagggaucuagcaucggcaaaauguuugaagcuaccgccagaggggcuagacgcauggccauucuuggagacacggcgugggauuucggcuccgucgggggaguucucaacagccugggcaagaugguccaccagaucuuugggucugccuacacagcucuguucuccggcgugagcugggugaugaaaauuggaaucggcguccuccugaccuggauugggcuuaauucuaagaacaccagcauguccuuuucuugcaucgccaucggaauuaucacacuguaucucggcgcugugguucaggccgacauggggugugugauuaauuggaaaggaaaggagcugaagugcggcagcgggaucuucgucaccaacgaggugcauacauggacggaacaguacaaauuucaagcggauucccccaagcggcuggccaccgcuauugccggcgcuugggagaauggaguuuguggcaucagaagcacaacccgcauggaaaaccuucucuggaaacagaucgccaaugagcugaacuauauucugugggaaaauaacaucaagcucacaguggucgugggggacauuaucggaguucuggagcagggcaaacggacccuuacgccucagcccauggagcugaaguacucuuggaaaaccugggggaaggccaagauugugacagcugaaacccaaaacuccagcuucaucaucgauggaccuaauacacccgagugcccgucugcguccagagccuggaacgucugggaaguggaggacuauggcuuuggcguguucaccacaaauauuuggcucaaacugcgcgaagucuacacccagcugugugaccaccggcuuaugagcgcugccguuaaggaugagagagccgugcacgcugacaugggguacuggaucgagucccagaaaaacggaucuuggaagcucgaaaaagccagccugauugaggugaagacgugcacauggccuaagucccauacccuguggucuaauggcguccucgaaagcgauaugaucauucccaaaucccuggcggggccuaucagccagcacaaccaucgccccggauaucacacccaaacagcuggcccuuggcaccuugggaagcuggagcucgacuuuaauuacugcgagggaaccacggugguuaucacagaaaacuguggcacccggggccccucucugagaacaaccacaguguccgggaaacugauucaugaguggugcugucgcagcugcacccuuccgccucuccgguauaugggagaagauggcuguugguacgggauggagaucagacccauuucugaaaaggaggagaauauggucaaaucccuggugagcgccggaucuggcaagguugacaacuucacgaugggggugcugugccucgccauccuguuugaagaggucaugcggggaaaguucggcaaaaagcacaugauugcuggcguguucuuuaccuucguucuucugcucagcgggcagaucacauggcgcgauauggcccauacccugauuaugaucggauccaaugcgagcgacagaaugggcaugggggugacauaucuggcucuuaucgccaccuuuaaaauucagcccuuccuggcccucggauuuuuccugcggaagcucacgucuagagaaaaccugcuucugggcgucgggcucgcuauggccacaacccugcaacugccugaggauaucgaacagauggcuaauggaauugcccuuggccugauggcgcucaaacugaucacacaguuugagaccuaccagcucuggaccgcccugauuucccuuacauguagcaacacgauguucacccugacaguggcuuggcgcaccgccacacucauccuggcuggcgugucccugcuuccggucugccaaucuagcuccaugcggaagaccgacuggcugcccauggccguugccgcuaugggggugccuccccucccucuguuuaucuucucucucaaggauacgcugaaaagacgcagcuggccccuuaaugagggagugauggcggucggccugguguccauucuggccucuagccuccugagaaacgacguuccuauggcugggccccuuguggccggaggccugcucaucgccuguuaugucauuacagggaccuccgcugaucugaccguggaaaaggccgcggacaucacaugggaggaagaggcugaacagaccggaguuagccacaaccucaugauuacaguggacgaugacggcacgaugcggaucaaagaugacgagaccgagaauauccugacaguccuucugaagaccgcccugcucauugugucuggcgucuuuccguacuccaucccugccacacugcuuguguggcauaccuggcagaaacagacgcaacgcagcgggguucugugggaugugcccucuccucccgaaacccagaaggcugagcucgaagagggagucuacagaauuaaacagcagggcaucuucgggaagacacaagugggaguuggcgugcagaaggagggggucuuucacaccauguggcacgugacacggggagccgugcugaccuauaacggcaaacgccucgaaccgaauugggcguccguuaagaaagaccugauuagcuacggcgggggauggagacuuucugcucaguggcaaaagggcgaggaaguccaggugaucgccguggagccugggaaaaaccccaagaauuuccagacaaugccuggaacguuccagaccacaaccggcgaaauuggggccaucgcucuggauuuuaagcccggaaccuccggcagccccaucauuaaccgggagggcaaagucguggggcuguauggaaauggcguugugacaaagaacgggggauacgucuccggcaucgcccaaacgaaugcugagccugacgggccgacccccgaacucgaggaagagauguucaaaaagcgcaaccugacaauuauggaucuucauccuggcagcggaaaaaccagaaaguaucugcccgccaucgugcgggaagcgauuaagcgcagacuccggacacugauccucgccccuaccagaguuguggcugccgagauggaggaagcucugaaaggccuucccauccgcuaccagacgacagccaccaagucugagcacaccgggcgggaaauugucgaccugaugugccaugccacauuuaccaugagacugcucagcccugugcgcguuccgaauuauaaccugaucauuauggaugaggcucacuucacagaccccgcguccaucgccgcucggggauacauuucuaccagagugggcaugggggaagccgccgcuaucuuuaugacggccacaccucccggaaccgcggaugcuuucccucagagcaaugcccccauccaggacgaggagcgcgacauuccggaacgguccuggaacucuggcaaugaguggaucacagauuuugccgggaaaaccgucugguucgugccuagcauuaaggcuggcaacgacaucgccaacugucuucgcaaaaauggaaagaaggugauucaacuguccagaaaaacguuugauaccgaauaccagaagacaaaacucaacgacugggauuucgucguuaccacagacaucucugagaugggcgcgaauuuuaaggccgaucgggugauugaccccagacggugccugaaacccgugauccugaccgaugggccugagcgcgucauccucgcuggacccaugccugugacagccgcuagcgccgcucagagacggggccgcguugggagaaacccgcagaaggaaaaugaccaauauauuuucaccggacagccccuuaacaaugaugaggaccaugcccacuggacggaagcgaagaugcugcuggacaacaucaauacaccugagggcauuauccccgcccucuucgaaccugagcgggagaaauccgcugccauugauggggaauacagacugaagggcgagagccgcaaaaccuuuguggaacuuaugcggagaggagaccugcccgucuggcucgcucacaagguggccucugagggcaucaaauauaccgaucgcaaguggugcuucgacgggcagcggaacaaucagauccuggaagagaacauggauguugagauuuggacaaaagaaggagagaagaagaaacugagaccgcgcuggcucgacgcccggaccuacuccgauccucuugcucugaaggaauuuaaagacuucgcggccggcagaaagagcaucgcucuggaucucgugacagagauugggcgcguccccucucaucuggcccacagaacgcggaaugcccuugacaaccuggugaugcuccauaccuccgaacacggaggccgcgcuuauagacacgccgucgaggagcugccugaaacaauggagacccugcuccuucugggccugaugauccuccugacagggggagcgaugcuuuuucugauuagcggcaaagggaucggaaagaccuccaucggccucauuugugugaucgccucuagcgggaugcuguggauggcugaaauuccccugcaauggaucgccuccgcuauuguucucgaguucuuuaugauggugcuucugaucccugagcccgaaaagcagcggacgccgcaggauaaucaacuggccuacguggucauuggaauccucacccuggcggccaucauugcugccaacgagaugggccuucuggaaacaaccaaacgcgaccucggcaugagcaaggagccugggguugugucucccacauccuaucuggauguggaccugcaucccgcuagcgccuggacccucuacgcugucgccacgacagugaucaccccuaugcuuagacacacaauugaaaauucuaccgcgaacguuagccuggccgcuaucgccaaccaggcugugguccugaugggacucgacaaaggcuggccgauuuccaagauggaucugggggugccccuucuggcccucggaugcuacucucaggucaauccucugacccugacagccgcggugcuccuucugaucacgcauuaugcuaucauuggccccgggcugcaggccaaagcuacccgggaggcccaaaagagaacagccgcuggaaucaugaagaacccuaccguugacggcauuaugacaaucgaucucgaccccgugauuuacgauagcaaauucgagaagcagcugggccaggucaugcuucuggugcucugugccguucagcugcugcucaugcgcaccuccugggcgcuuugcgaagcccugacgcuggcuacagggccuaucaccacccucugggagggaucuccgggcaaauuuuggaauacaaccaucgccgugagcauggcuaacauuuuccggggguccuaucuggccggagcgggccuugccuuuagcaucaugaagucugucgggacaggaaaaagaggcacgggcucccaaggggaaacccugggagagaaguggaagaaaaagcucaaucagcugagccgcaaagaguucgaccuguacaagaaauccggcauuacagagguggaucggaccgaggcuaaggaagggcucaaaagaggagagacaacccaccaugccgugucucggggcagcgcuaaacuucagugguuuguugaacgcaacauggucauccccgaggggagagugauugaccugggauguggccggggcgggugguccuauuacugcgccggacugaagaaagugacggaaguccgcggcuauaccaaagggggaccuggccacgaggagcccguuccuaugucuacauacggguggaauaucgugaaacucaugagcggaaaggauguguucuaccugcccccggaaaaaugugacacccuucugugcgauauuggcgaguccagcccuucucccacagucgaagaguccagaaccauccgggugcucaagaugguugagcccuggcugaagaacaaucaguucuguaucaaagugcugaacccuuauaugcccacagucauugaacaccucgagcgccuucaaagaaagcauggcgggaugcuggugcggaauccucugagccgcaacucuacccacgaaauguacuggaucuccaauggaacgggcaacauuguugcuagcgugaauauggucucuagacuccugcuuaaccgguuuacaaugacccauagacgcccgaccaucgagaaagacguggaucugggggccggaacacggcacgugaacgcggaacccgagacgccuaauauggacgucauuggcgagagaaucaagcgcaucaaagaagaacacaacagcaccuggcauuaugacgaugaaaaucccuacaagacaugggccuaucacggguccuacgagguuaaggcuaccggaucugccagcuccaugauuaacggcguggugaaacuccugacaaagccuugggacgucgugcccaugguuacccagauggcuaugacagauaccacgccguucggccagcaacggguguuuaaagaaaaggucgacaccagaacaccucgcagcaugcccgggacccggagagugaugggaaucacagccgaguggcuguggcgcacccucggccggaauaaaaagccuagacugugcacgcgcgaggaguucacaaagaaaguucggaccaacgccgcgaugggggcuguguuuacagaggaaaaucagugggauuccgccaaggccgcugucgaggacgaagauuucuggaaacuuguggacagagagcgcgagcugcauaagcucggaaaauguggcucuugcguuuauaacaugauggggaagagagagaagaagcugggcgaguuuggaaaggccaaaggcagccgggcuauuugguacauguggcuuggggcccgcuaccuggaguucgaggcgcucggauuucugaaugaggaucacugguucuccagagaaaacucuuauagcggcguggagggggaaggacugcauaagcucggcuacauccugcgggacauuuccaaaauccccgggggcgccauguaugcugaugacaccgccggaugggacacgagaaucaccgaggaugaccuucacaaugaagagaagauuacacagcagauggauccugagcaccggcaacuggcuaacgccaucuuuaaacucaccuaccagaauaaggucgugaagguccagcgccccacaccgaccggcacagugauggacauuaucucuagaaaagaucagcgggggagcggacaaguuggcaccuaugggcugaacacguucacaaauauggaagcgcagcuuauucgccagauggagggagaaggcgugcuguccaaggccgaccucgagaacccucaucugcccgagaaaaagaucacccaguggcuggagaccaaaggggucgagagacucaagcggauggcuaucagcggcgaugacugcguggugaagcccauugaugaccgcuuugccaacgcucugcuugcccugaaugauaugggaaaaguuagaaaggacaucccucaauggcagccgucuaaaggcuggcacgauuggcaacaggugcccuucuguucccaucacuuccacgaacucauuaugaaggacgggcggaaacuggucgugccuugccgcccccaagacgagcuuaucggacgggcucggauuagccagggcgccggguggucucugcgcgaaacagcgugucucggaaaggccuacgcucagauguggucccugauguauuuucauagacgggaucugcgccucgccagcaacgccaucugcucugcuguuccugugcacuggguccccaccuccagaacaacguggagcauucaugcccaccaucaauggaugaccacagaggacaugcugaccguguggaaucgggucuggaucgaagauaacccuuggauggaggacaagacacccgugaccacgugggagaauguuccguaccuuggcaaaagagaagaucaguggugugggucccugaucggccucaccagccgcgcgacaugggcucagaacauuccuaccgccauccagcaagugcggucucugauuggaaaugaggaguuccuugacuacaugcccagcaugaagagauuucgcaaagaggaggaauccgagggcgccaucugguga

SEQ ID NO: 20411 - RNA, 9873 nt, Artificial Sequence
  derived and/or modified CDS sequence (opt5) from DENV-3__FJ850079__SS-prME
acaagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacguggaggcugaaccuccguucggcgaguccaauauuguuaucgggauuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuacgggaguccuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgugugggaagucgaggacuauggcuuuggcguuuucaccacgaauauuuggcucaaacugcgcgaaguguacacacagcugugugaccaccggcuuaugagcgccgcugugaaggaugagagagccguccacgccgacaugggguacuggaucgagucccagaaaaacggaucuuggaagcucgaaaaagcuagccugaucgaggugaagaccugcaccuggccuaagucccauacacuguggucuaauggcguucucgaaagcgauaugauuauccccaaaucccuggccgggccuauuagccagcacaacuaucgccccggauaccauacccaaacggcgggcccuuggcaccuugggaagcuggagcucgacuuuaauuauugcgagggaacaaccguggucaucacagaaaacuguggcacccggggccccucucugagaacaaccacgguguccgggaaacugauucacgaguggugcugucgcagcugcacccuuccgccucuccgguacaugggagaagauggcuguugguaugggauggagaucagacccaucucugaaaaggaggagaauaugguuaaaucccuggugagcgcuggaucuggcgaagucgacaacuucacaaugggggugcugugccucgccauucuguuugaggaaguuaugcggggaaaguucggcaagaaacauaugaucgccggcguguucuuuaccuucguccuucugcucagcgggcagauuacauggcgcgauauggcucacacccugaucaugauuggauccaaugccagcgacagaaugggcaugggggugacguaccuggcgcuuaucgcuacauuuaagauucagcccuuccuggcccucggauuuuuccugcggaaacucaccucuagagagaaccugcuucugggcguggggcucgccauggcuacaacccugcaacugccugaagauaucgagcagauggccaauggaaucgcucuuggccugauggcccucaagcugauuacccaguuugagacauaucagcucuggacggcgcugaucucccuuaccuguagcaacacaauuuucacccugacagucgccuggcgcaccgcuacgcucauccuggccggcguuucccugcuuccggugugccaaucuagcuccaugcggaaaacagacuggcugcccaugaccguggcugccaugggggucccuccccucccucuguuuauuuucucucucaaggauacccugaagagacgcagcuggccccuuaaugaaggagugauggccguuggccugguguccauccuggcuucuagccuccugagaaacgacgucccuauggcggggccccuuguggccggaggccugcucaucgcuuguuacguuauuacagggaccuccgccgaucugacaguggagaaagccgcugacgucacgugggaagaggaagccgagcagaccggagugagccauaaccucaugaucacagucgacgaugacggcaccaugcggauuaaggaugacgagacagaaaauauccugaccgugcuucugaaaacggcgcugcucauuguuucuggcaucuuuccguacuccaucccugcuacccugcuuguguggcacacauggcagaagcagacccaacgcagcgggguccugugggaugugcccucuccucccgagacacagaaagccgaacucgaggagggaguuuauagaauuaagcagcagggcaucuucgggaaaacccaagugggagucggcgugcagaaggaagggguguuucauacaauguggcacguuacgcggggagccguccugaccuacaacggcaagcgccucgagccgaauugggcuuccgugaaaaaggaccugauuagcuauggcgggggauggagacuuucugcccaguggcaaaaaggcgaagaggugcaggucaucgcgguggaaccugggaagaaccccaaaaauuuccagacaaugccuggaaccuuccagaccacaacgggcgagauuggggcuaucgcccuggauuuuaagcccggaaccuccggcagccccauuaucaaccgggagggcaagguuguggggcuguacggaaauggcgucgugaccaagaacgggggauauguuuccggcaucgcccaaaccaaugcugaaccugacgggccgacacccgagcucgaagaggaaauguucaagaaacgcaaccugaccauuauggaucuucacccuggcagcggaaagacgagaaaauaccugcccgccaucgugcgggaggcuauuaagcgcagacuccggacacugauccucgccccuaccagagucguggcggccgagauggaagaggcucugaagggccuucccauucgcuaucagaccacagccaccaaaucugaacauacagggcgggagaucguugaccugaugugccacgcuaccuuuacgaugagacugcucagcccugugcgcgucccgaauuacaaccugaucauuauggaugaagcccauuucacagaccccgccuccaucgcugcgcggggauacauuucuaccagagugggcaugggggaggccgcugccaucuuuaugacagccaccccucccggaacggcugaugccuucccucagagcaaugcgcccauucaggacgaggaacgcgacaucccggagcgguccuggaacucuggcaaugaauggaucaccgauuuugcugggaagacagugugguucgucccuagcauuaaagccggcaacgacaucgccaacugucuuagaaagaauggcaaaaagguuauucaacugucccgcaagaccuuugauacagaguaucagaaaaccaagcucaacgacugggauuucguggugacaaccgacaucucugagaugggagcuaauuuuaaagccgaucgggucauugaccccagacggugccugaagcccgugauccugacggaugggccugaacgcguuauucucgcgggacccaugccugugacagccgcuagcgccgcucagagacggggccgcgucgggagaaacccgcagaaagagaaugaccaauacaucuucaccggacagccccuuaacaaugaugaagaccacgcccauuggaccgaggcuaagaugcugcuggacaacaucaauacaccugaaggcauuauccccgcccucuucgagccugagcgggaaaaguccgcggccauugauggggaguauagacugaaaggcgaaagccgcaagaccuuuguggagcuuaugcggagaggagaccugcccguuuggcucgcucacaaaguggccucugaaggcaucaaguacacagaucgcaaauggugcuucgacgggcagcggaacaaucagauucuggaggagaacauggaugucgaaaucuggacgaaggagggagagaagaagaagcugagaccgcgcuggcucgacgcucggaccuauuccgauccucuugcccugaaagaguuuaaggacuucgccgcuggcagaaaaagcaucgcgcuggaucucgugacagaaauugggcgcguccccacccaccuggcccauagaacacggaaugcucuugacaaccuggugaugcuccacaccucugagcauggaggcaaggccuaccgccacgccguugaggaacugccugagacgauggaaacccugcuccuucugggccugaugauccuccugacagggggagcuaugcuuuuucugauuuccggcaaagggaucggaaagaccagcauuggccucaucugugugaucgccuccucugggaugcuguggauggcggagauuccccugcaauggaucgccagcgcuauugugcucgaguucuuuaugaugguccuucugaucccugaacccgagaagcagagaacaccgcaggauaaucaacuggccuauguugugauuggaauccucacccuggcugccauuaucgcggccaacgaaaugggccuucuggagacgacaaaacgggaccucggcauguccaaggaaccugggguggucagccccaccucuuaccuggauguggaccugcaccccgcuuccgccuggacacucuacgcuguugccaccaccgugaucacaccuaugcuucgccauacgauugagaauagcaccgcuaacgucucucuggccgcgaucgccaaccaggcugugguccugaugggacucgacaaaggcuggccgauuagcaagauggaucugggggugccccuucuggcccucggaugcuauucccagguuaauccucugacacugaccgcugccgugcuccuucugaucacacacuacgccauuaucggccccgggcugcaggcgaaagcuaccagagaggcccaaaagcggacggcugccggaaucaugaagaacccuacagucgacggcauuaugaccaucgaucucgaccccgugauuuaugauucuaaauucgaaaagcagcugggccagguuaugcuucuggugcucugugccguccagcugcugcucaugagaaccagcugggcucuuugcgaggcccugacacuggcgaccgggccuaucacaacgcucugggaaggauccccgggcaaauuuuggaauaccacaauugccgugucuauggcuaacaucuuccgcgggagcuaccuggccggagcuggccuugccuuuuccaucaugaaaagcguggggaccggaaaacggggcacaggcucucaaggggagacccugggagaaaaguggaagaaaaagcucaaucagcuguccagaaaagaguucgaccuguauaagaaaagcggcauuacggagguugaucgcaccgaagcgaaggaggggcucaaacggggagaaaucacacaucacgccgucuccagaggcucugcuaaacuucagugguuuguggagcggaacauggugauucccgaagggcgcgucaucgaccugggauguggcagaggcggguggagcuacuauugcgccggacugaagaaaguuaccgaggugcggggcuacacaaaagggggaccuggccaugaggaacccgugccuauguccaccuacggguggaauauugucaaacucaugucuggaaaggauguguucuaucugcccccggagaaaugugacacacuucugugcgauaucggcgaaagcuccccuagccccaccguugaggagucucgcacgauuagagugcucaagauggucgaacccuggcugaagaacaaucaguucuguaucaaagugcugaacccuuacaugcccacaguuaucgagcaccucgaacggcuucaacgcaagcacggcgggaugcuggugagaaauccucugucccggaacagcacccaugagauguauuggauuucuaauggaaccggcaacaucgucgcuuccgugaauauggugagccgccuccugcuuaacagauuuacaaugacgcaccggagaccgaccauugaaaaagacgucgaucugggggccggaacacgccauguuaacgcugagcccgagaccccuaauauggacgugaucggcgaacggauuaagagaaucaaagaggaacacgacucuacauggcacuacgaugacgagaaccccuauaagaccugggccuaccaugggagcuaugaagugaaggcgacaggauccgccucuagcaugaucaauggcgucgugaaacuccugaccaagccuugggauguugugcccauggucacgcagauggcuaugaccgacacaaccccguucggccagcaacgcguguuuaaagagaagguugauacacggaccccuagauccaugcccgggacgcgccgggugaugggaauuacagccgaguggcuguggagaacccucggccgcaacaaaaagccucggcugugcacaagagaagaguucaccaagaaaguccgcacgaaugcugccaugggggccguguuuaccgaagagaaccagugggacagcgcgaaggcugccguugaagaugaggacuucuggaaacuuguggaucgggagagagaacugcacaagcucggaaaauguggcuccugcgucuacaauaugauggggaagcgcgagaaaaagcugggcgaauuuggaaaggccaaaggcucuagagcuaucugguacauguggcuuggggcccgguaucuggaguucgaggcucucggauuucugaacgaagaccauugguucagccgcgaaaauuccuacucuggcguggagggggagggacugcacaagcucggcuauauucugagagauaucagcaaaauucccgggggcgccauguacgcggacgacacagccggaugggauacccggaucacagaagacgaucuucauaacgaggagaagaucacccagcagauggacccugaacacagacaacuggcuaaugccauuuuuaaacucacauaucagaacaaggucgugaagguucagcggcccaccccgacgggcacagugauggauaucauuucccgcaaagaccagagagggucuggacaagucggcaccuacgggcugaauaccuucacaaacauggaggcucagcuuauccggcagauggaaggagagggcgugcugagcaaggccgaucucgaaaauccucaucugcccgagaaaaagauuacccaguggcuggagacaaaagggguggaacgccucaagagaauggcgaucuccggcgacgauugcguugugaagcccaucgacgaucgguuugccaacgcucugcuugcccugaacgacaugggaaaaguccgcaaggauauuccucaauggcagccgagcaaaggcuggcaugacuggcaacaggugcccuucuguucucaccauuuccacgagcucaucaugaaggacgggagaaaacugguugugccuugccggccccaagaugaacuuauuggacgcgcuagaaucucccagggcgccggguggagccugcgggagacggcuugucucggaaaggccuaugcgcagauguggucucugauguacuuucaccgcagagaccugcggcucgccuccaaugcuauuugcagcgccgucccugugcauuggguccccaccucucgcacaaccugguccauccacgcccaucaccaauggaugacaaccgaagauaugcugacgguguggaacagaguuuggauugaggacaauccuuggauggaggauaagacccccgugacaaccugggaaaacgucccguaccuuggcaaacgggaggaccaguggugugggagccugaucggccucacauccagagcuaccugggcccagaauaucccuacggcgauucagcaagugcgcagccugaucggaaacgaagaguuccuugauuauaugcccucuaugaagcgguuuagaaaagaggaagagagcgaaggcgcuauuugguga

SEQ ID NO: 20412 - RNA, 9873 nt, Artificial Sequence
  derived and/or modified CDS sequence (opt5) from DENV-3__FJ850080__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcacagacgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaugagcccgucaacauugaagccgagccuccguucggcgaauccaauaucgugauugggaucggcgacaacgcccugaaaaucaauugguauaagaagggaucuagcauuggcaaaauguuugaggcuacggccagaggggcuagacgcauggccauccuuggagauacagcgugggacuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgauauggggugugugaucaauuggaaaggaaaggaacugaagugcggcagcgggauuuucgucacaaacgaggugcauacguggaccgagcaguacaaauuucaagcggacucccccaagcggcuggccacagcuaucgccggcgcuugggaaaauggaguuuguggcauuagaagcaccacacgcauggagaaccuucucuggaaacagguggccaaugaacugaacuauauccugugggagaauaacaucaagcucaccgucgugguuggggauauuaucggagugcuggaacagggcaaacggacgcuuaccccucagcccauggagcugaaguacucuuggaaaacaugggggaaggccaagauugucaccgcugagacacaaaacuccagcuucaucauugacggaccuaauacccccgaaugcccgucugcguccagagccuggaacgugugggagguggaagacuauggcuuuggcgucuucacaaccaauaucuggcucaaacugcgcgagguuuacacgcagcugugugaucaccggcuuaugagcgcugccgugaaggacgaaagagccgugcacgcugauaugggguacuggaucgagucccagaaaaacggaucuuggaagcucgagaaagccagccugauugaagucaagacaugcaccuggccuaagucccauacccuguggucuaauggcgugcucgagagcgacaugaucauucccaaaucccuggcggggccuaucagccagcacaaccaucgccccggauaucacacacaaaccgcuggcccuuggcaccuugggaagcuggaacucgauuuuaauuacugcgagggaacgacaguugugauuaccgagaacuguggcacacggggccccucucugagaaccacaaccgucuccgggaaacugauccaugaauggugcugucgcagcugcacgcuuccgccucuccgguauaugggagaggacggcuguugguacgggauggaaaucagacccauuucugagaaggaagagaauauggugaaaucccugguuagcgccggaucuggcaagguggauaacuucaccauggggguccugugccucgccauccuguuugaggaagugaugcggggaaaguucggcaaaaagcacaugauugcuggcguuuucuuuauguucgugcuucugcucagcgggcagaucacauggcgcgacauggcccauacccugauuaugaucggauccaaugcgagcgauagaaugggcaugggggucacauaucuggcucuuauugccaccuuuaaaauccagcccuuccuggcccucggauuuuuccugcggaagcucacgucuagagagaaccugcuucugggcguggggcucgcuauggccacaacccugcaacugccugaagacaucgagcagauggcuaauggaauugcccuuggccugauggcgcucaaacugaucacacaguuugaaaccuaccagcucuggaccgcccugauuucccuuacauguagcaacacgauguucacccugacaguggcuuggcgcaccgccacacucauccuggcuggcgucucccugcuuccgguuugccaaucuagcuccaugcggaagaccgauuggcugcccauggccguggccgcuaugggggugccuccccucccucuguuuauuuucucucucaaggacacgcugaaaagacgcagcuggccccuuaaugagggagucauggcggugggccugguuuccauccuggccucuagccuccugagaaacgaugugccuauggcugggccccuugucgccggaggccugcucaucgccuguuaugugauuacagggaccuccgcugaccugaccguugagaaggccgcggacaucacaugggaagaggaagcugagcagaccggagugagccacaaccucaugauuacagucgaugacgauggcacgaugcggaucaaagacgaugaaaccgagaauauucugacagugcuucugaagaccgcccugcucaucgucucuggcguguuuccguacuccaucccugccacacugcuuguuuggcauaccuggcagaaacagacgcaacgcagcggggugcugugggacguccccucuccucccgagacccagaaggcugaacucgaggaaggaguguacagaauuaaacagcagggcaucuucgggaagacacaaguuggagugggcguccagaaggaggggguguuucacaccauguggcacgugacacggggagccguucugaccuauaacggcaaacgccucgagccgaauugggcguccgucaagaaagaucugauuagcuacggcgggggauggagacuuucugcucaguggcaaaagggcgaagagguccaggugaucgccgucgaaccugggaaaaaccccaagaauuuccagacaaugccuggaacguuccagaccacaaccggcgagauuggggccaucgcucuggacuuuaagcccggaaccuccggcagccccauuaucaaccgggaaggcaaagugguugggcuguauggaaauggcguggucacaaagaacgggggauacguguccggcaucgcccaaacgaaugcugagccugaugggccgacccccgagcucgaagaggaaauguucaaaaagcgcaaccugacaauuauggaccuucauccuggcagcggaaaaaccagaaaguaucugcccgccaucguucgggaggcgauuaagcgcagacuccggacacugauccucgccccuaccagaguggucgcugccgaaauggaggaggcucugaaaggccuucccauucgcuaccagacgacagccaccaagucugaacacaccgggcgggagaucguggaucugaugugccaugccacauuuaccaugagacugcucagcccuguucgcgugccgaauuauaaccugaucauuauggacgaagcucacuucacagaucccgcguccaucgccgcucggggauacauuucuaccagagucggcaugggggaggccgccgcuaucuuuaugacggccacaccucccggaaccgcggacgcuuucccucagagcaaugcccccauucaggacgaggaacgcgauaucccggagcgguccuggaacucuggcaaugaauggaucacagacuuugccgggaaaaccgugugguucgugccuagcauuaaggcuggcaacgauaucgccaacugucuucgcaaaaauggaaagaaggucauucaacuguccagaaaaacguuugacaccgaguaccagaagacaaaacucaacgauugggacuucguugugaccacagauaucucugaaaugggcgcgaauuuuaaggccgaccgggugauugaucccagacggugccugaaacccgucauccugaccgacgggccugagcgcgugauucucgcuggacccaugccuguuacagccgcuagcgccgcucagagacggggccgcguggggagaaacccgcagaaggagaaugaucaauauaucuucaccggacagccccuuaacaaugacgaagaccaugcccacuggacggaggcgaagaugcugcuggauaacaucaauacaccugaaggcauuauccccgcccucuucgagccugaacgggagaaauccgcugccauugacggggaguacagacugaagggcgaaagccgcaaaaccuuugucgagcuuaugcggagaggagaucugcccguguggcucgcucacaagguugccucugaaggcaucaaauauaccgaccgcaaguggugcuucgaugggcagcggaacaaucagauucuggaggaaaacauggacguggagaucuggacaaaagagggagaaaagaagaaacugagaccgcgcuggcucgaugcccggaccuacuccgacccucuugcucugaaggaguuuaaagauuucgcggccggcagaaagagcaucgcucuggaccucgucacagaaauugggcgcgugcccucucaucuggcccacagaacgcggaaugcccuugauaaccuggucaugcuccauaccuccgagcacggaggccgcgcuuauagacacgccguggaggaacugccugagacaauggaaacccugcuccuucugggccugaugauccuccugacagggggagcgaugcuuuuucugauuagcggcaaagggaucggaaagaccuccauuggccucaucuguguuaucgccucuagcgggaugcuguggauggcugagauuccccugcaauggaucgccuccgcuauugugcucgaguucuuuaugauggugcuucugaucccugagcccgagaagcagcggacgccgcaggacaaucaacuggccuacgucguuauuggaauccucacccuggcggccauuaucgcugccaacgaaaugggccuucuggagacaaccaaacgcgaucucggcaugagcaaggaaccugggguggugucucccacauccuaucuggacgucgaccugcaucccgcuagcgccuggacccucuacgcuguggccacgacaguuaucaccccuaugcuuagacacacaauugaaaauucuaccgcgaacgugagccuggccgcuaucgccaaccaggcugucgugcugaugggacucgauaaaggcuggccgauuuccaagauggaccugggggucccccuucuggcccucggaugcuacucucaggugaauccucugacccugacagccgcgguucuccuucugaucacgcauuaugcuauuaucggccccgggcugcaggccaaagcuacccgggaagcccaaaagagaacagccgcuggaaucaugaagaacccuaccguggauggcauuaugacaaucgaccucgaucccgucauuuacgacagcaaauucgagaagcagcugggccaggugaugcuucugguucucugugccgugcagcugcugcucaugcgcaccuccugggcgcuuugcgaggcccugacgcuggcuacagggccuaucaccacccucugggaaggaucuccgggcaaauuuuggaauacaaccauugccgucagcauggcuaacaucuuccggggguccuaucuggccggagcgggccuugccuuuagcaucaugaagucuguggggacaggaaaaagaggcacgggcucccaaggggagacccugggagaaaaguggaagaaaaagcucaaucagcugagccgcaaagaguucgaucuguacaagaaauccggcauuacagaaguggaccggaccgaggcuaaggaggggcucaaaagaggagaaacaacccaccaugccguuucucggggcagcgcuaaacuucagugguuugucgagcgcaacauggugauccccgaagggagagugauugaucugggauguggccggggcgggugguccuauuacugcgccggacugaagaaagucacggagguucgcggcuauaccaaagggggaccuggccacgaggaacccgugccuaugucuacauacggguggaauaucauuaaacucaugagcggaaaggacguguucuaccugcccccggagaaaugugauacccuucugugcgacaucggcgaauccagcccuucucccacagucgaggaauccagaaccauucgggugcucaagaugguugagcccuggcugaagaacaaucaguucuguaucaaaauccugaacccuuauaugcccacagugauugagcaccucgaacgccuucaaagaaagcauggcgggaugcugguccggaauccucugagccgcaacucuacccacgagauguacuggaucuccaauggaacgggcaacauuguggcuagcguuaauauggugucuagacuccugcuuaaccgguuuacaaugacccauagacgcccgaccaucgaaaaagaugucgaccugggggccggaacacggcacgugaacgcggagcccgaaacgccuaauauggacgugauuggcgagagaaucaagcgcaucaaagaggaacacaacagcaccuggcauuaugaugacgagaaucccuacaagacaugggccuaucacggguccuacgaagucaaggcuaccggaucugccagcuccaugauuaacggcguugugaaacuccugacaaagccuugggaugugguccccauggugacccagauggcuaugacagacaccacgccguucggccagcaacggguuuuuaaagagaagguggauaccagaacaccucgcagcaugcccgggacccggagagucaugggaaucacagccgaauggcuguggcgcacccucggccggaauaaaaagccuagacugugcacgcgcgaggaguucacaaagaaagugcggaccaacgccgcgaugggggcuguuuuuacagaagagaaucagugggacuccgccaaggccgcuguggaagaugaggacuucuggaaacuugucgauagagaacgcgagcugcauaagcucggaaaauguggcucuugcguguauaacaugauggggaagagagagaaaaagcugggcgaauuuggaaaggccaaaggcagccgggcuauuugguacauguggcuuggggcccgcuaccuggaguucgaagcgcucggauuucugaaugaggaccacugguucuccagagagaacucuuauagcggcguugaaggggagggacugcauaagcucggcuacauccugcgggauauuuccaaaauccccgggggcgccauguaugcugacgacaccgccggaugggauacgagaaucaccgaagacgaucuucacaaugaggaaaagauuacacagcagauggacccugagcaccggcaacuggcuaacgccaucuuuaaacucaccuaccagaauaagguggucaaggugcagcgccccacaccgaccggcacagucauggauauuaucucuagaaaagaccagcgggggagcggacaagugggcaccuaugggcugaacacguucacaaauauggaggcgcagcuuauucgccagauggaaggagagggcguucuguccaaggccgaucucgaaaacccucaucugcccgagaaaaagaucacccaguggcuggaaaccaaagggguggagagacucaagcggauggcuaucagcggcgacgauugcgucgugaagcccauugacgaucgcuuugccaacgcucugcuugcccugaaugacaugggaaaagugagaaaggauaucccucaauggcagccgucuaaaggcuggcacgacuggcagcagguucccuucuguucccaucacuuccacgagcucauuaugaaggacgggcggaaacugguggucccuugccgcccccaagaugaacuuaucggacgggcucggauuagccagggcgccggguggucucugcgcgagacagcgugucucggaaaggccuacgcucagauguggucccugauguauuuucauagacgggaccugcgccucgccagcaacgccaucugcucugcugugccuguucacugggugcccaccuccagaacaacguggagcauucaugcccaccaucaauggaugaccacagaagauaugcugaccgucuggaaucggguguggaucgaggacaacccuuggauggaagauaagacacccgucaccacgugggaggacgugccguaccuuggcaaaagagaggaucaguggugugggucccugaucggccucaccagccgcgcgacaugggcucagaauauuccuaccgccauccagcaaguucggucucugauuggaaacgaagaguuccuugacuacaugcccagcaugaagagauuucgcaaagaagaggaguccgaaggcgccaucugguga

SEQ ID NO: 20413 - RNA, 9873 nt, Artificial Sequence
  derived and/or modified CDS sequence (opt5) from DENV-3__FJ850083__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcagcaugaaaaucucaaguauacagucaucaucaccgugcacacaggggaccagcaucagguuggaaacgagacgcaaggcgugaccgcugaaauuacaccucaggccucuaccacagaggcuauccugcccgaauacggcacccuggggcucgagugcuccccucgcacgggacuggacuucaaugagaugauucuucugaccaugaaaaacaaggccuggaugguccacagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcauaccgcucugacaggcgccaccgaaauccagaauuccgggggcaccagcauuuucgccggacaccugaagugucgccucaaaauggacaagcuggagcuuaaaggcaugucuuaugcuaugugcacaaacacguuugugcugaagagagaggucuccgaaacccagcaugggacaauccucaucaaaguggaguacaagggagaagaugcccccuguaagauuccuuucagcaccgaggacggccaagggaaagcgcacaacggacggcugaucacagcuaaucccguugugaccaagaaagaugagcccgucaacauugaagccgagccuccguucggcgaauccaauaucgugauugggaucggcgacaacgcccugaagaucaauugguacaaaaagggaucuagcauuggcaagauguuugaggcuacggccagaggggcucgccggauggccauccuuggagauacagcgugggacuucggcuccguggggggaguucucaacagccugggcaaaaugguccaucagauuuuugggucugccuauaccgcucuguucuccggcgugagcugggugaugaagaucggaauuggcguccuccugaccuggaucgggcuuaauucuaaaaacacaagcauguccuuuucuugcauugccaucggaaccaucacacuguaccucggcgcugugguucaggccgauauggggugugugauuaauuggaagggaaaagaacugaagugcggcagcgggaucuucgucacgaacgaggugcacaccuggacagagcaguauaaguuucaagcggacucccccaaaagacuggccaccgcuauugccggcgcuugggaaaauggaguuuguggcauccgcagcacaacccggauggagaaccuucucuggaagcagauugccaaugaacugaacuacauccugugggagaauaacaucaaacucacgguggucgugggggauauuaucggaguucuggaacagggcaagagaacccuuacaccucagcccauggagcugaaauauucuuggaagaccugggggaaagccaagauugugacagcugagacccaaaacuccagcuucaucauugacggaccuaauacacccgaaugcccgucugcgucccgcgccuggaacgucugggagguggaagacuacggcuuuggcguguucaccacgaauaucuggcucaagcugcgggaggucuauacacagcugugugaucacagacuuaugagcgcugccguuaaagacgaacgcgccgugcaugcugauaugggguacuggaucgagucccagaagaacggaucuuggaaacucgagaaggccagccugauugaagugaaaaccugcaccuggccuaagucccacacacuguggucuaauggcguccucgagagcgacaugaucauucccaagucccuggcggggccuaucagccagcauaaccaccggcccggauaccacacccaaacggcuggcccuuggcaucuugggaaacuggaacucgauuuuaauuauugcgagggaacaaccgugguuauuacagagaacuguggcaccagaggccccucucugcgcacaaccacgguguccgggaagcugauccacgaauggugcugucggagcugcacccuuccgccucucagauacaugggagaggacggcuguugguaugggauggaaauccggcccauuucugagaaagaagagaauauggucaagucccuggugagcgccggaucuggcaaaguugauaacuucacaaugggggugcugugccucgccauccuguuugaggaagucaugcgcggaaaguucggcaagaaacauaugauugcuggcguguucuuuaccuucguucuucugcucagcgggcagaucacauggagagacauggcccacacccugauuaugaucggauccaaugcgagcgaucggaugggcaugggggugacguaccuggcucuuauugccacauuuaagauccagcccuuccuggcccucggauuuuuccugagaaaacucaccucucgcgagaaccugcuucugggcgucgggcucgcuauggccacaacccugcaacugccugaagacaucgagcagauggcuaauggaauugcccuuggccugauggcgcucaagcugaucacccaguuugaaacauaucagcucuggacggcccugauuucccuuaccuguagcaacacaauguucacccugacaguggcuuggcggaccgccacgcucauccuggcuggcgugucccugcuuccggucugccaaucuagcuccaugagaaaaacagauuggcugcccauggccguugccgcuaugggggugccuccccucccucuguuuauuuucucucucaaggacacccugaagcgcagaagcuggccccuuaaugagggagugauggcggucggccugguguccauccuggccucuagccuccugcggaacgauguuccuauggcugggccccuuguggccggaggccugcucaucgccuguuacgucauuaccgggacauccgcugaccugaccguggagaaagccgcggacaucacaugggaagaggaagcugagcagacgggaguuagccauaaccucaugauuaccguggaugacgauggcacaaugcgcaucaaggacgaugaaaccgagaauauucugacaguccuucugaaaaccgcccugcucaucgugucuggcgucuuuccguauuccaucccugccacgcugcuuguguggcacaccuggcagaagcagacacaaagaagcgggguucugugggacgugcccucuccucccgagacccagaaagcugaacucgaggaaggagucuaccggauuaagcagcagggcaucuucgggaaaacacaagugggaguuggcgugcagaaggagggggucuuucacaccauguggcaugugacacgcggagccgugcugacguacaacggcaagagacucgagccgaauugggcguccguuaaaaaggaucugauuagcuauggcgggggauggcggcuuucugcucaguggcaaaaaggcgaagagguccaggugaucgccguggaaccugggaagaaccccaaaaauuuccagaccaugccuggaacauuccagaccaccacaggcgagauuggggccaucgcucuggacuuuaagcccggaacguccggcagccccauuaucaaccgcgaaggcaaggucguggggcuguacggaaauggcguugugaccaaaaacgggggauaugucuccggcaucgcccaaacaaaugcugagccugaugggccgacccccgagcucgaagaggaaauguucaagaaaagaaaccugacaauuauggaccuucacccuggcagcggaaagacccggaaauaccugcccgccaucgugcgcgaggcgauuaagagacggcucagaacgcugauccucgccccuacacgcguuguggcugccgaaauggaggaggcucugaagggccuucccauucgguaucagaccaccgccacaaaaucugaacauaccgggagagagaucgucgaucugaugugccacgccacauuuaccaugcgccugcucagcccugugcggguuccgaauuacaaccugaucauuauggacgaagcucauuucacggaucccgcguccaucgccgcuagaggauauauuucuacacgcgugggcaugggggaggccgccgcuaucuuuaugaccgccacaccucccggaaccgcggacgcuuucccucagagcaaugcccccauucaggacgaagagcgggauaucccggagagauccuggaacucuggcaaugaauggaucacggacuuugccgggaagaccgucugguucgugccuagcauuaaagcuggcaacgauaucgccaacugucuucgcaagaauggaaaaaaggugauucaacugucccggaagacauuugacaccgaguaccagaaaacaaagcucaacgauugggacuucgucguuaccacagauaucucugaaaugggcgcgaauuuuaaagccgacagagugauugauccccggcgcugccugaagcccgugauccugaccgacgggccugagagagucauucucgcuggacccaugccugugacggccgcuagcgccgcucagcggcgcggcagaguugggcggaacccgcagaaagagaaugaucaauacaucuucacaggacagccccuuaacaaugacgaagaccacgcccacuggaccgaggcgaagaugcugcuggauaacaucaauaccccugaaggcauuauccccgcccucuucgagccugaaagagagaaguccgcugccauugacggggaguaucgccugaaaggcgaaagccggaagacauuuguggagcuuaugagacgcggagaucugcccgucuggcucgcucauaaaguggccucugaaggcaucaaguacaccgaccggaaauggugcuucgaugggcagagaaacaaucagauucuggaggaaaacauggacguugagaucuggacaaaggagggagaaaaaaagaagcugcgcccgcgguggcucgaugccagaacguauuccgacccucuugcucugaaagaguuuaaggauuucgcggccggccgcaaaagcaucgcucuggaccucgugaccgaaauugggagaguccccucucaccuggcccaucggacacgcaaugcccuugauaaccuggugaugcuccacaccuccgagcacggaggcagagcuuaccggcaugccgucgaagagcugccugagacaauggaaacccugcuccuucugggccugaugauccuccugacggggggagcgaugcuuuuucugauuagcggcaaggggaucggaaaaaccuccauuggccucaucugugugaucgccucuagcgggaugcuguggauggcugagauuccccugcaauggaucgccuccgcuauuguucucgaauucuuuaugauggugcuucugaucccugagcccgagaagcagcgcacaccgcaggacaaucaacuggccuauguggucauuggaauccucacccuggcggccauuaucgcugccaacgaaaugggccuucuggagacaaccaagagagaucucggcaugagcaaagaaccugggguugugucucccacguccuaccuggacguggaccugcaccccgcuagcgccuggacacucuaugcugucgccaccacagugaucaccccuaugcuucggcauaccauugagaauucuacagcgaacguuagccuggccgcuaucgccaaccaggcugugguccugaugggacucgauaagggcuggccgauuuccaaaauggaccugggggugccccuucuggcccucggaugcuacucucaggucaauccucugacgcugaccgccgcggugcuccuucugaucacacacuacgcuauuaucggccccgggcugcaggccaaggcuaccagagaagcccaaaaacgcacagccgcuggaaucaugaagaacccuaccguugauggcauuaugacgaucgaccucgaucccgugauuuaugacagcaaguucgagaaacagcugggccaggucaugcuucuggugcucugugccguucagcugcugcucaugcggacauccugggcgcuuugcgaggcccugacccuggcuaccgggccuaucacaacccucugggaaggaucuccgggcaaguuuuggaauacaacgauugccgugagcauggcuaacaucuucagaggguccuaccuggccggagcgggccuugccuuuagcaucaugaaaucugucgggaccggaaagcgcggcacaggcucccaaggggagacccugggagaaaaauggaagaagaaacucaaucagcugagccggaaggaguucgaucuguauaaaaaguccggcauuacagaaguggacagaaccgaggcuaaagaggggcucaagcggggagaaacgacccaucacgccgugucucgcggcagcgcuaaacuucagugguuuguugagagaaacauggucauccccgaagggcgggugauugaucugggauguggccgcggcgggugguccuacuauugcgccggacugaagaaggugacagaggucagaggcuacaccaaagggggaccuggccacgaagagcccguuccuaugucuacauauggguggaauaucgugaagcucaugagcggaaaagacguguucuaccugcccccggagaagugugauacccuucugugcgacauuggcgaauccagcccuucucccacagucgaggaaucccggaccauccgcgugcucaaaaugguugagcccuggcugaagaacaaucaguucuguauuaagauccugaacccuuacaugcccacggugaucgagcaucucgaaagacuucaacggaaacacggcgggaugcugguccgcaauccucugagcagaaacucuacacaugagauguauuggauuuccaauggaaccggcaacaucguggcuagcguuaauauggugucucggcuccugcuuaacagauuuaccaugacacaccgccggccgacgauugaaaaggaugucgaccugggggccggaaccagacacgugaacgcggagcccgaaacaccuaauauggacgugaucggcgagcgcauuaaacggaucaaggaggaacauaacagcaccuggcacuacgaugacgagaaucccuauaaaacaugggccuaccauggguccuaugaagucaaggcuaccggaucugccagcuccaugaucaacggcguugugaagcuccugacaaaaccuugggaugugguccccauggugacccagauggcuaugacggacaccacaccguucggccagcaaagaguuuuuaaggagaaaguggauacccgcacaccucggagcaugcccgggaccagacgcgucaugggaauuacggccgaauggcuguggcggacacucggcagaaauaagaaaccucgccugugcacccgggaggaguucacaaagaaggugagaaccaacgccgcgaugggggcuguuuuuacggaagagaaucagugggacuccgccaaagccgcuguggaagaugaggacuucuggaagcuugucgaucgcgaaagagagcugcacaaacucggaaaguguggcucuugcguguacaacaugauggggaaacgggagaagaaacugggcgaauuuggaaaggccaagggcagccgcgcuaucugguauauguggcuuggggccagauaccuggaguucgaagcgcucggauuucugaaugaggaccauugguucucccgggagaacucuuacagcggcguugaaggggagggacugcacaaacucggcuauauucugagagauaucuccaagauucccgggggcgccauguacgcugacgacaccgccggaugggauacacggaucaccgaagacgaucuucacaaugaggaaaaaaucacacagcagauggacccugagcaucgccaacuggcuaacgccauuuuuaagcucaccuaucagaauaaaguggucaaggugcagagacccacaccgaccggcacggucauggauaucauuucucggaaggaccagcgcgggagcggacaagugggcacauacgggcugaacaccuucaccaauauggaggcgcagcuuaucagacagauggaaggagagggcguucuguccaaagccgaucucgaaaacccucaccugcccgagaagaaaauuacacaguggcuggaaaccaaggggguggagcggcucaaacgcauggcuaucagcggcgacgauugcgucgugaagcccaucgacgauagauuugccaacgcucugcuugcccugaaugacaugggaaaggugcggaaagauauuccucaauggcagccgucuaagggcuggcaugacuggcagcagguucccuucuguucccaccacuuccaugagcucaucaugaaagacgggcgcaagcugguggucccuugcagaccccaagaugaacuuauuggacgggcucgcaucagccagggcgccggguggucucugagagagacagcgugucucggaaaagccuaugcucagauguggucccugauguacuuucaccggcgcgaccugagacucgccagcaacgccauuugcucugcugugccuguucauugggugcccacgucccggaccacauggagcauccacgcccaucaccaauggaugaccacagaagauaugcugaccgucuggaauagaguguggauugaggacaacccuuggauggaagauaagacgcccgucaccacaugggaggacgugccguaucuuggcaagcgcgaggaucaguggugugggucccugaucggccucaccagccgggcgacaugggcucagaauaucccuaccgccauucagcaaguuagaucucugaucggaaacgaagaguuccuugacuacaugcccagcaugaaacgcuuucggaaggaagaggaguccgaaggcgccauuugguga
